United States Patent 7,365,185 (GENOMIC PLANT SEQUENCES AND USES THEREOF) - sequence listing, part 30

SEQ ID NO: 59502 - DNA, 20471 bp, Oryza sativa
ccccttaacgtcgctgctgccctcgtgtttctctatcaagtacgtacgcgtcattgtgggggtgtagggtcctcagtggcgtgcgccacagaggacacgcacgccgatgccatcgctgtcgtcctctaggcgggctaccgccgacaccttcattacacactggttggctagtgtagggagaaggtggctagtgcgttccacgaggcgcacgactgcctcttcctctgggtggacgtcgcaccggaccagatgcgctatgcagtggtacatatacgcaatggtgcacgtggacgacatgttgtggtgcaggttggtgggcgaggcgcacgccgtgttcaacgccggtcggggcagcctaccagagatgcacgagtacccgcttggctagcgtgatggtgctggagatggtgatgctgaggttgcggacatgctagagcgcacggtgcgcgacgtcaaggccaacacttacggctagcgtgcgctccatcaaggccaatacttatggctggctgttgtgcagcagcgcaggtggcgaagagcccaagacacgtcgactcccttaatgtaggtagatgcagttgcagtgttaattagtggtgtacggcgtaaaaggagatcaattttttgatgtgtttacaccttttttgacttgaaagttaaaatcaatcgtaactcccagccatcttttgaagtgttttccctgtactgcttattgcattgcaatgttgccacttctctttgtaacaggacataaatcttttttttttctgaaaaaaagaacggaagcctgccattagtgtaagagaaaatttcaagcaataatacagcacagaacatgataatattgtaaatttcttgattatccaactattagcacaggatggcctaatttcatagtatacgtcgtattatatcctgaacatcgatcgctattgacgaccatgttggtaatggtggataaccaaaccaaattgcacttccaccggtttactgtacccgtggtggttggataatgcagagtcacagggtgatctagaggttaattgtgttttttttatctccatctaagtaagaaaatttgaaacaaacggtctaatcttttcatttataattatacttatcagcgaaaattagaattttcaaccttaaatttggagtccatattaaggttttttcatcgaagtttatttttcagcctttgcttttagatcattacgaacacgtatataaaagttttatttgtaaatttttttcgtttgtaaatataccgtttggtttattcccggacccaataaaccatccgatggcctcctttgacgctctaaagtcatgtaatgaatatgtttttctcctacattcaagcgcgaaatgtttaaggagaaaagaaaattttgaaaatgtgtttgtttagatttattaaaaaaaagatgagtttgtttagatttattaaaaaaataaaaacatgagtttgtttagagttttgttaaatttctcaattgattcataattctttattagcatcaatagaaaatgagcttcaacttcaaattagtaaacgaaaagtttctgagttgggaaacgtctcttaatcggcttccagtaattacgggcgacttgagggggttagatgaaatttgtgtaagaaaacttgagggggaacaaattagggccctccttgcgatttcgaggttagggtcggggtcgatccgtcgcgggggaccatctctcggcatcgatcgatcgccgccggtgtcggcggcgaggggcggcgcggggatggcgagcggcaacagcggcgagccgagcacggcgccgcagccgaatcggtggtacgagctccggctgggctcctcctgccgcgacccctcccccaccgccaagttctgcacgctccgctgtacgccccccaaatccccttcctccttccctccctgatactcgtgaggcgcatatgcgtagcgcacgcggccggagcacaggttcctcttcgctggtaattctcgcgcccttcggtggtgcgatgggggggggggggatttggcgatagtatgcttttagtgatgcgtccgtgtccaattggagttctggaattcatcgagctggtggcaaagcactccctgtttagcggcgttggggtcgtgaacacggcatgatgctcttatttggacatgcgtgactcatcatcggtgcatatttgacatttgtgacttttcatcagccacaattggtgggattaccacatgtcagttgtctttgttcttctgaatatgtttcctttggttgatcaggtagcatttgctttatctctaaagtagtaaaattttggtttgttggagacagcaaaataattgttaggaagggttgaactcgcatatatatttttggggtctgtagcattgattccatggttccttggtttggtgaatcgggtgctcttggtattgtgatgcatagtttctgtgctctcttgctctccttttatatggccaacgattcactatctcataagcttttccctcttgatggttatgtgacatgtttcaatttttttttcattgggccaaaacaagtcattggtaataaaggaatcaaaattgatgctcccaaaactgattaaatagttaattttctctccctctcgtggtttgaaaaaggttaccacgatcatgtagggcatgcctgtcctgggtactcttcatgaatgaattagcataacaatttgctgaaatccaatgagtcaccacttcgttggttgctgtctagctttcccttccattttaagtccattattggattatgaagtttgaaataaccatttttcttttgcctgaaaactatttctacaaatatctctaatgtgttgatccttattcttttatattataaatacatatcaggctatgtcgtgttgaacccttttcttatatttgtgttgacagatgaatttaagccagcatcaattgataagactcaagctgggtctctgcagaagaccaaagataacagggttactgtggaattccacaacaatcagcctggcaagccaaaggtgacatttgaaggaagccaagaagagtacaaggataatgatggtgtcttgttttttgatggtgaaacctttcgtctggagcggttgcatcgggctgtcaagagattaaggcatgtccgagttccaggagagtcttcggcagccacttcggctactactggaatgggcgaatcacattcccctccattaccgaaagttggaaagtcaccggccatgagtaaacctgctgtacactcagttcctgtaagttctttcagcattttagatgccctagataaattttgatacattgttatataatttgttacgaccttaggtattggaggaaaaaaagtgataacgttgaataaccggtatgagacaatatatgatgcacactatttagactgacaaacacaaaacatttgccaagagatttttgttatctgggagactggaaccactcatatataggcccttcagtaatatttatcggtagcatattaaacaattcgggctttttggaatgttgtagaccatattacctgattgtcttcatgtagaaagtataaaacattatatatgtgccacaataaaatttcatgtttgtctaaattcaagcctagccagttcataagctcttttgaatctaacatctctcagacccgtaagcatccacaggattatgttatatttgtgatatggtaaagtgattaatatttgaatttcatagtatgttttaggttattagtatttaatggtttatgaaaacattagtctttgagcatctgattgaaaagtgaatattgttaatttttattcttcataatttatatttcagaaggccaaacattggatagtgagtagaaatttcctttacacaacttttatgccagaatacagtatggttagctctgactaccgatgaaagttttttttttttgccaaaatatggtagcaagttctgttccttttctttgaatatggaaatttgatggcttgatacaatggaccatattcaattatcctaattaacttcgtatcacatgacaattggactgggccagggattgttttcctatcatgttaatgcttttctttttatcaaagaaaactttatacagtccttgctaagttcctcgtttcagttcctggatccattaaccccaagcttttgtgacatagtatcattatccctgatggggattttgtcagggcccttgcctgttcaatgcaagtgttcggatgggagcttttgtaacatagtatcattatcatgcaactgtgccattgctactgaatatactgctatattttgggtatcaaagtgatttcagcttttagtgagctcaaagtagagatacaatctctgaacatttgatttgcatgagagatgcatccttgtcccaatctaaaatgtactttacatactttctaagacttggatataggctcataagtttgttatatttctcatatcattcccagtttactccagattatatatattgagactagattcctgaagaaagcatcctaaagtgttataagttcataaatagatttataagctgacaatgttattgatatgctgaccctgggccctgggggatattggccaacctctgtgatatcacgttgtacaattttagtggaattcttgaagtttaagaaactcttctatttaatcatcgtctgacttctgacctttgatcatcattttataggttgaggttgaacgcattgacattggtgaacctgaaaatccaggtaatgtgaccctttttttattgcaatgttgttcttaatcatgaggatcttttagtttcttaacttgctctgatactagagatgatgaatacattcgcgtaattgttgttaaaacaaaggcaaggcatttgccatgtaggttatacaccaaattctatgttcgggtcttgatgttgatgttgtagtttgcagttcttggaatggtccttgtaccatgatatcatcttgtcaaatttcatggtgctggaggaaagatatggcacaatgcaaaaacagtttaacctttctaattgccgttttgacctgttctgcaaaaaaaatatattagttcaccaaatacatgccattctacaactcagaggcgcatgtagtgatttccccctctgtaccatactgccaccattactacaatttgtagtatatttccacgatgaaaaagtagcatacagatcgaagcatacttgaacattgttctcctcgattatagaagcatgattaatacctaaaatatctaaaaatagaggtagtgatgaaaaagatgtttgcgttttctaaaagggttgttaaagattgtcaatgttgccaaattacgtgaaatgttttcttggataggatttatcgtttgttctcattttctagtttgccagttgcaggtctaagaaacaataacaggagcactacataccaacctgttaccacaaatccattttcattttcgcctgatccaaatgatcaagaggagaacctagacatacttggtgatgatgacaatggctcaccgaataacatgtcctctggacaaggagcttctgttcgtggttttgacatcaacataccaaaccagcttgacatagatgatgaaattgctgatgtagatgtcagtgatgaggctgatgagggactcaatgcagccgaggccctgcgagctcaagtcaatgcagaagggcagcaggatgagcaggaaacctctagctctagcgggagcagcagcagcagtagtagcagtggaagtgggagtggtagtggaagcagcagcagtgatagtgacggcagtgatggtgattcagccagctctgggggtgacgttgatatataagtttggtgtacagagttttcttgctgtgtatgccatggttcacaattttacaccagtatcaggaggtgtaagccttgaatgtttaactcatagttcacaggtaacaaaattaagtttcttctgttgtgatcttattctgctgtaatttgtttgttctcctcttggttagtctgctatgtttcttagatctagcctggagcatagcatttgtatgaaacctttgcatgatggattttcttcccaaatatgggatatattttctcttgttttgaagtacagaacggcatatattctgatatgtagacatacatagtgtgcaccatgttgtgggttagttgtttgatggaagtatctgcccactttttgtatcgtacttgctttgctttgcaaattaactcatggagctgttattttttgacaagtaatttatcatgatttggtaacacctactccctccatttcacaatgtaagactttctagcattaaccacatacatatagatgttaataaatctaaacacataatgaatgtgggcaatgctagaaagtcttacattgtgaaacggaggaaatattattctcagtcatgtttgtgcgcatgttttaaacccgcaagttattatagtagtaaattgaaaacttgtgaacctgtggcatgaacctgtagtgatttccccctctgtaccatactaccattacaccattactacaatttgtatatttccacgatggaaaaagtagcttgcagatcgaagcatacttaaatcttcgatttagaagcatgattaatacctaaaatatctaaatatggaggtagtgatgaaaaagatatttaagttttctaaaagggttaaagattttcaatgttgccaaattacgtgaaatgttttctttggtaggatttatcctttgttctaaaaggatcatcacgtccgtccggacctggcagcgaggggttttggtctatttgccactcttccgaatgccgtattctcaaataccattcttccaaataacttttaattttaccatcgaagagagaagatttcttgctcatttgccattttccagcccatcagaagccacatcaccaaatccgaggacgaaagggtccgttttgcccctctcaatgtctttcattctcgctccttgccttgtgcttgggctccagtgaggattgccacgctgataaaccccctggcccgcgagctccagccgtctccttcaccccgctcctctgtatgcgcaagaggagaggatagctagcggtggctttgccccgtgaggacgaggtcggtgatgggtgaggcaggagtgatcaacaccagcgggtaagtggagccctcgacgatgggtcgttggtggctctagtggaagaggatatcgtggccacgacgatcgtacccctcgacagcgagccgatggtggaggtatggcactcgcggatgcttactgcaaggccatgaccctcggccgcaccctcgacgtggagctcacgtggcttcgtctgcttgtacaccttcattgacagggagcacgccggaggagagggagatgatgaaggtgagtgaaggcaaagaagaaagaaaggaggagggcaaggcggccattttgtcctcgaatttggtgacatggcttctcatgggctgaaaaatggctcacgaacaagaaatcttctttctccgatagcaaaaagtcaaagttattctagagaatggcatttgagaatacgcccttcaggacaatggcaaatagtctaaaaccccaaccgagaatgtgagaagaagaggaagagaagtcggtggcactgtggagttgggagggaaggttgccaggggagatgtcagtaagggaagggaaaaagtagttgacatgtgggcacttatgccacgctgtatatgtcgttgcatggaagggtgacaagccttgagtaattgacctggttgactactctaggtgtccatgtgcgggcatgcaagtgagcacgtgacaccatatttgagcggcaatggtgcttgagccatcaacgtgagaagcgccaatgatgctgatcggagcgatgagacagagacgggagcgggagtgggagcgggacggacctacgattggcgttggtgagcttaagacgagcacacgtactattaaagcgagaggtgcatctaaagcgagcatgcacggggtgagcatgattgacacgagcgtgtgagtctgattgctgtggcatgctggtattttttacgatcacagataaatctgcaggtgtacggataccgctgtagtatttcacctagggttattcaaagggtatcgtatttatatttttgcagggaagatgatggtgtaaagataaagtttatacatcattaatcaagctataattaattcaccatagtgtaaacaggggttagaataataaggataattggatagtgtgacacacaccaatctaaaatgtgactcccacctttcagatgaacaagtaagaattagtgtaatccgctaaggttattggactgtaaccgtagtattgatcgactagcctaatcaagtgaatcatataaatgaagtatatcctaatcataaaacacaaaactaccaaagcagtatatgaactatgaacacaagaatataaagaaggtaattctattaattcaactatagttttacaagaacagtaaagtactaaagtcatactggaatctccgagaaaaccatagaaccgaagattactctaagcctatttccactaatattgtagagaatacaatgcagatagagaaaatttctccttgagtatgtgctgtgaagtaaggaactctcctctatttatagcttctaatgacagttgcttagatcggttttggtttgggaattaggcataaccgctatcaagagtgcgggaggaggcaccacgtggaagacggtggcgaggggtacacccctggtttggccgaaccagggactccaccattcactaccgaccttgtcctgaggctgacatgtgggcccttcgattggtgcacggttgattggacacattttaagtcggtttggcctgacttgggcccatcaatccatgtgctcttacgtgattcgctagaaatgtgtttctttgcatgttggctcatttctcctttattttggtgtataatctttgcatacatgttatttctctaagacaagtgaaattatattttttattattgccatacgtaaaaaatattagttctccatttatttattatgatagttgccgtcgacattgatacttaactatcgttaacagagcgcgcatagatgggcttagggcgagcgtggacgtacggttgcgtgtgcgtgagctcgaggcgagcatgaccaacagctagggtggccacgtataggcacgagaagactagcgtgagctcagtaatgccggcgttagagtcatagagtgcgtaagagcaagtttaatagtatagccaactactagcttcaattcatctatagctaatctaataaatagcttatttatacaatagttatatactacactattaatatctggtcctacctgtcatacacacactgcgtcttggagtccgtgctacagctggctacagatctatagcccgctgctcttctctctcatcatttatcttcttaaaatatgtttgcaactggcttatagccttctattgtatctgctctaatcctcaccaggtgggttgtcgacatggggctcctcgcctttccatgtagcgacaaaacggtgttacctttccaccggttgacatcggtatttttttttgcatcttttgtaaaataaaattaggttgtttcggtaaaactgaagaactatcaacaggggatggatgacttcgcagtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcgcgatcttgtactcaattgagagcgaaattacaagtcagtaaaacgagtaacatcatatccccgccaactagctttctcgccctctctccctatctagccataactactgaaagcaacgtgatttgcctacttgctcgcgacgagaaatggtccaaacggggcctggctgcggctccatgaccatgagtccatgatcgtcgtcgtcaggcgcggtgcgcacgcggagagtccggagagcgctacgcgtcggacgtacgacgcgagacgaaaaatcggatgcctccgcaaccgtccgatccatgcacaggtacaccagccatccattatgcatgtatcaaatgaattttaaactattttttctctcaaaatatttatccaaatcatgatccgattgcaccattaaattcgttgcaattaaatctttaaaacaagaccacacatgaatataatccgatgaaattttttttagcttattattaaattatttttaaatgttgcacgctgttgcaccaagtattggaattgtttcactaagtagatcgaaaatgttttattggacgccgtttcgccttatatgaaaataatgtttcagcgaatagcgaaaggatgttttaactcactgcaacatttgattcatacatagtgaaacatcatgagtacattaggtgaaacatttttaaattaaaaaaaaatggatggtcaaatgttgcagttgaccaacaagtaaaacatcatgttatatatatggtgaaaaaaatcagcaactggaacatttaaatattttatgaaacatggtgaagatacacgttgaaacatgttgctgtcacacatgaaacaacaagtattaactgattgaaacacatgtttttcttttatcaaaatataatcaagcgatatcttgttgtaaagatttaattaaaacgaatacaatggtgtgatcggatcttagattgaataggtaatttaagagaaaaatcattttgaagcttgctaaaatacatgcatgtatgcatgcatgaggtggagagagagtagtagtaggtagtttcaggaattttgtgaaacacacttaagacacatattgaaacatatcactatcacatatgaaatattttgttttaacggtttgaaacatacgtttttcttttgacataatataatcatgtgatatcttgttgtaaagatttaattgcaacgaatacaacggtgcgatcggttcgtagatcagataagtaatttagaagagaaaatatttaaagagaggagaaaagaatgaaaagaaacaactagatatatgcatgcatgttacagtacgacagtaccaggctgctgatcaacagcattttcttgacgtcaacagagagaaataagaaattagcaagtaaggactgagctgaccgtaggcgtccaatgtttttcatctgatcggacgttcgaagagaagcattttcgggagagtcctgcccccaaccggattagaactagtagtctagtagggatgagaaagtaattaaaattcttgcttgttacttatctccgacttggttttgaccgaactattaatttgaaaattctaactgataaaaataataataataaaataaaaatagatacaggaagaattttactattctacgaaccgttaccaaaacttaccatattataccatacctgaatctattaacttattaataataaagtaatactcccttcatccaaaagtcttgagacctactccctcaaatccaaaatagaaggcttaaccacttctaacataaagacgaagaaaaaaatttgattatctcctcgcttgaatcacatctatccacgcaagaaatgtgattggggaacttgatggtagaagatttaaaatgaaccaaatttaaaggactaagaggtgatagttaacttatgcatccatgcacgccttatgatatatgaaaaaaaaaacagttgtgctttatattttgggatggagagagtatttcttctgtcaccaataccaagagtaattaacttacccaccacgtgaccaaaccaatgaactatatacgtgcatgcaactatgacttctaggtttcggaatttatcccacaaagattataaatatgtcttaggattttggaaaaaaaccaaaaaataaagtaggtttagacttttggagagagaatagaaaaagaaaccaccatgttcattcccacgatttagaaattaccacgttattagagaaaagtaaaataaacaaaacaaacaaacaaaaaagaatacgttaattggatgaaaataagaaggaaacaacaaatgaacaactattctttttgaaacgggacgtaccaataaaaaatatgcttatgaattgtcatcgtgtatgaaaccgataacaatctcaaacagccaaggattcttttcggaaatgtgatgtagcaataaatattcatgcatgcatggttagtgtaggaaacggacaacagttctcagcaacgaaaccgtgtgaggcacctaagcaatgtaaatatgtaacagaccaatcataattagattttcatgcatgaccttagcatccaagcatgtcagtatataattaaaagtaataggaaaagaagcatagtcttacaatctaagcattctcaattaatccaaagaaaataagaaaaataaaaattcacgattaagcgaagtgagcgtaactcagctggttaggttttttttttaaccagcccaccaggattcaaatcctagatttgacgctagcgctcgcatttacgactaattattctttcaatcgtaggcaacatacccatcaatattaaggcatccgcgacgacttcatcaatcacactatacgccagcttagtattccggatgtgtttataggggtagggtatgaatgtgtgcattcgtagaggtgagtgcgtcgaaaaccctatttgctgactagtcgcgtacacccccctccgccccccccccggcgcgcggtgcaaccatgcatatggcgcacatggagagggggcacggcgggagggcgcaggagagaggcatgtggaagttttttttttcgtttttacttttttttcctttccccccttatttttctaggttttcttctcttttttttatacggacgtttacaaagatgtatgtattttttacattaaaagtgtatacatataaaaaattatatacattaagaaataaatttgggaaaatgaaattaagattaaattaaaatttaaaaatatctaattttgatagaattaaaattaactaggcaattttgacgtgttagttaaaaattcttataattcacccgttgattgaagaaaagttaactttgttacccaatctacattgaaacaataccactaactgatgatattacatcctcgaatctattctaacgtgacgacgaatttcctagagtccaaactgtgaggaacatatgatataatataaactatcatgaatatatatgatacaatatgctatctttagttggtgaagaatgtcattagaaataataaaaggatgctactaaatactaattgtccctcaagataaagatggaggaaataagacaacaaatataccataaaattatatatcctataccgtttgctttatagattgcaattaccgtatttctatataccccatatctactaatatgtgtaagtgtaattactttatctcatatttcatacaaagaactactttttataatacggtagttatggtatctcatacaaaaccctaatttgacaatattttaaaggagagatagtttataatttttatatcgtaacttgaatggatttttcactataacgggattagtcatctctaacgggcttaaagcatcatctctttcgggcaggcccctgtcactaagcaaaggtcagtgatgtgacaaaatatctcaatcgggcatccggccgtcacggatgagacatctcaatcgggccaacacaaaagcctgtcacggatgactctcatctctaacgggcctagattatagcccatcacagatgaatataatccaaaaaaaaataaattttgtttttttgttagcctcgggcctttgccctcacttgtgtgccttcccagtcggtcacccatccgaacctcacttgtgtgccttcttggtaggtcacctatccgagaattgctctaggttaacctcatagttctttggaaattggctttcgagagagaaattgtaatttgttggtatgagtattctattaatcctattaagccctgggctaggatgtcacaccctagcatcctctattcatatacattcattcacataacacaaccacattcacataacatctattttgatcacatatttcaccagtaaatccgagttaattggatcaaatatatatttagcaagtattatcataagtaggaggcaaattagacttctaggaaaaaataaatttcgaattgaattttatgatactaaatgaactcatataaaaaagctataaaaaacaaagttgtataactcattgagatctaccatttttattttggtcatttctccatccgggtttgattgaactatataaaatttgtattttaaaatataagaaattcaaatattttttcaggtagtaaatgattttaaatagagaaatcatcaacaacaaagttgtataactcatcaagatctataacttttactttggtcttttttctatataacattttttgaacagtttaaatttgaatttaaaaatatgacaacttcaagcaatattttcaaatactaaatgatttcaactgaaaaagtcatcaacaacaaagttgtataactcatcaatatctataactattattttgttcatttatctatacaacatttttttttgaacagtttgaatttgaatttgaaaatatgacaacttcaaacaacattttcaaatactaaatgatttcaactgaaaaagtcatcaacaacaaagttgtataactcatcaagatctataacttttattttggtcatttcttcatccgacaaagtgatagtaacattgtttataaaattcacatatctctcatctagttttgtaaacaataaaacatatatgtaaattttgtgaacaatgttactagcactttatcggatgaagaaatgataaatataaaagttatagatcttggtgagttatacaactttgttgttgatgactttttttagttgaaatcatttagtatatgaaaatattgtttaaagttgtcatattttcaaattcaaattcaaactgttcaagaaaacgttatatagaaaaatgacaaaaattaaacttatagatcttgatgagttatgcaactttattgttgatgacttttttagttgaaatcatttagtatatgaaaatattgtttgaagttgtcatattttcaaattcaaattcaaactgttcaaaaaaaacgttatatagaaaaatggccaaaataaaagttataagttatagatcttgatgagttatacaactttattgttgatgacttttttagtttaaatcatttagtatttgaaaatattgttttgaagtgttatattttcaaattcaaattcaaactgctcaaaaaaaatgttatatagaaaaataaccaaaataaaaataaaagttgtaaatattggtatgttatacaactttgttgttgataatttttttcatttgaaataatttagtatttaaaaaattgtttgaagttgtcatattttcaaattcaaactcaaactattaaaaaaagttatataaaaaaataacctaagtaaaagttatctctaacgggcatcaacaaaaacccaacaccgatatgagtcatcggtgacgggctttaaagtccctcatctctgacgggctcggtatctaggcccgattgaggtatgcgaggtcatctcaatcgggcctaaatatttgcccgtcacatatgagtgttatcggtgacgggctatatgtatttgggcctagagtaagtatatctataacggtgcaaatttaagtccgattgagatgactttgttctgacggtccatatagtacacgcataattgaacccgtcacagatgatagaatctgtactagtgtttatgttcatattctgacgttagttaccttgtagtttcattttcagttttctaatatatatatagtatagtacttttggttctacgtctactgttttagtggtgttttcgagttatgcaatgggtgaagatatttttgaccgttttcattgtcagaaaactatgtatttatcatttatccatattctctaataaaccaaaacgatttattagaaaataaaaattaaaatttttattggtaaaattttatatatgtgttcgcttcgatattaaaaatcaacgctaacaaaaatatgtcaaaaatatctgaaaataaacatcaaaattaagtttgggaatttaaattttagttttactttgattttggctaattattatagggtaaccaattggactctagtacgcgcgacgcgtcgcaaatcggtgcttccgaagtttctgggcccgaatttagtagtcgtggtcggcggtcgcggacgcgcggtttgggcgaccgaccgaccgacggacgtgtcgcgtcgcgctggtaatggacccgcccggtggtttcgggactctgtacaggttaagtacgtgtgtcgctgctggtcgctgccgaccattacaggactgcgtgcttagtatggccagattaacttgccgagcctcactacacgtacgcacgatataattaggatttagggtcaacactctccaacagtctattactcctactaatttgctggacgcatttcatcagtgattagattataattgtacactgcacatcttacagggagagtagtgatcacgatctctcctcatctttcagtactgctgtgacacctgtttttatcttccgtatcatatgatattttaatgggtactttcctatttagcatgcaatatattttagagtaaatttcacaaaattacataattatagaactatagattaaactcggtgtatcaaaaaatatatttaaagtcaaaattatcatataactatacattaatgatgaaatgtaacaaaacattttagtaacaactataggtttagaaccaatttaattataaaactacattttatagctctaacataacaatggtgttaggatttaaactctaaaatatgtagttctgcgattagtttaatattaaatatatagtattgtgatacattgtcttagatttgtagttttgtgataaatttgatgttaaacatgtagtttatgataaacattttaaatctatagttctatgatagtttagtcaaaatatttgaagttttgggaaatttacactatcttttaagtattcgaagatctccagtcatgctagaaaaaatacattatatgtttttttggaaaagctacaactctaagaaaatttctcttgttccgttcattgtgaatgactatcacttaatataatttacttcatttttcttgcctttctttcttcgaattttctgggtttcaaccttttttcatcgttgaaatttctgaatgttctctcggggtttctttgtttcttgcatctcttcccaccgtccccccaaaccgaatgagtttttttgccaatttagtaccgtcatgtggccctgatatttaccggtcctccttcgctgccctaggtgcaaaagatgcatgcatggttagtgttgggatacgcataggctacgatagtataaattaaaattttctatcgcgtaaaccaggaatcatgcaagtattagatcatagatcgttaccactcgacgcgctacgcaacggaagaaggcgctaagaagtcgaaggaattctcgcgaagtagcgcgcgtcgatgtagaggaagtagtcgatcgcaccggctcgaccttctcctcatgcgttctcctcgctgtattcccacaccgatcagcactacaaaccagcggtgcctctactggtatccacacgtacagggacggaacgccacgcgcaaatatgctagcacccgcgcgcggctagggttttgctcggggaggggagtgacggctagggtttctcacgtgatgcaatacctccgccggtcacaccccttacaaatatataggatccattactcgggcctccaaggcccgtaggactcctattcggatctctatccgaattaagctcatattggatctccatccaatccccttattctagcctattaagcgtgcgatactgtaggttcatgtacactccgctgtaacccgaaaagtccttttcggtccacgcatcaacagcggcctctagcagaacatattgactcaccgggcatacataaagatcatatcggctgaatctctagtgtatacttgtatgaacccctttgcctcacaatatcgattaagctcaaggctagatatgtgccatactctaatagctcaatcattcactcgaacctgttgatagattatataacttgtgatatactcctcaatcacctttggcatgccatgcacttccataatttacaacatcgaggggtccagagatatctctccataggaggggcaaatcccatcttgattattcatatctcactacatatttcatagcatacccgaaaacaacttttataactacccaattacagagtagcgtttagcagtccctaagtaagctactacacatgttgggaaccatgataatatcaggtctaaggattcaacaccaacactaaatgagattactgatgacacaacacatatggctcttgcagtgtctcatgttgggtctattcatcaacatgttcaccaacatgtgtccacattattaatttggtatctctattccatgatccatgagacatgatcatcaattagtacatgtgctgatcatctaaacatatttgttccacatatgatatttgatcagggatcctttagaaatagcaacacacaacataaagagtctcatgaaagaatcacatattcattaaccaataatgagttatctatttcaagtaacaaagtcggataaatatgtaaacatagtatgtgatacaatcatctctatgattgcctctagggtatatcactaacagttagatggatggtgtacgaacaagtgcgtaacaactcaaccaattaggttgcagtgagacgtgccagctttaaaattatagatagattagcctgttatttgtgcacttctagctagtcattctaattcaacatttgtcaagattgcggttgtaagcaaaggatctctcccagatagaaacatgtagtggtcaaaagtacacatgcacaacaagacgacatattcaatcaacaaattatagaacaaagaatcagagagtgacagcaaatcaacaaaatcgatcagatcaggtctaaggaaaagaaaaacgaatgctgatatggcgctttgagatatcagtcatgtttagttgaagtcatggccctcgatccccctaacttagggcctgtttagatcgaatgtttgatatttgatatgtatagaatattaagtatgaaaaaaaactaattacagattacgtgtaaattatgagacgaatcttttaagcctaattgctctatgatttgataatgtggtgctacagtaaatatttattagtgatggattaattaggcttaataaattcgtctcgcagtttacaggcggaatctataatttattttgttattagtctacgtttaatactttaaatgtgtatcgatatatatctgatgtgacacagtgaaacttttcacccttgaattagcagacaagaagaaaacgtgttacatgtaaaatagcagcaataaaatgagtgacccacgcgcagactagatgtggtagagcaaattgcagtgtatcgaccattcaatagctcacaaccacacgccaataacctgttggataagtcataatacaacacgcaattaatgaattaatgatgagagttacttggagaataaatattgatttagatagcttttatcagtgtgaacaagttattacatactcccttcgtttctaaatatttgacaccgttaactttttagcacatgtttgagcgttcgtcttattaaaaaaactgtgaaatatgtaaaactatatgtatacatgaaagtatatttaataataaatcaaatgataggaaaagaattaataattactttttttaataagatgaatagttaaacatgtttaaaaaagtcaacggcgtcaaatatttagaaacggagggatagtaacctgcttatttaattactgaatttatataattaattatttgttttaaaaaatccatacaatgttacagatgatatgatactactcttccatccctaaatatcttttagctatgcatctcgatgagtgtgtgtctaatgtttagctt

SEQ ID NO: 59503 - DNA, 23974 bp, Oryza sativa
  unsure (1)..(23974): unsure at all n locations
tttagtaaattaaaatattggacatccaggccaattatgttcattcataatttgtaatcaatattgaaaatgttaaccaaagattcgagtttaccatattttaaaataaaagaatggtatgtgtggcattatatgtatttgaggtattttaaagagtaaattgcattggtggtacacgaacttattaggtgggtgcaatttagtacatgaatttgtaaaatgcacgttttggcacacggacttatctaatccgtgcgaactaggtccaaaatggtttagcaaggttaattttacctagctgatgttaattaggatgtggcatgcatacgtatagtgagtatgcataaaacatgctatatttataaatttattctctactttatcttgaattttgtatgtttctaacccatgcatcattgctcatttgcccggtattttatatctttctctacaatcactatatctcattatatctttttattgaacaggtgcatgtctaagtagcaaccttctcatatatatgtttacgtagtatcctaatcagcacctaaagcaacaaaattagtcatgtaatgtccttttgaccttagttcgcacacgcaagataagttcatgtaccaaaacgagcattnnacaagntcatgnannananngcacccacctaacaagttcgtgtaccgctgatgcaatttactctattttaaaagttgaaattacatattttaatatgttggttaaaattatctttgtaatgcttattctgattaaggaaacatttttatactgtaatgatatgctaggtacatgaaattcattaataagttgaaatttatcagcctatggcatctcatattctgtaaacctgtaccttgccatgttattggaatttccaaatatgtcatgttgtaataatcttctaattgttatagaagtttgatttgcatctttgcattccaccaagctcaagtatttatcattttatgagttgctacaacttctaatatttagtgcatttcaatgtggcaggaaacgctggaatcactgagaaatcatgcgacgtaccagagaagaatgtttgatcaagctgtcaagctagttcaccctggtggggtgattgtttattccacgtgagtgttcaacattttatgttattactgtgtatgagaacaaaaattatgttactaagaaagatgttaaacacacacacgtgtgtggtaatcagatatccattctatttgtacttgaaattgcgataaactacagagctctagacaaacttagtgttggatccagaagagtagtgttcaacggctatagacgtatcagtcgaggatattacttactgagcatagctttaaaattagataccttctgtattccctaaacccaatagtaggtctcccctttcctctgtttatagattgtacataaataacataatccagatttcgtgtacagtacagttagctagctgatgtaccagtactaaagaaaacataataatgttgggcatgacattctagtcatacatgcacattttgttggtattcaggtagtgaaacagtcaaatttgtcccatctatatgtattgatcggtatttggtggaagctttttatgtggtcattccaaaaaacacataacttacacggttattctatctggaatctacaattctacataccatttatcctagttgtttctgctttgtaggtgtactataaatccaggagaaaatgaagctttggtcagatatgcattggataagtacaagtttttgtcgctcggatcacaggtaagttccatgatgtaatttgctaaattgctatggtgaggatttttaattagtaatttattagatggagaacttgaaatgtaccagccaaattgtatgttttacaaattataattttgttcagtttcgttacagatatgatgactaatggattgatttgaaactgatagatctcactttagacaaagttgaaccaaattaaagtctgcacatatttaatcttgctcatgcacttctgtgacaaacatgcctttctttttcctaacttaggatagtaaatacttgccctatctctgcagttacaatcaattatatttgttacttttgtatgctctataatttcattgtcattgttaatcttttcagcacccaaaagttggaggacctggtattgttggttcatttgagcgatcaaccaagaaatatactgagtaagattcttgctatatatttcttggaacatgggacctgaacctatccaatttctgtgattatgttatcgcacacctatctgaaaacactgaaatacggtattatgccataatttaggaaaacttgtatgtaacggaatacggtagatttggattgcatcacaaagtaatgtagttttgtaggaccgatatctgctatagaggtgggtgaatatagcatcaaaaagttcttccccaaaataatcgttcaaaaacctctctgaaatatcacccttagaccatagttacgtgacaagctagatctaggaggaggtgaagaaaagttgcaaagaaccctactcagatgagggctttaccctctcaaaaacttctctgaaatatttccctcaagactatatatgacaagatagatttaggaggagcttaaaaaagctgcaaagaatcaaagggcctttttggggagctttaagattctgagaagtagctggttgatagccagcttctgagaatctaattcattttctggattctacaactacagcttctcagaatctagaccaaaagttggactgtttggggggagcttctgattctgggagaagctctagtagctagaagctccccaaacaggcccaaagtatctcgcttaaacccacaaaatccccaaatccttcgcctccctcattgctattccgtacttcaccacccactgctccctcgtcactacctcgtacttcaccgcctcagtcgctaacctaagccatcgggggagaaaggcgagggattttgtgggtttcagggtggtattgtagtgcgaaggggcaaatttgtaattcttccaccactcttctctgcggaggggctagctgtaaatgtgttgcctacgtggaatgccacgtcggtggttagctttggtcaaacgagatttggatcggctatggttcattaaaccaagattgtggacctggatgtgcaattttcaagtttacggacctaagtgacacccgctctcaagtttaaggactggccatatattttactcatttgaatttatttatgcagtttaaattcccgtcatttaaattccgcagaggtttctgcttctcttccttcctgtttcttcgtgaaccctatgcttgcacaccaaaccttgtgaagcccgttgcaaagatcgccctacacggtgtacgtccatcgtgtgccaccttgtgtccaatcttgtcacccggcgtactgatcgttctggaccccaactcctctctgtgtttagtcccgatccccgccactgaccaagattgacctctaaggatcttaacttcagttacaccttgtcacatggcatcccgatcgtgctagacctctgctcctcccttagcataattctggtcctcaccattgaacaaggttgacctaaatcacctgcacacacatagactaaacaactgattttgggcacaggggaacctgacccacgttagtcgcacgcaagtccataatcgccaacattccaaactaaatttccaaccaaaaccaactcgtggtgttcccaaattccttgccaattttccaccacaagtaaaccaaaacaacacttggtttcacaagttcctgatgagaataccattttgcatgcctaggcattagcaatctttgttagcttgatgtgttgtccttgtacaagagaactgtttttgccaaatgagctggtgggtcaatcaaactgatggatgggccattttaataatcctatcgttatgtgctatatggataataatctccttgctatttgctactgaaactatgtttttactttttccccccaacagtatgttgaactgatagaatgcttatgcagggagtggttgacaaagcatgaatcacaacttgtccagagattcgatccatcatcaactctggatacaattggtttcttcattgcaaagtttgatgttgggcagaaagacgactgacgtaaggggttctcttgagcattctattttggatcctacactctgaaacttgctgttcctgacttcaaatatctcagcattaacacttgctgcagttagatcatttcagggccccaatcatttttcagtatgaatgggaaccaatatcccatatctggtttcccagaaattttgtgctcaactgtcaatattaaattattctttgtccaagggattattgtttgttgtaatgaaatgccaagggtgactggttgaaagtagaaacatttgtaaacccaaaatgatagggacttgagattttagatgttgggtggtggggatatggagctggaagagtggagttgtgctttgtatggcttagcatatttaactaaatcaatttcttttctatcacatggcagtatagcatactttctccgaggaaggtggtttctgacctgcatttttaagaatattcttcatagtgtttgtgattttacatgtgtgcttccattggcttcttctcccagcaaaagtcattcgtgtgctttgcctctaaagtttaattctcattcctccgctaatttcttgtagcgtctcacgtttagcttcagtagactctcactgcatataaactgtcttacgtcttttccacgagagagtacaactaaaaaaaaatgtgcataacctgtatacaccacactcatgaccatcaaacttgcatgtgccctaaacattagtaccaaatatatcaaacggcacagacgtgcggtgcgcggatatacgcattcctacggaacagacgtatgcgacgagcagcctcgtgataggatatgctctgtgctcgagcttgctctcgatcatcaacaagtatgccatcaccaaggccgtgctgagttcccttcaaacttttaaaaatttcgtcacatcgattgtttggagacatgcatagagcattaaatgtagaagaaaaaaccaattgcacagtttacatgtaaattgcgagacgaatcttttgagcctaattacgctgtaatgtggtgctacagtaaacatttgctaatgacgaattaattaggcttaatagattcgtctcgtagtttggcggtatctataatttattttcttattagtctatccgtatacgtcacaattttttttggctaaacaactaaacacagcctaagttcagctacctggccacctcactgccatgcagaccacaaagaagtttgcgccagctgctcatattcatataaatgtcatacatatgttagaatatatatatatatatatatatatatatatatatatatatatatatatatatatatatatatatatatatatatatatatatatataacatctatataaatatggacaatgctaaaaagacttacaatgctaacggatgaagtaccttattaatagccgttattgttagaaaataaacagatcaatatttccttttttgtaaaatggttcatgttttaatgaactatcccgtatgggtgttcattcacaatggtaatatataattttatttatatagcaaaaatgtcagagggttctaatatctagaagagggttttcggaaaataactggtattaatatatttcgtaatcatggttctttaaataaataatatttgaaaccaaaatagacacatattaccaaatgctcatcatttagcccatgcataacaagaaaacgaaaaataaaatcaaataaattccaacatgcacgggagttagaaaagatttttgattattccgaatttttaattatgtatttcagaattgaaaatttcagggtgttacacttatcaatggcatttcttagattatctccaagttaatacatattgctttacttttcattgtgtgagccacgtatttctacgtaggcagttgtcgatcgacaacaattttcttaagacatgcttgaaaggaggcatcagttcgctgtagaggatagaaattctcgtattattcagtgaaaaatgaaaaggagagttcaagtatgaaaacaatttataaataacttaaattcgaaattaaacaaagggatattggaataacggtccatatataacgtaatacgagattaattaaaattcgaaattagaaaagaaaaaattttaagtaggaatgcaattttaaaaaaactgaaataccgagattaaaacataataaattcctaaattagaaaaggaaaaaaagtttaagtaggaatgcaatttcaaaataactgaaattcggaataaaaataagaaatattaaaaagatagtcaatctagaacaaaacacatgattaattaaaattcaaaatagaaagtaaaataaattcagaagttagaaaaataaaaataagaattgaagtaggaatacaatttaaaataactaaaatttggaataaaaacaaggaatattgaaaaaggtccatatagaacacaataagatattaaatattatttaaatttgaaataaaaaataaattaaattccgatattagaaaaaagtcaggataaaaaataagaaaatattgagacagtagactacctagactacaatgatggcaaataccaataaagagggggaggaccctggcatgctgtaagaagtaccgttgtggtaatggtagataggacacctaaaaaattataaaacaaaccccaatcatgactagattccattctaaaattctaatgactattaaaagaatgggccacgggtacagctgcgaaggagtaagattgcagtagttgaatggatttatagaagggaaagaagaactcaataatgatcaggtttgatttttttaagatcacaataacaatcatacagagtggtgcaacgggtggccgtaatggagtgaagtggtgttaacgataaaatttggcaatttccgttagtcaagaccgggtcaaaggaagatttcacatcgtgactttagaagattcggttagtaaagttatccaagttttggcatccttcggagttaacaaaggtgtatcttagtttctatttttttaatagactcctgagccgatggaatcctgttaaaattagactcggatgtgtttggcaatgtttagctgatatgagttgtgtgaaaagtcggagtctgtaataaattccttaattagagatagagcctagattaaaccgatcataatagaatcggacttggtatagtctatgggtataaatatgtacacccagggtctttataatttaacaatagttcgatatacaaatttcggtgcatcgccaacgtttagtctcgacgtgatcttgttttttgagttgggctacatcggttgagtttgatctccggcaagaagtaagtactgtcaaatcttcgcctggtatcgacgggatcagtactttcacggttaagtccgatatattagtttaacttttgcatggggttgcttatcaaatatctcgactctggcttggatcggttttacgttctttgttagggtttctatatcaaccacgctaaatagcatcaatcggctagtttaaaacctatccagtttatctttagatcacgaattgtcttgcttaacttcaatcttctaagatttagtttgttggataagtttactcaagtcaacaggtgctagctatcatctcattggtgtttcagccgataagttatctatttaattatcatatataaacttgttgtatcggttcattcacaaaatttgatataattggctagttgttgtttttactagattcaatctcggttaggcctgataaagattgagtttagtaaatgtaattctttatgatcatattttagtttgttataatcggtcttagtttatttgctaattacagggcaatgaaaagttttaattaatacttcaatacatcaacctatatttagagattatatatacttgttaaatccagttattattaccttcaatcttataatgtcttggttgggtctaatctatccagattgactgtaataaaattaaggtttagcaaatactccctccgtttcacaatataagattttctagcattgtccatattcatatagatgctaatgaatctagacattattttatatatagatttattagcgtacatatgaatgtaagcaatactagaaagtcttacattgtgaaatggatgaaatatatatatagagtccatattccaggtgatgttgatctagtacgtaatattcgtttccattgattatcgtcgatcgacctgaaattatcatcgacatcggctggacacatggtattatatcagctccaaagtcgtttggcccaaggactaacatttcttttattatcttgttagttgcaggattaaactaactggcacgctctgaacccgatttgataggacctacactagagtaaagcaaacctcttagacctttgtgtgtacgatgaatttcatgtaaacaagtggtaacattttacaagacttctaaaagttataaatacggaattcgattagacaataaactccaaaaattacatgtttgatttttagaggtcccaaagaatatgaaaagaagtcataacaggaaaaaagaacagaaataggggacgacaagtaaagggtgatggttggcgtaacctttaaaaactataaaattgaatcctgctaatggtaatgtttgattttttaaaattctaaaataataggatgactatataaaaaagcttaaataaaaccatacgtaaaaaataaataattttgtatgtgctagctgcacaattacaccgcgccacctgctagttactttgaaaatttcgttttcaccaggggtagtagcatgaagcatacgatatttggggcaagtgtgttcttacccctgttttgttttacaattgtgattttaccttttttttagggtttgtgattttgaaataaagcaccagtttacccttcctttggatgactgtttggtgaggtttggttgagtgaactaaaaacaatgatcaatataataagaaaacatgtacacctgccttgccgtgtattaaccgtcgctgtatctaacggctgacaagatccgatcgactagtccatatctagctgcgtggcatgtaacctgtccgtgcgtgcgtgcgtgccgtgtcggtcggtcatggatcgatttgccatgccatgccaggtctctgttgacctcgtccatcgccattcgccaatcggtgtagctatgctgctagctgatcgatcagttatggcgatccagcaaccacgagctctcaattatgaaggcagccgtaatcacacgcagcgagagagagaaggcgcaacgagagtaatggaggtgtttttagtttggagggcacttgtatggctggcgctgatcactccagcagcggcgctggcgcagcaggaggaggcgccgggatgccggcggcggtgcggcaacgtgaccgtcccctaccccttcggcatcggctccgagcgctgctaccgcggcggcgtgcgggggtttcgcctcgactgcgacgacgcccgacgcccgccgcgcctcacagttgccggctacggccacgaggtgacctccatctccctcgccgccgccgaggtcaccgtgctgctcaacgccagccgcgcgtgctacggcggcggcgactacgggcgcggccgccgggggcgggaggagcagcccatgtccctcaacggcagcgcgttcctcttctcgtccatgaagagcaagttcgtcgccatcggctgccccggcctcgcctacttcgtcgacgacggcggggactacgtcaccggctgcatgtccgtgtgccggccgtcggcgcgggcgctgccgggctcgtgccggggcgacgacggctgctgccagagcaacatcccgctcgggctcgcctcctaccggccgcgcctccgcagcttcggccgccgccagggcggcgccttccttgccaacgccaccgcctgcgcctacgctttcatggtggacgcatggtggttctggtacgccggctcaaacttcaaccggacgggcgacttcgccgtgcccgtcgtgctggactgggccatccggccggacgccgggagcgggagcgggagcgggagctgcgccgccgcaagccgcacgccgctgccgtcgtacgcctgccggagcgcgcacagcgtctgcatcgactccagcaacggccctgggtatatctgcaactgcaccgccgggtaccacggcaacccgtacgtcgtcggcgactgcacaggtctaaatctaatttttggttactcctccgttttagaatataaatcgttttttattaagtttgtagacaaattttaatatttacaacatcaaattaattttattaaatcaataattaaatatatttttataatatatttgtcttggctaaaaatattgttatcttttttactaacttgatcaaactttaaataacagtttgacttttactaaaatcaaaacgacttataatctgaaatggagagaggtacttctctccctctcatcatcatcccacttcagttcatcctgatggtgatgtttttctggcctttaattaattacttctcatgttatttgtggatttaaattgaaacaaattattaagacatcaacgagtgcgagcacaaagatgagtacccctgctacggcgtctgcaccaatacggcaggcagctacgcttgctcttgccccaagggatccagtggaaatgccagcgtggagggtggctgccgccgcgacgacaagttcactctagcactcaagacggtcacaggtacctacgaaagattttttttatatattttatatattttttatatacctttccaaaaagtatttttaaatatgaattttgactacgccagcctgtggccaaataactttgtcacgtcacgcacagctggcgcggcagtgctgtcctgccacactagcctcttgccacgctaccatggctggcgtggcaaaacaacgcttcaacgccaaaaggtttagtttttgaaatattttttaagaacggtatattaataaaattaaaaaataaaaagtctaaaaaaataaaaaaattctcctacaaaacgggattcttcaccttaacaacaaataatcttgactttatatcactatgtcactgaaccgaaaatcacctgacactgacgttacagcagaggatccatatctgttgtaccaatatatgatacctctgtcccaaaatattaggacaagatgatattacttgttcggattcgtaatattaggaaatatcaccttctacactagtcgtaataatttgagtttggagaaagcagtgacagataagccagcagcttagtaaaaagctaatccctccgtcttaaaatttttcagatgtattttgtttgattaggacaagactttaaccaataattgcttcattagtatattatttatgtggcacaaacttatgatcataagaaattacttttcactataaatttggtaaattttactacaatacatctaaatcaatctatctatatatctatctattatatactaaaactccatgaaacttcctacaacgctcctaagccgccatgtgtactcctacaaatactcctaaaccaccacatgacatcttaacaaattggtgggcctaatatttttatctattaaaattttattaaaaaaataaccccacaaacttccctcccctcttctctccccatgggcccatccttcaaccggacgaacaactcaagttcgtacgtacttaggtacggtctccctcccctcctatccaatctcttcttcttttttttctttagttataaaaatttttaaacaataataaatcttaaataaccatattttttctatagttatttgcatgttgtctatcaacaattaaaaaatataaggtgttctttaacctatatgaaatatttaatttttttatcacatcctaaactttgcatatcacgtaaaactgtcatataaaataggtaaaaattgataatgtagattacacgatcatatatcaattgacagaatatacataaacaaattaagttagatctattatataacaaacgtttctaagccaccacgtggcatcctgcaaacgctatgtactacgatgccacgtgtcactataataaattagagaaatttttaaaatttttaagaaaaagaaaacatctagacattaatttttattaaattaggtagacccattatttaccactattatatttatctttaaaagaactccttaacctccaaaccggatccaaattggacctgtacgtagcgtacgttttcttaaggatagtacgtacgtacgttagtaacgtacttccaccccttcttccctcaatttcttcatatttttgcacatatttcttcccctattatcatatactttattagttagaaaatatattttgtgttaaacaattcaacaactataacatctaaatcatacaactaacttttaattcgcttatatcttaaaattattttatgactaaatctacaggcaaataccaaatttccacaataattcaactttgagaaagaaaatgacactttggattatatttccagacttttgcgtaccgttgaagcaattacaaaaaaaatgaaataataatattgtagactctatcattgtgcataacttcataagaattaaattatatctacaatcataaaatctaaaataaaaatagctatgagtaatgttcccaaaatatataagttagaaagcaagagttacacgaaaaaaataagcagctataacatctcaatcatgggatcccctaaatcatacgagtaatatttttcttatgtattttgattattttacatttaaaaacccatatttgaggttatattatctgacttttatatgcaattcaaacaattataaaattgtgaatagtaacgatatatattttatcattgtatatgtcagggttacgggtcaggcataccctctacccttcgatatacgttacatatcgacatggcatacccacgcgcacgcggatgttttctacatatcctaaggaaacctttcacgaaatctacagatgggaagaatccttctcgacagaactgggtcgtcgacgtatcgtattgggtctgatatctctgagtcctacttggaaacctccagatctatgatataaaagggaccccccggggagggcatggatcatcgaatctcagagccaacacaacccacacagcctacaaagccgaagtctgcgaggagcgaagtcgtcgagagctagttgaatccactcgactacgatctcgccggatccgacaagttccatcgttccctttgtaacctgtgttttccaccatataatcccatatcaactggattagggctattacctaccaaggggcctaaaccagtataattcttgtctttgattgttcgatgtcgtactacgtagatccttgtaccaacgtaccccaataccatctatatccggtctacgggtatcacccgtcgacagtggcgcgccaggtaggggtatttggtactcaaggttctactactatgtcatccagcttcgtcgacaacaacgtcaacaccagcctcagccaagcgctccctgcttcaacaatgctggtatgaactcaagtcggcgaaatcgtcttcccggtttacaccacaacgccaatctcaaccggtcctccaatgaccggaaacgagaacgcagtggctacaaaccaaggcgactccatgtcaaaaaatccacccgtcgaaacggagaacggatcatcgacgacatccaagcacgggaaggattctgatacggccaaaccttgtccttccaacataaaccacgagccggcaaagatgacttccgaagccacaaggtcttggtgtcctatccacaaaaccaagaaacacaccttgcaagattgttgggttttcctcaacgtccgtgttgaaattcgcgcctgcaaagaacgtggaattcagcgtacttctccaactcgggatgtctattgtcctattcacaagacaaataatcacgacctctcgagctacaaagtcttcctcggcgccatgaaagctccgtctcctaagtcatacgtccccgtcagggataacggcaaggaacaaggagcgactccagcctcagatcgattcgttggggtaatcgatatcgatcctcacgaaccatcggtcttacatcttctcgaagactatgggtcatcaacaacgagcgtgccacgggaggtattggctatcgatgacgttggcacgtcagcgcaagccaacgcagaagcggcgaatcaatcgactactccagcccaacacatcagggtcgttcaagctatactgagggaaactccttacgatcccgttctgaacgatgacctcgagcgttggacagaacgactacgggaatcggtgaccaacctcagcaacgcgtttgaagaagccgctaccgcagcgcaccaagatcagccgccaactggcgacgccaatggtgaagatccggaacggagggaatcacctcaacgagccactcctccacctcgcggagctggcgatctctgagatcaaatcaatggccgccgagaagcacgacgcacacgagacaatgtaaatcgctctcggcgtcatgtctcttcacgactccatgataacggaaatcgaggagaccgctcaaacgaggaccgggatcacgacaaccaccacgatcgcaacgatcgcgaacgacgggggccagacaatactggtcatggccgccgccgtaacggcgacgataatggagatcggcaccgagacaacagcgagagacaacgacaggattcccgagatccaggccgttatcctcgtaatcgtacgccagaaccaagcgacccatcgtcatcatcatcatctgcgtcctcctcatcgtcagacagacatccacgaaggacacacgaccgccgacaacccaccgtccccaacgctcggtcgttccctacatgatgtccgatggcctaagagattctgacccggagcaattgaaaagtatgatgggagcaccgacccagaagaattccttcaagtctactccacagtactctgctaccggagcagacaacaacgcactagcaaactatttaccaaccgcgttgaagggttctgcacgttcatggctgatgaatcttcctccctactcaatctcttcatgggtagacctgtggcaacaattcgtcgccaatttccaaggaatgtacaagcgccacgcgatcgaagacgacctacacgcgttgacacagaactcaggtgaatcattgaggaaatatgttcgacgcttcaacgaacgcagaaacacaattcctgaaatcaccgatgcttctgtaatccgtgccttcaaatccggtgtcagagattgctacactacccatgaattggcgacaagatgcatcacaaccactcagaggttattcgagatcgttgagcgatgcgcccatgtggacgatgcgctaagatgcaagaacgacaagccgaagaccgggggagagaagaaatcagccacagacgcatctgagtcaagcaagaagaaaaatcacaaaaatgggaaaaggaaagctcaagtggaagtcctcacagcagaatacgcgaaccctcccaagcgcccagacccacaaggcagcgacacaaagaaatcttggtgccccatacacaagacggacagacattctctgaaagattgccttgttttcaaaaagtcgctcgagaagcacatggcgtttgaaaaaggcaagcgagtacgcgttgtcgagaagaacgaagagacggctcctcacgaatcggattctgcatatccggactccgacctccacgtctcacacattttcggcggctccacaacgtactcctccaagcgagaatacaagaaagtggaacgtgaagtctgttcgacatggcggggggggggggggggggggctgcacccaagatgaagtggtctgagcagaaaatagagttctcggaagaagaccaccccaagagcgccgttatcccaggacgatatccgatcgtggtcgaacccactattcggaacattaaggtagcgcgagttctcatcgacggtggcagctcgatcaatcttcttttcgccagtactctaggcgcaatgggaattccgcatagtgagttgacaccaactgatcaacccttccatggaattactccccgatcatcatccagacctttgggcaagattacgttgcctgtgactttcggccaagccaacagcttccgaacagaatggatcaccttcgatatagcttacaacgccatcatcgggagaactgcacttgcgaagttcatggccgcatcccactacacgtatcaagtactcaagatgccgggaccgaagggaacaatcactattcaggggaatgcaaagctggcggtgtagtgcgacaagcggagcctcgacatagtcgagcaaacgcccagcccacccgccacgactgagccacccaagaaagtgagcaagacaaataagacgccgaagccggacggcgccatcaagatctttccactctccagtgccaatcccgacaagactgtcaagatcggggcgacactaaacgagaaataggaactcgcgctcatcaccttcctccgcgataatgccgacgtgttcgcttggcagccgtccgacatgccgggggtccccagggaggtgattgagcacaaactaatggtgcgacccgatgccaagccagtaaagcaaagactgcggagatttgcaccagaccggaaacaagccatacgagaagagctcaacaaacttctcaaagctggcttcatcagagaagtacttcatctagagtggctagccaatccagtcatggtgcggaaggccaacggaaaatggagaatgtgtgttgacttcaccgacctcaacaaggcgtgtcacaaggatcacttttctctccctcgaatagatcaattggtggattcaacagccggttgcgagctattgagcttcctcgacgcttattctagctaccatcaaatcagcatggcaaaagaggacgaagagaagacagcattcatcacgccgttcggggtattttgctatgttaagatgccgttcggactcataaccgccgggaatactttccagcgcacggttcagggcacacttagcaaccagcttggcaacaatgtcgaggcttacgttgacgacatcgttgtcaaaaccaagacaagcgactcattgattaacgatctgcgggaaacattcgacaacctccgacgatatcgcctcatgctcaatcctgagaagtgcacgttcagagtaccgtcgggcaagctactcggattccttgtctctggcagagcaatagaggcaaatcccgagaagatcaaagcaatcgagaacatgaagtcgcccacgagactcaaggaggtacaaaagctaaccggatgcatggcagcactaagcagattcgtcgctaggatgggagaacgagcacaacctttcttcgctctattaaagaaacaagacaaatttatatggacacaggaagccgaagaggtatttattgcactcaagcgctacctatcaaaccccgctgtacttgttgctccccaacctaatgaagaattattcctctatattgccgccacgccatattccgttagcactgtcattgttgtcaagagagagaaagtacagcgacaagtttattacgtaagcgaagctctccatgatgcaaagacaagatacccacagatccaaaaactgctttacgcagtcatcatgacatcaaggaagctgcgccactacttccaagctcacagagtcacagttgtatcctccttcccccttggagaagttgtgagaaacaaagacgttgttggccgcattgcgaaatgggtagtcgagctaagccaatttgatgtccactttctaccgcgaacagccatcaaatcccaggtactcaccgacttcgttgccgattggactatgccagacaacaaatcagacaaccaaggcgacaacgaaacatggacaatggcgttcgatggcgcactcaacagccaaggagcaggggcaggatttatcttgacgtctccttccggagatcaattcaagcacgcaatccacctcaactttagggcgaccaataacactgcagaatacgaaggactactcgccggatacgagctgcagccgcacttggggccaagcgactaatcgtcaaaggggactccgagctagtcgcgaaccaggtgcacaaagactacaaatgctctaacgccgagttatccaagtaactcgcagaagtcaggaagctagagaagaggttcgatgggatcgaggtccgacacgtctatcgcaaggacaacgtcaagccagatgaccaagcacgacgcgtgtccagacgagaaccgctcgaacctggcacctttctcgatatcctgacgaagccatcggtgaaagaagttagcccgaacacccccgacattagctcggaggtcactgaggcagaacgcgccgttgctgacatcgaaactacagacgactggcgcaccccattaatcaaattcatcagcagcgaggagttgcccgaggacgatacagaggccgagaaaataacccgtaaagcaaagatctactgtatggtcggtaatgatttatacaaaaaagcgctaaacggggtacttctcaaatgcgtctctaccgacgacggcagacacctcctcctcgacatacatgaaggcatatgtgggtcacacgccgccggtcggacattggtcagcaaagcttttcgacaagactttttctggccaaccgcccttaaagatgcatgcgacatggtccagcgatgtgaaacctgtcaattccacagtaaacacacaaagctacccgcgcaagcgctccagactatccctctgacttggccgttctcgtgctgggggctagatatacttgggccattcccacgaggacagggcggctacagattcctattcgtggcgatcgacaaattcaccaaatggatagaagcagtgcccacgggggaaatcaaggccgacaacgccatcaaattcatcagagggaaattctgcagatacggactaccgcaccgcatcgtaactgacaacggctcccaattcatcagcgccaacttccaagattactgcatcgggttgggagtcaaaatatgtttcgcctcggtctctcaccctcaaagcaacggacaagtcgaaagggcaaacggcatagtactacaagggatgaaaacccgcgtctacgacaggctcatgtcataagacaaaaagtgggttgaagaactcccatcagtactatgggccgtacgcaccacaccgacaacgtccaataaggaaacacccttcttcctcgtgtacggctccgaggccatgctccccggcgagctacgacatcaaagtacacgagtacagaagtattccgacgagaaccaggaggaacagcgagacatcgatgtaaatcttctcgaggagcatcgtgagcgagttgccgtctgagcatccagctatcaacagtccctccgccgttatcacgagaagcgcatccgagcacgcatactttcgatcagcgactatgtcctccaacgagttcaaacccaagcagggcgaaacaaactctcaccaaaatgggaaggaccttacacgatcacacaagtcttgcggccaggcgcattcaaaatcgcagacggcgacggtcgcgaattagcaaattcttggaacattgaccaactacataaattctatgtatgagtcaataccactgtacctataagtacccttacagcatcaataaagcctatttctaggtcccatatcacaatcaaagtgttttcacccgatgatcccttactctgatgacacctagcgttgaaacttgtccttatgtccctttacgctgtctcgacaaggcctccgaggaacctaagggatcttcggctggggacgcccagagccgataaggccttgtcagatcctgtatagacaaaagaccatgtaagatctggtcgtgtaagagttctcgccgtgcgtattaaccaagccgtgaaatcggaaatcaactttccaacctcacggctgggggctaggatcagagcttattcaaccaaggcaggtcaagggtccaagagccttatcccccgagaaaattcctccgatgacaaggctgggggttagtgagagtgtacgactcaaacggctgaccaaagtcgttaactgagaatacactcttacacacgacatctagagtaagatatatttgtttaaggaatatttctttattcacaaaataattcttacagtttttacataaattttccactacattacatctttccctaagatatctgtgacaggacacgagtactaccaagaaggccaacgccagtccatagactggaagatcttctcggccagcggcgacatcgacctcgccagatggtctatctccgccggagttctccgagaacgagcaaaaccatggcggagaaactcgaggtcctggcgcgggcggtgatctcgtaggcaagccagcatgtgccctccggcatatcggctcgctcgacgacactcttgcttcaaggcctcgtcgatatgcttgccgatgccatcgagttgggcacaggccccgtttagccaagagatgtacccggccgccgactcctcgggatcaccgcggactactcgaagttccctgcatactctagccatggaggcacagcaacttctcaagtaagagttgaaccacacctcgcgacctcggagcatctccacaacctgctcttttttcacggccagcatggttctctcaagttccgccacttcaaatttcgtcttccagtattggatacgacgatcttgatttgcaagggcaccctcgagatctgctaaacgtgacgaccactaagacaagctagatacctcctttacaacataaataacctaatcaggaggttactgagaggtgaaaaagctattcacttgaggtggccgttgccatcccggcctccgcatcaagagtttgatccacattgtcagacgaaacatgtggttcaaaatcgagtaccggaatcattgccagtgactcaggctgcccgcgctgctggacatcttcgtcatcaacatctctacaatggacaaaaactcccgagatcaacatacaaaattggacaagggtggtaatcgcacgaacgaaggcggccggagttcaagatttacacaatatataacaaatacaagaagtcctactctttaaaaagggagagaatagactcccccagatcaccgacttcttccatcacctccttacgcgtgtcgcttgccgccccctgatccaagatctcgcgcagatcgagctcaggacgcgacaaccttacacacgcgaggacgtgacacgccccagtgtagatgccattcgacgtctccttcgcgatcctggccgcatgcttggaggggatttccccaatcgctgtcgccagttccgcaagagaggaagtcagcgaaaactcgtcgggattcgccgggatcgtggacttgacgccgcactcctcggcgagctgatggaggccagtgtaggtgacccgcaacgagccacggatcttggagatattgttcccgagttccgacattcggtcctcgagcgccttccgttgacgatcgttgccggccaccaactccctcatcttcgtgaggtcctcacgggcttcagctagctcgcgcactaatctctcagcacgcgcgttcgccgtcgccgcttccgacctcgcctccgagatctcgcggccgatgccgcgagcaccagcttcgagaaggcgccccatctcgacttggagctcctcccaggtgagaatggccgctgcagaccacaacccgcagcgagatcgctgacggggctgctaggcgtcgcctctcggctcccggtcacgggcatgacatctgtcgaggccgtggcaggcgatgcgctggaagctcccccggacttggcccgtgcagccttcgcccgcgcctccctacggacaaccatgaatcaaacaccatttgaacgaaaagcacgagaatccaagaatctatttacttacttctcgccaatcgtcacaatgcgctgtcgtcgtggaggtggagaggacgcgtctgaagcctgaaagacaatcaatacagagtaagaagaaaccctccttgctgcacgatctgatgacaagatgaaattactgagggggtcgctgccttgcggcgatgtccgagtatagacgagaatttcctcgccttggtcaagactttgccaccgctagtggtggccgcatcagatgcctccttgacaaccttctcctttagagatgtcgccacctgatggtccgcgagtggcccgatgatgtcagtcaaaggaagggcctacgcttaatcaggtcataaggtgatttcgaaaggagaatacgagatgcttatcaattacacttacgttgatggcttcatcgcgttccgccgcccccttttcacaaaggggcacggggatgtcgctagccgtggtcggaccgctgatcatcacctgaccaacgcgccgctccacagctttgctgctcagacctgttaaacgggaaccaacttttgataagtcaagaggaacgcgagtacaagcacgccaagatgaatacgagaaagataccccgaggagaaacccgggtcgcgtcatccggcccgagatagttataggctggatgggtccgagcctggagcggctggatccgcctaccgatgaagtctgcagcgacttcatatcccgacaagccccgttctcggagatcatcgatgatgtcgataaacgactgaagagagggggtcaaagggggcttggcggtccaggtcggaatcttgtccggttgattctcgggaacaacgaagacagggttcgagtccttgatctcaagatagaaccacctattccgccacttactgcgggaaggacactggaaggggatataacgcgacttcatgccatcacgaagtcggaacccgacgcaaccagacaccctattggattccatccaacgcagttcatagtagaaacggaagagatcgagaaaaagctctaccccaatgtaggcctcacagagatgaacaaagatactaagaaaggcgatggaattagaattcaaatggagaagagaaagaccatagaaattcaacaccaggagaagaaactcggaaggtggagaaagaaaatcgcagagaacgtaatctttgatcgcaaccatgcgacccaagaggggccgaggatcagtacctcctgcttctctctccatgtctccacggccgggaagggcgccgtcctcctgaaggttcttcaacgtcgcgccggtggaagacgacttgccgagatccattgctgtgccaagatcgccggaaaacaagcctgagttggcgaactagggtttcttgtggtggcggagaaggcaaggagcgctggcaggtggtgtgtgttcaacaaggttggcagacttgaaaatgagctcccaaaattcctttaaataagcgcactaccgacggtgcgaattccaaggaacggagagagatccccgccggaaatctctgggcccgttacgcgcagcagttttctggacttcaattcaaaattcactcatgaccgttgggcttcaaacggcatgctcgactacgttctatctccacggtcctcgcaccaggaatgacaacgttctcgacacccgaagtcgtaaatggttgcacgagttcattttaagcagaagttgggg

SEQ ID NO: 59504 - DNA, 646 bp, Oryza sativa
aatcggagggtttccaggaggggcgggttatgcagacctgctcgtcgacgaggttgaggtcggagagcttgccggcggcgcgggcgcgcttcttgccagaggagggctccttctccttggccaggaagtagctcctggagaagccggcctcctcgtcgtcatcctcggacccagagcttaccccagcagccgccgccggtggccgcctctcagtgccatcggggttcgcttccgccgccgccgccgccgcaaggatggaggacgagaaaggggaaggacgcactcgtgcacagcctgccggtatataactgtaaatggttcaatacaagtagaaaataacaaataagtagaaaataacaaatagtaaacgatacggtatataactgtaaatggttcaatacaagtagaaaataacaaataagattgaatcttacctaaatgacaatgtaaattgttcaaaaggtcttagataaatccacgggtgggattggtacatcacaagatgcaactcctttttgcttcatgcttttgaataagtaacgcaatgcttgacttctccatgcctcaatctccaaccatcataccatgcaaaaatgtcatataaggttcattgttgcacacaattttgtggtaatttatacaaatc

SEQ ID NO: 59505 - DNA, 1137 bp, Oryza sativa
catagtaaaccaatttcccaggaaaagatgtttattgtgtatgttaaattcctttctatagctggaaatattacaggtagaaaaaaaccctttgatgtcctcttctactgttctattctacgaaatctgaagaagcatagaagaatttatgtgcatagaagcatggaagctttgaagtttggtactacgtatggattctaatttagttaaaagaattcagcctgaagtagcatatatgatgcaaaccaaaagaataagaggtatatttttattttctgcaaatctatatatactggagaagatctaccatactaccacaggcaacatctgtccaaactccagatgagtaaatcgtgttcaaatcataccaggaaattactgcatgctaatagcagtgcactattgactcctacacaacgaattgttatccttaatttgcagcataagtggttagttttgtagatccgtacctgtgcatgaagccaaccagctacctatagctcactgctcgtattgtgggctgtggccgtaggtgagcgtcctccgcgtcggctgctagtgcaatcgatattcttgtagctcatatgtttgattgagttgattctctccttgctctctgcatctccgctcaagccaagcactgaaggagtaagaggggtactaaatctgtcaatctgagataggggatctgtttttccctgtactagaagaatccagactgcttattgatagagtgggctatggggctgtgacttttcatgggcttttagcgttctgtgtccccgaagtgtcgtacgtagggatcttttcatacgcacttcgtaatagtttcttcgtgtgtatagcagtgttgttttccaatcgattgagccactgatcatccgcaaagacgaagctatctccttcgtcgattcatccttcccgaacacctcatactcatggccataaaccggatgccccatcgggtgcggacctagttgtgttcatcgtttatgggcatgaatgctcttaaatgttgactgggcttctaagtgcaagaggcatttttgacatcaacaaaacgatgtaagtgtacaattttccttttttttatttctccagcaatacactggtgaatacgagtttgttcactttggg

SEQ ID NO: 59506 - DNA, 21477 bp, Oryza sativa
  unsure (1)..(21477): unsure at all n locations
tgagcaaagcatatctaattacaactgcggcaatgtgagagctgttccggttaggagtacagggattctccttgtgttgtgatgccgagcttgactagacgtgatcacaaatggacgaaacctactatagtactagtagtaggagcactacttctactctagctactcctcgagcccagttattccatccatcggattccttccacagataggcagaaactagcaagcctataagttttttctttctttttttttctgaaataattacagaaggccctaataaaaaaaactaattataaaatccgttgttaaaacagcgagacgaatttattaagcctaattaattcatcattagcaaatatttactgaagcaccatatcgttaaatcatagagtaactaacctatatttaatattttatgtgagtgtttaaacgtttgatgtgacatattgtaaaattttagcgtgagaactaaacagaactaaacagggcctataatacttcctaagtactgtactaccagcttaatactccgagaaagacgtttatcaatgtttgaagtactattactgtactagctgcggcaaggggtggtgttcagcttataatacttcttactttacttcggctgtttctagttaagcgtaaaatttagattttgtttgaaattgaaaatgatgtgacttaaaagttatgtgtgtatgataggttgatgtaatggcaaaggactaaagtttggatctaaactttagatctaaacacagccttcctctgtctgctagtagtgtagtattgactttgtcccaaaatatatttttaagttttgactgatatacagttatccagatttataatcagaaatgtttatatttatatttttgacggttgaagcagttgtgaactgatcgttacaaagtctcatttattctaaaataagctaatttttgagtaattattatatctaaatttacgaaagtagtagaatatatagatatactgggagtagataaaataaataataatggtactggaatttaataaggtagaggtactcttttcaatttttttattggtgcaagagaaaaataaacttactttaaaaaataaacggcttcagtactgagatttaataaagtagagctatcatactatttttaatttcatattggtgcgagagaaaaataaacttactttaaaaataaacgaagtcagtactgtatatattttttttactacctccgttttaaaattatgttcatctttcaaccatctcacatataccaatacaaaagagcctcgtcgattacttatattccctaataaatcaaaacaattcattagagaataaaaattaatttatagataaaaattttatatatttgttcgtaacgatttaaaagccaattgaaaaaggaaattacgttgaaaacatctttgcatcaactttaaaatcaagttcgaaaattcaaattttagttttttcttggcttattaggctatctcatggggctctagaatatccatgctttatcaaatctcaatgtaactactttttatttttatcttttctcaatacaataattccttacttttatatactttgatgtaatgtttactccaaaaataaatttattaacttttgtatatattttttttataaaaacatacccgtttagggtgtgtttagttcctaaaaaaagttgaaagtgtgaagaaagttgggagtttggataaaaaagttggaggtttatgtgtgtagaaaaattttgatataatatgatgtgatggaaagttggaaataggagagaaactaaacacggcctttagtagtttgaaaaacatgcaagtgtaaaaggagcgaagtgttcattcaaaacttttctacttacataaactcctaattttttttctaaactaccaactttctccaaacttctccccaaattcagaaactaaacacagcctaaagttggataaaaaaacctatagtcgctcttaaaatgggacaaaagagtacttcctccgtcccaaaaaaagacaaaccttggtttccgtgtccaacgtttgactgtccgtcttatttgaaaaaattatgaaaaaaaataaaaagacaagtcacgcataaaatattatgttttatcatctaacaataataaaaatatgaattataaaaaaattttatataagacggataatcaaagttggatacggaaacccagggtttatttttatttttattttttttgacggagggagtatggctagtgctactacccctattaattatgcaatgtggagttagctactagctctagtgtagggagacaagatttgcatcgctagtctagattttagatagatcgagtattatatatggtgatgcatgggtgtttgaccataaaaaactaattacagaatccgtcggtaaacagcaagataaatttattaggtctaattaatctgttattagcaaatatttactatagcactacattgttaaatcataaagtaattaggattaaaagattcgtgtcccaaattagttaatctgtgcaattatttttttttctatattaaatcttcatagttccgttgtcgtgtcacccggcgcaacacgccaccatgacctgtcctgtccaattgaaaggccttttccatagctgcttctgctgtagcagcagagcgaaagcagccagaggcccagagcttcagcttcagcctactactagtactctactactcccaactccatggccttcgttcgcctgcacgacggcacaaccaaaatgcgcagaaactcccaatactcctgctactgaacacaggaggggacattgcaagaaaattatactagccccagcatatactagcctgcacacaggagaggcagcagctgaagaaggaagcaaaacagtcaagcttttgcattgcaagcagccgattctgaattctgaaagctgtgattccttgcttgcaaggcagggagtcgcacacgggcaggcaggcagagagaggcagtggagagcgtgggtggctgcatcctgcaggcaggaggaggggaagcgttttgctccaaaaggaaagctgaaaaggcctttggcctcgcgctgtgcgtggccgtgttgatgttgagtagcgcccggccggcgggcgttcccctccaagctgcgcgccagtggacagtggtggccatggccattgcactactgtgcagcgatatggctgggcgctttaaagtaagtgcactgcactgcactgcgccgatgggctctttctttctgacctcctcggttgttctttacacgagcaagttgatagtatagccaaatactactaactccaaatcatttatagccaacgtaatagctaattcatacaatagttgtttactaaataattaatatctgatcctacttttcatacacatattacgtcttcaagttcgtgctgtagctaactacagatctatagcctgctgctcctctctctctttctttatctctttaaaatatatttatagctggcttatagcatgctattatacctgctctacagggcattttggttttcgatggcatgtaattttagtgcccttaatgaaaggattaaaatgttttatgtaatttaaggctgagttcttcaggtaactttcccaaattaattttctcatttttcgagtgcatattttttaaaatattaaatggtgcgatttctaaacaaaattatataaaagttgctttaaaatataactagcatagtggctagcgcatattacgcagctagcataatatattttctgtagtataatagcatatatgttttctcattatattattcaaatatattaaaatgacaacataattttaaattttgcaataactttacgaaactactaatgtgtaatattcatattgtattttatatacgtgttagttattaattatttttaatatcagattttagttatttgttatttatatatattcctatatggactatagactcgtcttttaatatttcttttttaaatttcgaattttctgtaaattgtatttctcttcttccaatattatttatttttatttatgaatttttattatttctaattatatttctatgtggactctaaactcatctttcaatattctttaatttttaattttgaatttcagttacttctaaattgtattcctatattgactttaaactcatcttcccatgtttttcttaattacgaattttagttatttgtaaattgtatttttatatggactctaaactctacttttaattttattatatttattccgaattttagttagttttaaattcctatatggactccatactctatttctaatattccttattttgtaattccgaatttctttttttcttaattgtagtctcctcttctaatattccttatttttaattccaaatttcaactatttcctaattgtatttctatatggactctagtctcctcttctaatattccttattttttagttccgaatttcaggtatttctaaattgtatttctatatggactctgttttttctttttctccgattaatgtgagaatttctatgctatgagagcgaacgtggaggctcctttttctattcctttaataatataatagatattaatttatttttaagttttttaagttaatagtacttaattcatcatatattaataaatcattacatatgctaattttactagaactctgtcaaaataagtgtacttattaagtacttttttaaagaacttggaaaatagattaaaatattaatgaaaaattacctttttgaccttatgatatactccctctgttttattttaagcgcactgtaactatgagttttttttttgtccaaatttgattgtccgttttatttgaaatttttttatgattagtattgtgttgttattagatgataaataagacgaaccattcagttagacatgaaaactaatgacgtcaattaaaatgagacaaatggagtactctatccgttaaaaaaaggcaacacctctcctagtacactgtcgctgtggaggtccttatatacgcacgtcccgtctcgtttggtccgatccggtgcggtgcgggtgcggtcacgtcgttggccagagggcctgtcccttctctcgggtcatctcagcgacgtcgccacctgcagtagcctccatggtaacctgtgcgtcgtcacgctacgcagatgctaccctcgctgccgtaaaaaatccgtcgatcgatcgccgagatgataccgatgatcgatgggaaaatgtgcctgataccgctggctcgctcgctgcgcggcgaaacagggatcccagcatgtgactcgccaagtcgagtcgccagggtgtagtcggtcaggccaattgcagagatcgatcgatcggttggtcagatacgttgtgccggactgccggtgtgtgtgactgcgcgtggttgtggtagatcggaagaattcaattcaacggtgcatagacacaaaagttccaacgagagaagacgagaacacaaaaggaattaaacataaactaaactttaatccatccaagttatatcggatgaatttgaagtattaaacgtagactacttattataaaactaattatataaatgagagctaattcacgtgacaaatcttttaagcataattaattcataatttgcgtatgtttactgtagcatcacatagcctaatcatggattaattaggctcaatagattcgtctcgcgaattagtgcagggttatagaatgggtttttattaataatctacgtttaatatttataattagtgttcaaacatccgatatgatagggactaaaaagttttattctcatctaagcaggaaagattttgggactgaaatttctccgtcgattggcagttgtgttctttttttaagtgtttccttcatctagaatgtagcaatttaagatgggatgagatacatccttagacaatatatctagatataccttatgtccaaatatattgtcctaagatcctagatgaaggtagtagttcctaactcactttctcgtctctcctgtgtacgtttcccaaattcttaaaaaatatttatatacgaaaattactttaaaaaaatcatattaatgtacttttttaaaaagaaaaaaagtttcttatattttgtaacaaggctagtagtactccgtggtatatgaccaattgttggtgtcctgcgccagagtgacgccccagagtaaattggaccggaatattgttgaggcccgaacagcaggcctagatttagttgggcccgacctggatagcgaggaatgaaccagcccagaactagtcggctaggtcgggatgcgatgggatcccgatgtacgtgttggacttggacccagcccaatactcccaatattcaagtttgaggcaggccactaatccgtcgcagcattcgagcccattttcgtttcgaatcaacgtatctgctttggttcacaggaaagatttaaatatccacgcatttcaaacgtgttaaaactaaaaggccatatgattttttttctcagtcctgcgaacacgcctacgaggttactagtgagtctatggtggcaacttattactcattttctgttagctaaacaaatacgctttcttattttttaaaaaactaaatagacccatttttatttgttataattgatatttaattaatcatatggtaattacttgcatcgtttctgtgccacgaaaaatccaactcactagggtgtgttattttcttccactctttagttttcactttttgattttctgcacacgcttcccaaatcgttaaattgtgtgttttttttaagaagaatatgaaagttcatttgaaagtatcatattaatatattatttgatctttttaatatttaattaatcatgcgttagtacctatttaggtttcgtgtgcctaggaaaatggtatccaaacccctcaaaataacacagcaaagtctgtgacccgcgtggtagatccagccatccaggaattttaacaatcgtgcacaaacattttataacaatagtaacaatctgtacgactgtaccttatttgcgcttgtaggtgtcaacggtcggtttggaaaaaaaaaaaacttccaacggccggaatccttcttccatctcctcatccaaatcccaacggtcatctctccgcccttccccccacttgtcccctagctccgccgcgataaagtcttgtagccgttggagatcaaaatcaccaagcaatcccatcccccgcggcgccccttcccccccaattctccgcctcgaattcaccctctctctctctctccccccgaatccacagatcgagatggctgcggcgacggcgaggtctccgtcccccggccccggcgcgaggccgggctgcgccgttaggaggagcgccgactccagccccgccgcctccccctgcggtaacgtctcgttttgatttgtttccggtttcgttttcgaacaagctttccgtttctgcggcgagcggatctgatctgatggtttcgtggtgattttgatcgagtcgtgtttttttttgtttttggttggatgcggcagatttggcggcgctgaggagctccgtggtgtgcaggaacgcgtcgccgcgggcgtcgtggtgcgcggagaaggagaacagcgggcagcgcgacgcggcggcgagggcggcggcggcgcccaagcccgctcgccccgcggccggcgccgcgaagaacttcatggcgccgaccatctccgcggcgtccaaggcctcgccaaggaagaaggtgctcggggagcgcaacgagcagcagcagctctaccccgtggcctcgtcccccgtcaagcccatggcgtccgaggcgggcgccccgcgacgcctccggctctcgttcgatggggcgcccaatactgccccacccgccgcatccacgccggtcaccgcggcggccggctccaggcactcgttcggcggggaggaggagcggagggtggagaatcccccgtgcaagaaccaccaccacgccacggccttcgacgacgctgcttccgcggaggcggaccagggtgcggctccgtacgatcccaggacgaactacctgtcgccgaggcctcggtttctgcactacaagcccaacccccgcatcgatctgtaccggcaaggcagcagcggtggcgtgaggcggctcgaggacgggttcgcctccgagagcagcgaggaaaccgtcaccaccaccaccaccaccagcagcgaggaggaggtggttcttgtagacgaagaacaacaagcgcatctgtcgtctgagctcggagatggcgccgctgttcccgcggctgatgcttgtgccctgccgctggagcctgcgtcgggttcaccgcgggctcgcgtgctgacgccagagccagcgacgcgttccccgcgcgctcgtgtccagacaccggagccggagcctacggcgagctccgagcgagctcgtcgtcccaggaagaggtcttccctgaggttcctggttgctccccttgcgctggtcgtgttcatggctgctgctctcatctgcgtgccgccgccgccggtggattctccggtcatgccgctaaccgccctgtcgaaggtgtcggactttctgtcagttcaagaattgcatcctgtggagttggctgcttggctgaagcaatggtcaagcagttcgttgaatctggtcacatcctactgggaatcccttgtttgggcgcaagagcaagagttctttggtccgcacttcgcagccaatttgagtgctgcaactgcaagtgcgcacgagggtgttgatctctactgcaactttgttgaaacaaggccagttctaatggaagatatcggtgccagtgcctttgagcaggattccaagatccaggaggctgtttcagcaagtgattctgagttgatttcagagatcagtgatgtggagcaagaagatatcactgataagggagatgtgatcgatgatgggttcttagcagaggagcttaatgttgagatgccggaagaagacgctgagatgtcacaagaagtttcaggtagcaatggtgaagagatggcatccttcagtcaggatctggagccctcccaacctgcaggagaagctgagccactagagaacattgaaactagcacttcttccttgaagcaggatgttcagactgatgattctgagggtgatcgtgctgccgacggagaggagagcccagaggcggatcatggaatgaagtcagaattggggatgtggccaagctacctggacaaaatctcaaagcctgctgctgctggcgcagctctggctgccgtcattgttccagctgcactggccttcctcctcatgagcaagaagcaagatcaggctgtcgcaaatgctgccgctgaggcaccagctgatcaagctgaaccggttgtcgagaagaccctatctggttcggggagcagcgagggtcatcttcgtgtgaagggttcacagcttcagactcctcctgtggcagatgaaaccgagagattcggcggcggctccggcgcttcgatgtatagcagcagcttgtcttctggctatggcaggaggaagagtgccaaggaggacgagagcctgagccttgatccagtgtccaggagggattctgccgcgcaacccacatcgtcctatggtagtttcaccacctacgagaagatccctgccaagaaggtatacaattaagcggttgctgtttatatcctgaattcatcctttgaaagtttgtttgtgctaggttgcatgcttaattaatttaactttgtttgtgcagagaaacaaggatgatgaggcggtgaccaccccagtccggcgttccagcaggttgaggaatcaggttaaatcaccggaggcgtaaagatgggcagccccagtgctaactacgatctgtaggggacctaactatcagcttgattttagcacttgctgctttagcttaactgctcctcagctttcattgacattgctttagcacttgaattcgactgatgtatgatgataaataacagctctctgctgttcttttcatcgaaaaatggattacgatttctgttttttccccccttctttttagttgtgtctgttgagatgactgctttcgtgcagctttgttatgtttgctacctgaatatgaatgtattaatccaggacatcgctttgttaccattctgtcagtttctttgtgaccgtgacatcatctattgtcttccgtattaatgtttcagaaacatgctgtttttcgtttggagtatttcgatggatttacgattatggtactagtagttctgtagtagccacgacaaaacactttgaaacttccaactttccatcacatccaaaacttttctacacacataaactttcaactttccccaaacttctaactttttttaggaactaaacatagcccaggttagattcatattgaaatcagaaccaagcctgccaaattcacttagcattaaaatttcagatttactatgcaaacacttggaagctgtgctgtaacaatcgttcgtgtttctgcaaaaccgtgtgcaaattcacataaaactgctcgaattcatattccattgtgatgggtgtgaatttcaacgctgctaatatttgacttttgacaagttgccatcctgtggcgggaaaaacaagcttaaaaagaaaaaacaaactcaaacaacatttgcctaccggacccacatgtcagcttccaagtagcccaatccgttggctccctgacaggtcggacccacttgtcatctgccccaattcggttcaactacccgcaggagtcggtctccccgccctcctcgcatcgcatcctccgccgccgccgccgccatcaccctcctctccgccgcattagcagtagaatcctaagccataatggcaacctccgccgccgccgccgcgagcaccttgccttacctcgtcgccgccgcctcctcctccgcggcggcgcgccgccgcggggcccaccggatccgggcgtcgtcggcggcggcggaggtggagggggcgatggacgtggtgtcggaggcggagctgcgggagaaggggttcatggggctccggaagacgaagctggtgtgcacggtggggcccgcgtgcgtgggggctttgccggcgctggcgcgcggcgggatgggcgtggcgcgggtcaacctgtgccacgggggccgcggctggcaccgcgccgtgatgcgcgaggtgcggaggctcaacgaggaggaaggcttctgcgtctccctcatggtcgacaccgaggggtcccagctcctcgtcgccgaccacggcggcgccgcctccgtcaaggccgaggtgtgctttctccattttcttgtcgatttggttcccggcattgacgtccggggattatttcatataattgcgcaacaatgccccacaccttcaaatgtgcatcctagaaacatccaatttggtattttggttgtccaaatttgaaataaaaacaattggtgttttcttgggagtaattttgtcaaatttgattgaatttgatctagccggtgaccagatttgaatcataacattcgggtaggatgtccattcatttgggattgttttgctaaatgacaattgttgtacagagacattgttatgactttcatttagcagatggccctttggcatttgatttatttgtatgcatattttatacatcctttatattgcaaaagactaagataaattcagtcttagttagatagtatattccttaataaaaggatagctgctagtgtatttctcgaaagaaggacagtggctagccctttcagcctttgtaatgctaaagcagataagtcttcacttatgttcctccattatgccgaagaagctgaagtaactagattttttgctaacagcattcttaataggacatattcatggttaaaaagttttacggacttggtactactagaagtactagattattatttcgtgcttatagcttaggtttcattagagtatggcactgcaagtaaaaaaagatgaactttggtcatctcgatctttgtaatttacgccttcaaccattcatcaagttattgtgtgaggtagcaaaatttatcgaattagtcctgatctattaccatacactgtttgagttttggttagtatctactcttcattgatactatcatttatctgtaattgtctcagcatctcaatatcattgtgaacatatttttgttactctctttcacacaaatcattccattgtttccttgtttccattaaatattgcaggatggctctgaatggctatttacaagtaaaagaaccgatgaatctcatccattcacaatgcatgttaactttgataagttttctgaaggtctgaagatttgcatggcttttgctggttttccataacaggaatttaaatgttcttttcacaaattacataccatttacagacattctagttggtgatgagcttgtaattgatggaggaatggcaacatttgaagttattgagaaggtcggaaatgatttgcgctgtaagtgcacagacccaggtttgcttcttcctcgagccaaactgtcattctggaggaatggaaaattagttgaaaggaactttgggcttcctacattgtcagcaaaggttaacttaaaatgcagtactttattattgctatttgttcgctttcaatgtagtgtcgctttgttttttcctgaaaaaaacagcatgttttcacttattcatgaagtatttctattaattgaattattgcatttatactgtttccttaaagttgcccattttttttgttttttcccctgaagactgcaacaatttttttggcttattcatgaagtatttctgttaattgaattaatacatttgtactgtttccatgtgacagttcttaagaagtgatagaatttctggatatttccatttcataaattgttctctcatagcatgcttgctgcgtgcatatattatcttgtaggattgggctgacattgaatttgggatagctgaaggagttgattgcatcgctctttcatttgtaaaagatgctaatgacatcaagtatctcaagacttacctctccagaaaatcattagagtgagcagacaactgacatataaagtccttttatagtttgctaaactgaattttctttgcattattgtaaaatggtgtacaattatttgtttcacaggattgttgcgtaatatatatgtgtcaatttattattattatagatgtctatgtgctaaaggagagtcctagaaaattctggagctgctgcagttaagcttataaatcaatgcatcacattgtcttatctagaaatgcaaacctggtagaagtgcagaacgaaagaaaatcgatgctattatttcacagcagagcatattaagtcaattgtttggaagtattcagctgcaatacagaaccacagaactaacttgtgttactgatgtatttatgccaaagttaccaccctattcagtttaggatttgcagttatgttactgttggatagatctttatgcaactgctagctagttgctgtactaatacaatcttgctgtataccagacacatcaaaatattcgcgaaggttgagagtcttgaatcactcaagaaccttaaagacatcatagaggcatctgatggagttatggtagcacgtggtgatcttggagttcagattcctttagaacaaatcccagccatccaagaggcaattgttgatctttgtcgacggttgaacaagccagtgatagttgcctctcagcttcttgaatcaatggttgagtatccaacaccaactcgtgcagaggtaatctatttttttaaggaaataaagttgatataaccacgatgtacggataatacatttcaaaaagaaattttaattccatctacctaacctttttgtgcttctccttgatgacctggcattatctttctgaaggtagcagacgtttctgaagcagtacggcaatatgctgatgccgtaatgttatcggcagagtcagctataggtgcatatccccagaaagctctagcagtcctccgtgctgctagtgagaggatggaatcatggagccgtgaggaaaacatgcagaaacttcttccacaacatcagcttgcaatagctttgcctgataggatctcagagcaaatttgcaccagtgctgcagaaatgggtatttttctaattttcttgtttatacatcctttccagatatccactacctttttctttcgataagcaaatatatattacctttttataatatcatctgatattcgctcatggttactctccctgcagcaaacaaccttgcggtggatgccatctttgtttacacaaagtatggtcacatggcgtcgcttctttcgcgcaaccggcccaaccctcccatttttgctttcactgataatgccaactcaagaaagagcatgaacctctactggggagtaattccacttcagctaccactgtcaaataacatggaagataacttcaatcaaaccatcaagcttatgaagtcgaagggttcagtgaaatctggagacacagtcttggtcgtcgccgactctgatctgaaccgaccccgtgctgctacctcagttttccaatccattcaagttcgaatagtggactaggttagtcattgctgagctagttgctagcagctgcagatctggatggatatttacaaattatacgatgattcttgaaattgttctgatgcgaacttcttgtggtatttggattaggggtcttcatctgcaataagtatcgaatgaaagtgttgcttgtgcgcacctggtattagtttgtatacattccaatcatgaatcatctcccctttttcatactaaaaggcttcaaaaataattctatgttcaaatgttagcgttatgtgcagaatctaaaatgtacgacgttctaaactgtggcccactatgtctatatccaagccaccatgtaatcatacaattttgattctgatacctttgagtcgttctgataacatacgaagtgtatgagttcatgggtattggcattgcaagcataatgccgaagagccctaatttaagaacaatacatacaaaaatttaaagaaaagctnnnnnnnnnnnnnnnnnnnnnnnnnncgtttggtaagcgggaggtcttgaagttcgactctcaacgaaagcataatttatttgcccatttgattttttatgaaatttttgccacgattttgtttgagtttgtgctaagggaagcaattaaataaccatgggtttgagacgatttacttgaagtatatataaccacgatttcattcgagtttgtgtaaggaaatcaaataaccaggattttcttgagtttgtctttaggaaagcatataactaattaaccacaatttcgtttgagttgtgtgttaaggaaagaaataaccacgattttcaaacgctgcgcgcgccacacatgcatgcctgcaagataaatttgtgcacttgtgcagtgaaatctattagtactattcactgtataattggtaagaaacagctagcctaccataatctgcagaagcttgctacaacgccgtttcgtctatgttcattttaagttaaagtagaaaaagccgttcctctttaaagaaagcagtaaaactgtggaacatatactacattcgttttataatatatgacgttatatattgaaaacgaagggattattattatcatcatcatcatcatcatcatcatcatcatcatcatcatcatcatcatcctcctcctatcaattccttttcaatcattttgtatggtttttatggtcatgcctcatacttgtcttcattaatttgcagaaatgagcttatccatgcttgaatgcatctccccattttcgttatatggatgtgaacattacaacctaatatcgctatgtccatggacgtagaacaactagaggaaagttcaagagtgagttggtgtgcctacatcaattaatggaggagcacgcagcaaaatgattcctacgtacccccgatccacaaggataggcaatcatatcttcattgactcaatcggacttataggttgattcttaaagcatcatggattaaagcggatatagcacaagaaagatcatcggggaaggaggacaacacctacgataggaggtctaggattggaagccaaattgagcttgtgcctgttagagatcgagttgtaaggatcctaaccattgtaatatgagtaattttacactccttgaggagatagtgggagataacatattttctaatgtaaaatttggtacctcttggtacctccaatactaagaggtatggaaatttacactaattattttttacctctttgtgtctctcaaggactacaaaatttctcttgtaatgttacatctagaagtgatatatgctaagcttccaatacttttgtgcttgtagtctagagagcttattagaatagtcaacgacgtagggcatgcgcttggacttaagagaggaggagagcaaacagagagcactccgtaatatgctagaggtaaattgtcaaactattttacaattcaaactttgccaaacatgctctaacatcactttgcattaattcattattgtggaatggcatgtagaagatgttgcaaaatggcggctcgccttggatgtcatttaggtggagtatatgtttttatcccttgccacctctatgaaaatcccttaattgatatgtccaagtgtagctagaacatccctatcgagctcaagacaccaagaaggcgatgcttcttcatctcatacccggaaaggccacggctccaagtgatgacgatgatgaagaggagaaggacaacggcaaggattacatcgtatattgtgctgacgagattgggccatctcaacttgacaatgcacctcagccatctcaacctactcaacaatacaacacttgttgtaaccaatcgataaaacttaatacattgcaaattattagacttcccttcacattctcaaaagtaagtccttacaatatgtaggtacactctttggatggatgttattcgacatcaacataaaaagtgaagacatgtttttacaaattgtgttgcaatgtacgttgattactaattgcttgtgatggactacgtgttgtaatatcatgcaatgtgaaagactatgtttctatttgtatcgactatatgttatggtaatggatatgttatgaattgctatggtcaacaatatcccatgtgtataattgggatatggtaattttttatgagatgtgctatattgttatatctgttgtgcttacacaaatatgtataaatgcatgtggttcatgccaaattttactgtcaagttgttctaggaataatatcttcctaacaaaaaaaaaattccaggtgttgccaggcttggcaccagcctcaccatgtgcctacttccacaccttggcaccagaggccgcttgaggcaggaggggaggtcgccagtaggggtgagaattcggtcagaccaaaccaatagtttgttttttttttcaaaagtttatttatctagaaaggataaatgattggttcctagaaaatgtcaaggctgagtgtttttgagtcagttagaaccgaactaaacaaactatcagagaccacgtcaaaaggcaaatcataaaacacgatagtttacattggatttagagatctagaatagatatgagagacaacatacaagcaccaaatccaaaaacaaatcaccgaatcaccatagtttttacaatggaaagagagaacagatctaagagcaattagacatgcatgggagagacatgatgttgccacctaaggatagcagctgggatccaccaccagcctctcctgactccatcgctcgagccatcactgctggtccctccatcctcgacatcggttgtgacgagcagacagggtcgcccggagggaaggtcggagcggcggatcaaaggaggaggaatggaaatcaaggaggcggaggaggaggcgagccactgggcgactgctgcttgcagcctcataggggcgtaggttggcaggatggtggcgacgttttatgtgtggtgggaagtggatgccaagtgggagaggacaggaggggaggggaggggagctaaccaaatattttggttttggtcaatttggtttcggtttattatgcctacccctaggcaccagggccttggctgagatgccggttggggggggggggtcggtgccagcctccttggcgtcgagctgcaacacctcgacgtaagcttcattggcattgagccctagccaccgcatcaaccaactaggcatgggtgccacgaaaagggccaacggggggagggggtagagggtcggcatcgagccattggacctcggcgccaaaaaagggttcgttcctaaaataaaattttcagggtctatttatgaaataagtattcaaaagggccaaaatgtaaagattttaggcttgtgagcactcgtctttatgtcatgtactctagtaagtaatagtgtacatgtataggcttttaatgttgatatttttctatccatatatgaatcaaaggttttatgaaatcgaaatcgattctttcttagatatatagatagatggatggatctatctttctattcagatatcttttgcaattattcctaaatccttgatttggccaggaaataaagcactgctttggccctaggaagcgaagggaatgagctcggctgcttctcctccacgcttctttatttctccgtgccccttctgcatgcacttcacgcgccattggccctttgctctcttcttgtttcttcattggagtgttcggatggacttcgctgttctttcccaatgaaaatggaaagggttgtatcacatcgaggtgtcaatccgttttccgccccaaatgagatggcgattagtcacctttgtcccttcatctttatgaaaggaatcaaggcccaaccaggctcgcgttgttccagtagcgcctcagtatactatcgtgcacagtaactaggagtcctattacacctaaggccaacttccattcaccaaacccaggttcatctcgtgtagtgattgtggactcgtacaaggatatggagtcgacggttgatgtatcagactcgaccctgtctttcgtagcatgcattcccatccgtgttgcaactgatttggtaagctacgtgtccggtgcaaggaaaattgccttcggtcttccaaccttactcatggcaaccttctggccgctcaacaacctataatgctagtcactactcccactggggctaggaagtaagccccacaacccaaagcggcgaagaacaaatagaatttgctacaaaagcctgctaacggggtattcccgtatatgagaacattgtaattgagaaggttatagccaaaataggattcggaattgataagtattgtgttcctttaagatgtacaattaattaagttctgtcaggcatccacagtttctccatgtataatcaaattttggagggtttggttcctaaggaaataattcttatatgatcatttggaacaaaggaatggtttccccaaattccttattagtattgtctcaaatcataggaattttgaggactctcaacatgaggttctaccatactaggtaaaattcctttgtatctatatatatctcttctgatttttgtgtttttcatgtgctccatctttctgtagtttttttttaaagtttttatctataggattggagatgacaaggcactcgtgactcctacgttttccatattcgcatgttttgaaaatccgtcattccaatgaccaaacaaaggagccctaattgtttgttttccaacttctagcttgaattttctaattttgattaggttacttattattctgcagggaaatgtccatttaatgcgcaattgttaacgtgttttcactttcagttatttcggtcgtatcagtacgtgaacatattgacatattactagctacagattgaacaagtgaatgttcattatattgtacaaacatcttaacaagtcttaataattatatatttattatttcactggtactctgctagtacccagccttctcacctctcagatccaacagcctatatatgtgctacagcaaacatcatgagagcatcttcagtgcccagtactacctaacataaagtacactactgcagcttcaagagacttcgctatatacatgagctgataatttggccggatatatacatcattgagtatgttgctggattaaattccattaattatccaaaaaaatagctgacagtagcttatggagatactcctatgaagcagagatttaattaatttccgtctctgcagtgaaaattaattcagaggtacatatatatacgtagttatacatcactaacatacaaagggccatcattgccatttcatatataaccgacatcgcaatattggtttttaatccagcagcagggcaatcgactgtgatagtatcactgccacgaatatgcagtgcagcactgtatattctgtgcactcgtgcagtacttgagccctggagatgctattatgtatggatcttgggttagattctgatcctactgtatattatatatatgtatatatttaaatggttctttccacaaatttcgttagttccaacacacatcgaccgtgcagtaaacaatatattaaagcaaatttaataatataatcaactactagcttcaaaattggaacatcatcaatagctgacctagggcctgtttggtagggctccaactcctaaatcctagctccaaactccaactccagtgggagctagctcctgttggagctagagatactcctgaaagcgtttggcaagcctgctcagctccagaaattctgaaagagatgataagggggagatagacaatactacccttattgttttcttgtttatttgacgtaggattaataacagttatttctccttaatatttgaacactaatatggaaggttaaaatttaattaaaataaaattgataaagttctagttggtgcatgacatatatgtaataatacaaatgtttagaaataataaccggtagcattgtcatctaaacatagaccaaaagagtagaacagccatcatcctgcaatagaccaaaagagtagaaaagccatcatcctgcgatacggccggctaggtcatcacgaaatgcatccatggatacatcactttgaccctcggtagatgtatccgatgcatcttgagaaatgacatatctcctaaatctagatggaatggtaggcacataatccggattcctttcaaacctatgaaaatgcctatccggagcattat

SEQ ID NO: 59507 - DNA, 3142 bp, Oryza sativa
aacaagtggtagttaccttggggaggatggggaaagatatctatatcggttctcaatgcattaaatagcacggttgtgtcatgcatcgagccaggttgtccaatagatgcataggtaaatctcatatcatggtcacaaatagccatcacattctgagtggttgattttgatctaccaatatatctaatcttatcatcatctggaacaactgcaaggatatgagtaccatcaaccgccccaatacaatctttgaagtgtggccacatacgacgatccttcctaattctctcatggacattagaaaagtttggatcctttggacgaacaatatcacgtcccaactccacaacagcaaacaatacttcttcaatttttcttgatattgtctcaccagaatgcttgaaacagttttgtgccctttggtttgatgaaccatcacctagaatgtacaaaaaaattgcaagtgcctccattgtatgcatgtgcacagtaggtgccaacttatatttatcaaccaaaagatcatgtaatgcaagaaaggtgttgccattcatgcgaagcatcctatagcattcacctggtgtggccaaagtttcttgcacccatcccattccactaagtcttgatgtcctaggcgcagccttattcatgtagagagagtgataactctctgccattcttcgagttgaagaaatattgcttgtcacagtttcaaacaattgcatggcaagcaaatcacaatcatattcttcatctgatgaaccatcttcactctcacttgacatctacaaagggagacatacaaaatcaattagaatagtactgcatatctacaattaatcgaacagtactgcatgccatacatatgaaaataatccaagagatatatatctgaaaataattcaataatagtgcatgacatatatatgaaaataatccaacaagattacatgacataggtctgaaaatagtagttcagaacccatacaacaaggtgatacaatccaataatagttcagaactgaaaatcaaataacccatacaaacatgtctcttcagtagatagttctgaaattaaatgacaactaaattaaagtgatacatttcatggccacattgcattcatctaatttccatacttcacatcatacttcttcttaagccatgcaaagcgtcctgcaggagtgcgcaatgaattaacaaacatctctctttgatccttcttgatgaaaatttcagttgcaatgaagtgttcatttgtcccttcaacagcaccacactcctccaccaaggtcataacatcctttatagaacaacccggtggatcctctcttattttagtgaatgattgaatggatgataaagtttgtgcagagagctcgttactctttgacatctcctccaccatcttttgggatccactctttgtttttttcagcttatccaccttcgagctatctcctctcttctctttgcgcttggttcatcttcatccgtctcatcgtcaatctcattgacatcggcaatttgaatagtgccattagtggtggctgatggtatggtgccttgccctaaagaccaatggtcggcaccggtattgcgaatgtcttcaaacatcttctcaagtaactcctcattttgaagccggcctttctaaatttgaggcagcctgctatatcctacatgacatgacattataaaaataagttaatacacaattttggttcgcatttgcataatttaacaccgtacgacaaaaacttacttctttaagttgtttccaacgtgctgctgtagctgtgacggtttgccttgcgtcatcccatcccaaacctgtttgagatttcaacttcttccaacaattgtactcaatcctaagtttatcccatttgttcttaatttgaagcctagtgtacctcagccctgtctttgaggcaaattgctcaatgacttcgtcatacccagaattggataaatgggtatttggacgattacccgcaactacttgatcagcaaaaatctcacacacaactctagtgttgtagtcattccaatcagcatagtcaattggcattttaacactcttcgatggcacattttcagccatgcctgccatccactcacaccatagtttcaaagtttagataaaggttcagaatgcactactataatttcacattgtgtgttcatgcagggttataatacatttatacacctatgtatcaatctgaaatcaagttatacattatcctctcaagcatatacatcaatctaaaatcaagttatacgttatcctctcacactgcaagagaaatagagaacataacatcaatctgaaatcaagttacacatagtactctgcatatttttacagcacgcatctttgcagatttttacagaccatagcaagaaaactcagggcctcctcatggaccactacccgttagatctacaactccatgtgacacaagattgagcaaatatcaagcaatcatccacccaaaaaattaaatccactccacaaaaatcatgctgtcatccgaaggaaagatttggggggatttctagggttttacagatttgataccttgtggtgctgggggatagggaccggcttcctcgagcttccgccgccgtgcgctgccgctgtgagcctccgccgtcgtgcgccgccaccgtgcgttgtcgccctcgtctgcaacaaggtccgccggaggtcaagagagggggaagagacaatgggggaggaaagaaaagaggggaaaggagaggggatttgagagcgcacctgctcaccgctgccaccggttcgtcgccgtcgctggtgtgcctcaggcagatgcgctgcgccgccgcctccttttttttcgcaagcgagactcgctggtgcggcggactgaggggatgcgatacaggcaaggggagggggaggggtggagggagtagttcgatggcatttgcgggtaatttttcttaaacttcagtggtacttctaaaatttggttggagttagagttagggagcggggggaatgccgctccgcgccgctagtacattttttcagagcgatccgcctactccgctccattttttttgtggagctggactgtttggttggactctagttggatctgagatgaat

SEQ ID NO: 59508 - DNA, 19682 bp, Oryza sativa
tgccaatgtatacaacctgcttgtgttactatactacacccgctcttaggaagtactacctccctcttaaaagactgtagttatgcactatttatattcaacgtcaggctgtccgtattatttaaaatttttttatgattagtattttaattgttactccctccgtcctaaaatataagcacttttagctatgaatctagacaactgtgtgtctagattcatagccaaaagttgttatattttgggatagatgtagtattatgtgataaatataaatagtagtttatatgtgactattttttaaattttataataaatttcttaaataagatgaatggtcaaacgctgaacacaaaaattcacaactacctacttaaaatgaaatggaggtatatatattactactaataagggagacatggcacgtgtggttttagcatggaatctgatgcatctcccaaaaggtggtaaatgtggagggccatgcattgcctgcgggagcagcatccatcaatcatactacgtactagttttgtaggtttagtactgatgcaccatgcacaaacatggccaaggacccgacccctgtagtagcacgtttctctgtaactccaccacgacggtcgttgggtcctagctagcttttctgaacgacatggactagtgttattttcttctctctctctctctctagctctcatttttttgggaggagattaaaggcagatggattaattagctgaaattacgtacatagagttacaatacattcttcactgtatatatgaacgagaggatattaattggcaagctgctcatctatccatgctggagagcttgtaaaccctactaattaattacattacattgatccctcttaaccttctgaaattctcacctcagaggatcgagatcagttatatcatcttgttctacgttttccaaaactaggatttcggagatgcatgttggcattttgtatcctaataaatcatttaagtactaaaaatttcagcaaaatctataatctttcaaagcaattcatcctttttatctcatcactaatgtgtctcagaaaccagcttgaactagcccaccactatagtatgtggtgatgtccgccatagctaccaaaaacatgagaacctcagctttcttggcttctctcaccctctgcgcacaaaggacgaggcatttattatataaaaaacccatcgcttgtatgttaaaacatacatcctatctaacattagctatggtaaagtaaggcatagaaatacaaaatacttcccgacaacttgtagccaatgtatttcttgtaagaactgatacacacaacactaatcgactacatgttatttcagagatccattctttaatatggtgtagctttatcgtgatctgcatgtctttcacgatctaggatttaagagaagcatattaggacaacaacattttatatcctaacgaatcatttatattattggaaaagttagataaatctatacattttgaaagcaagctagttatgctcggcatcacttaaataatgtgtctcagaaacccacgctggaattgatccactagaatagtgtgcaatgaccaccattgttaaccaaggacacgagcgtaccctagctttctaggcctccctctccatatgagcaggaaggctgggatgacaagacctttattacactataagttctagagttatgcatgtgcgtacgtatgacactagttgcaacatatgaaacacttatatcaatattagtaatgcatacaaacaatttaaaattagtgcttcattataacatgtagcgaattgaattgtcttgcaagaactaagtggttgttttgcaaggctcaaactcctaaatctaactgtaggagtgaaggcgaaccctgctccactcttctagttctttctagatcaacttagctcagtccactccaatggactatgtaagcaattggtctatggagagagagagagagagagagcatattttcttatttatttttacacatggattaaaaaaaagactaatatgtgaaagtgcaactagggattctagtcataggtcacctgtgaaaattattttttataggtgcctcccttatgaggccgaacataaaactcagaccatttttacaggcaaacttctcaaagatccgcttgtgaaaatcatatttcccaaaccctcgcttcctctctcctctcccctcagacccctcttcaatcacgttctctctcccctcaaaccccccctctccctctattaaccaggtttgcaggcggcgaaagataggtggcggcaacatctgtggggagggatggacccttcctctctctcccttaccatgctcacaggaggcggtggcaatggcaaagtggagatgcggtggtgttggaggatgcggatgcgccatcacggcacttggaagaagtggatctaccagcggcttggttgggaactccttcccttcttcctttgcaaccactgtgacaccgatcgacaagctttgctgaggcggattcatcggcaacaaccttggaaacaccggatctatctgttgtgggctgcggagtggaggtcggcggcaaaggtgctcaatgaaggtgatgatggtagtaggcagatccaggcgaggcgaggtcattaatggcgtcggcggatggatccaaatgaggcaagggtcatccaagacaatgaagctgggggagccctgtatgcaacaagaaccatgtcttcgctccacttcttgtctccaaatacttggtcattcctcaagcttacttgcctttgagaaccatcttatccgcctccaggaggacctcgtctttgccctcgaggaggacctccatgcaaaacagctgatcacctcatcgaacttcaaggtactagccaggctagcttgtacggagtggcttcaaggggaacatttttctctactgctgaaatctgggtttgttggaaccatgccaccctaattttgcaaaatttgagatatgccacccgtatgaatttggcatgtacaatggatgccacaagcactagtggtctcaagacgccacatatgatagaacaacacaaaggtcacactagccgcagtgaaaccactgcaaaacgtattttgcttttcagcccctatctatttatatgtcagtccttatattgtatgttattatcaaacctattaaaactttatattttggaccctataacaaccaaaataagtacatatgcacccctaaacactatacggacccactgtcagcctcttcccccctatcttttttattctctctccctctctcccccctctctccctctctcccgagccatctctctctctccctctctcattcgccatattcgctggtgagctccccatctcagcggcgcggacaagttctcggtggcggatccggaggcgggctcgacgccgccgtcctcctcccccacgacggtgcggacgagctcgccgacggcgtggcgagcttggtggcgtctggctcgccgaattcgggcgcgagctcgctggatctggcggcgggggccacaacggcggcggttcctcttccccttccttcttctcgagcgttggcagcggatccggatgcgggctcgacgccgccgtcctcctctccccacgacgacgcggaagagctcatcgatggcgggctcgccggatccaggtgcaggctcgccggattgcggcgagggccacaacgcggcggttcctctccccctcccttcttcacgagcgtcggcggcgaggagcaacggtggcggcgatgcgaccggacgaggcaacgcacggggctccggctccgccaacgcgtggcctcgggctgtggcttcgcccttctcgagcccaagcgcgacgcttcgagcggttcctctgcaagcgcgaaatcggtctgcggagccacggtccccactgccatggatgcgcgtgtccgacatggagggttaagaccacaagccagagccacgctttgtacatggcctgacaagaaatcgaaagttttatcacctgcattgacatgacttgtgcactatttttgcacgtacgccagcacatgaaagactatcaccggcactgtgccgtcacaagctggttgtaccaaaatagtcttgtcttggtgttcttccaggaaagatgccgccaactaaatttagtaacgtactgtacgtacagactacagtagtttggtccaacgtacacggtatcacaggatcaggtacatggctattctcaatagtattcttttaattaaactccggccacttgggtaaaaattcgggtcttctttgatcagtatagctaagatattttgtaaaatccgtacgtgtaaacaaaattcacaaagctatatatatagagagagctatgatatttctttaataatgaaatgaattatatcttgggacatatataggctgtgttcttcctgtacactttcccaacttctactcactcatttttcacgcgtatgtttctcaaactgttaaacgatgttttttatttttacaaaaattttctatagaaaagttgcttttaaaagatatattaataatccattttttattttttagtaaatacttaattaatgatacgctaatatgttattccattttgtgtaccgtgcggaaagattcccaaccgccacaatcgaacatatagctatagatgataactaaacttgtgccgttcaaaggactcatgtaatagtagcttcaatcaatcctgatatatacaatttaattaaaagaactatcctatagttgtagagtctgaatagatttccattatccagtaatgcacctaaaattcgagcatgagatgactctagctagcttggatattggtggcggcgagctaacttggtttctcacattaataatttacttttaaaaaataaacattcgctctagttggtttgaaataaaaaaaaaattgaagttactgaaagctgagcaatttcttcaggaccccgtattgaaaataattaatacttccttagagcgttgtatatatgcacacgttaggttagcacgcgattaatcaacaattaatagattggctagctactagttgcatcatgagatgtggatatctttgcatatgataatctgacagtgggttacgagtatcattttggtaggattcggccagataatcgcgatcgccagaaatgatttgtatattaattccgtcgcttttggttgtcctttgtggggaaagggaaaggtgatcgagagtcgtatgcataatattagcggcaattttggaggagacatagcacgtcaaaattaaatttaaagctaacacacaaaaggcatctgcttcacgagtgtagttactgcacgtttattttttgtttcctaaaagtaagtccaaagtgcacgtttataaactgttcttccttttgtttagattctatatctagcaacgattttggcgcagtcggtttgattcatgacaaaggcgagccgatatgtataagacgaggtgattcagccaagagtacaaaacaaaatggctcattttcaaatgagaaaattatttacagaaactttggagctatatagccatccaaagttcctttctaaatactacaaacacatgcatactttttttgaatctctttcaaaatgtaaggtacatatgcgtgtaggatcaatatgactttctgccttttactatcatttaactatagtctgttgtgttaggtttttatattttgggatggatgaagtattaagtccaccgccccccctcccccccccccaaaaaaaaaaccgcgctcacacacatttcgtatcctcttttggttcaaatcattaactccataggtacactggctgttcatgaatgtagctaggagacactgcacgtgagatatttcactttgttaatctatatatatggtactgtatagtacaattgatggtactacataaataccagaggtagcacatgcaaatcaatgttttgtttagggagaaattttatggtccttacaagctgtcaaaatgccaatacgaaaaggttaaataaattacactaaaaaattggtacctttcggtatctacttaagaactacaaaatcactcattttaaggtctataatgttagtgataccttccaagtgttgaggtatcaagagataccataaattagtatagcaaatctttggattatgacaactcctaaagtaccatgaaaaatcccatgattgtttaaccaaaatatatgcaattgactaagcaaaagggagcagtcgtcctagtggaggtgctctatatatgtcaaagaagagaaaagcctctgacatgatttatatggagagaggtggttagccagctaggccaagcacaaaaaatcctcgactagtcttgaatggtgttcttcagagtgactctctcttccatacattgtcccaaatattatttgcatgttaagcaggatctgagagattgttgatagatctgcaggtaagtggtactgtcccactgtcttggctacaaacgattctgtgtgtttcacgagctccaattcaatgggcaatctgtagtggcatcaagtcagctactgttcttgtctgtgattgatagctgtatatgtctcccggatgcatggatgatggatctctgtgcttgtttgccagtagaccagtagccaaatagttttctcttcagactggctgcaaaagtttttgttcgaccattcacatctcgaccagtcgattttctgtttgaatcatgtagcttagctctcgctcgatcgtccaattaatcttggattcttggagatatataactctccgatgtctagatcgacattgatcagactcaagagtgaaatgtttgtttgtttgtttgttattttgtctaggtagatagctagtagagttctttttctttggagacatggaggactcgagcctgttcatggagtgggccatggagacgctgcagcacctgcacccgctgccggcgacgccgccgcctgccggcggcgggtacgccggcgacaacgcgacttttccgtcgctccaagcgctccgcgagtcgtcggtgtcgcagaacggcatggccccgccggagccaacggcgcacgaaggccaccgagcctccaacagctggagctcgggcgacacggacagcgtgtccggtggcggcggcggcgcggtcatggagcacgacggatggtcgacgtcgccaaattcggtcaggtgcgccgctggcggcgggggcggcggcggcggcggcggcctctggcccgtgagctggaacttctcgtcggccatgacgcagccgtgcaacgatcaggccacgccgtcgaacccgccgacgacgacgagagcgcgctacggcggcggcggcgttcgatacctgccggccgccgtgtcgccatcgccatctgcacagacacggagagcctcctccaaaggcaacggcggcggtggctccggctcctcgtcggcggcgccgtacgcgcaggagcacatcatcgcggagcgcaagcgccgggagaagatcaaccagcggttcatcgagctctccaccgtcatcccgggcctcaagaaggtataatacatatatctccatttctcgctcatttctctcaccatcttctctgaacacgaagatcgatttgaacagatggacaaggcgacgatcctctccgacgcggtgaggtacgtgaaggagatgcaggagaagctcagcgagctcgagcaacaccagaacggcggcgtcgagtcggcaatactcctcaagaagccgtgcatagccacgtcgtcgtcggacggcggctgccccgcagcgtcatcggccgtggctggaagcagcagcagcggcacggcgagaagctcgctgccggagatcgaggcgaagatctcgcacggcaacgtgatggtgaggatccacggcgagaataatggcaaggggtcgctggtgcggctgctcgccgcggttgaagggctccacctcggcatcacgcacaccaatgtcatgcccttctcggcatgcaccgccatcataaccatcatggcaaaggtaagacaaattaattcgtcgttttaattcgagagaatttaaccaacttgttttgtgtttttttttgtaaatgcatgatatgtcttgtagttaatattccactctggtcaaatatatttgatgttgggagaatcatgcatatgtattaatttacagctagatctctcaatgtcaaatataacatgtccaaataatatggaccagtatggcttatatgctttaaaatttgtggcaccagtcttagggcccatttgaatcgtaggattgaaaaaacggatgaataggaaaaacacaggattttgatagaaatgtaagtgtaaaacaggggattgcaaaacacaggaaaaatatagaaatgactgtttgattagaccgcaggaaaaatgcaggaatgagatgagagagatagactcaaggaaagttttccaagaggtcagagtggatgttaactttcctacgttttgctctataattgtaggaataggaaagtttcctacattttttctttttcttattcctatgaatcaaaggcatgaatagtgtaggatttcaattcctttgtttttcctccatttttcctccaattcaaagggggccttaaacaatttacaagatcaagtaaggttatgaccacacaagcgcttcgatttaagaatatttcgaattgatcatcttcaacaagcacggacaaagctgtaagtaagtaaaaatagtttacacttggtgctggagcataaacttttgctacagctagcatatgggtttgctttgtgctgagaaacgtctaggggtctttcggctagctccacaaggtggtgggctagacgacctgggttcgaagcctcacctcttctaatcaattgatattaatggtcattccctaatattcacgtctgggtttgccttgtgctgactgcaggagtagtaagaacactaaaattcataaggtatatcgtgatgataatcatgttatgtagtacaacatatcttatgactacagtcattctttatgcacttcttatatactttctagttgcaagattttcaattaaaaaaatgctgggcctgtcaattgtaaatttattgctttatacatgcataatcatagtggcttataattaggtggaaaatatttttttaagagaggtggaaaataaaattgattgggataaaactatagtacttggagtagctagtatagttaactaattaatatcactgaaaacaaattttggctatgatatgctatatagggtaatatttatcacctaatcggaactagatcttatacatatataatggcttctgtaatcatcacagtaagaaaaatggcttcatgtttccgaacttgccacatcaggaatcactaaaactaatatttgagttttaatttctcatatcatatactatatataataatatttatagcaataaaataatagttgtacgaaataaactaaatgcaaatgttgatctaatgatattgtttttaccaaatacagtttaatttatattatactccctccgttttataatataagtcattctagcatttctcacatttatattgatgctaatgaatctagacatatatatctatctagattcattaacatcattatgaatataagaaatactagaataacttacattatggaacggaggaagtattaggctaattgtcagttatatatttgaagacttaaatttcaaaatgtccgcccatcttatttagtggaaggagcaagtaaatgcataacttcccccattaaatttacatagatttaaattcttgtgcacatttattttcgctagaaattactccccccatcccaaaataagcgcaaccataagttttcgtgtccaattttaatcgtccatcttatttaaattttttttaaaaaaactaaaaatatgagtcacgcataaaatactattcatgttttataatctaataaaaatatcaattataaaaagattttaaataagacggatgattaaaattggatacgaaaacttatggttgtattttttttaatggagtacgtgtttattgttgattccgtcgtcgtccacttaactattgcatatgtacacggtgtcaaacaaaatattactccggaaaattatggcaagctgaaagacaagtgataattgattaattgatttatgcaccggaaccaaaataattaagaatgcatctacatttatttaatacgcttgcgtggcagcaccgttattttttagtcgatagcagcggtcctcaacaatattaattaattgatgaaagcggctgtgaggagatttttaaaattaaaagtcatacttaaaatcaattagaatgccaaattcatcttttcgtcgtatcttccacaaaatctgagtactatatataactggtcgttgagtggatatgtatagcaggtatatataaatgcgcgtccactaattaagtttgaaagctgtaatatacattgcaccaaaatttataccagtactaatttcttatacgggtcgcttataaaacccttcacgaaaattcgtcaaaacgtactgtcatgaaattaagttctcgcgagtttgcattcgtaattaatatatatgcatattaattatacgatttaatttgcatcaggtggaggacggggtgagcgtcacagctgaggacattgtagggaagctaaacactgtgctccagcaaaacagcagaaatagcgcgcgagaaacaaaaagctgacaaacagcaacaaacgacagctgctagctagcttggctagctactcaatcaggcatgttgccattgattccagaacagtgtaaacacacactctctctcgatctgctcgtcgtgtacttgcgtgcatctggcccgtgatgcatgcatttgcacaaataaatctagcactggatacaatttatcttagtgcaataagtttaaatatatcatatttagtactagatttagttttttggacggagagaatactagctagagctacgaatgcactctctatagccgaataatcttaagatgtaccggttcaactttttttaaagatgttcataggagataagatgtgtgcatgtacatttatatcaatgagtgttttgcatgttatgagtatcatcatttgtacaatgttttttttaaaaaatattatgctgatgttgatcgattggtcaggaggattcatgcattttgcacatatatttgcgcttatatatgttgacactgcacggccagcgaccgatcgatcgatatacgagaatctcttggatgatgaccattggattgatcgaccggcaactagctactctggctagctagttttattagctcgttctcattgctctccggcaccatacttccgctcagatgcaaataattcacttttcaaaagtttccaagctaggggccggcctccatgaccatattcccaatgcatgcatgtgttcagcatagtctccatcttcatgttactattttttaaagaaaaagtacgaattaccgtcttaaattatcatagtcaaccgaactaacctaaacataaaaaccagacatctttcacccccaattttataaaccggataaataatcccctagcttaatcccggtagttttggtcctatgtggtatacacgtgatagtccagtcagtatttcttttaaaaaaaatcagtgcggctcactataagatctctcccctcccacctctctccaccaccaccacacgctgcggccgacgaagatgctgccccctctcccaccaccccccctctcctcatcctcctcctcctcacccaccaccggagaagctgccgccgcggacgacgacgatgacgagggatgcccttgcatctcctcatgagacaaccttccctaccgagccgaactcctcagccttcgccacggtgccctccttctcggcctccgccggcacgtgtgtgcagatgggagagggctggatgatgcccttcttgtagagctttgcacagcatgggcttgggtgcagacggaggtcgcaagtcccaagcgggcagcggcatgtcgtccctatccatgaggatgtgccacttgcggtggagctcatcggccttgacgcggggcatgctacggaggcgcgcttgagctgtgttgccttgacgaaaaattgttgattggactgccacacatataccacgtaggaccaaaaccacaacggattaaatcgggggagggggggttatttgtctggtttacatagttggggcgaaggatgtctagttttcgagtttgggggggaggggtaattcaatcgaccgcgatagttcagaaggctaattcatacttttttcctttttttaataaagacagtttaaatcttgcgccatacctattcgatacaataaatattagtgtaagaaaaaaaagacatatctacagtggtaggacaaacccccgaactcactcgaaaagatgaccaatcaatttagcatttccatatattttttttagataatgaattttcattaatccgatctttatatctatgaaggatatacacagctaaaaatatacaagagcacttagactcacacctcaacaaagaggagaacacacaacaaaaaaaaaagaaaagaaaaacctacgacctcagcacaaccctgcttctcgacatcctctcctgaaatgcccagattcggcgagtggaagttgtctagtcatcgctgcccctagtgtgccgtcattgcgaatctccgctagtgccatgttcatctacttcaagtgagctgacgccacgcgttgccggttagcccaccttcattcgtcatcatccaatcagaactagccgaccagacgcaagctgacaggatctgcttccgcttcgtcggattcctaggcctctgccacccataggccatagggctgccaccttcgactatatccttctccgtctcccagatttctagcccgccgctacccctagggccgccgctgccactgaggaaatcctcttccacccggactccgaggccttccacacctgatgggatccgcctcctcatcgttgagaaccttgcaccggtgcccaggctaccgccgcccctagggttgtagccgccgccgtcgaggaggtcttctgccttgatgcccaggccgccgccgccgcctacaggaccacctccaccggatccgccttctccctgtcgaggactagccatcgacgcttaggtcgccgccgtcctccgccacgttaagtacatgaagataagccctagtataatcttaacacttagtattgttaaaaagtattatcgttacaacaacgatgaattcaagatctttctattgcgtaccaatgagttcatcattgggtgcactcagacatacaacattgtcatctctacaaggttgaggataccgataggactttctcttgctactatgtcacctatggtgttattttgcagatgcttggtcgaaatattgcatcaagtcaaattgttgtagtggtttgttttcatcatgttgtgatatttcattgcaattgttctttcgatttgttgaagcaagatattgcccattttgcatcaagtttttatcgtcaccatttgtgttgcaggcttattgtggacatttacaaacatagtacttgctagattgtaatattaattgttgcggcaggatttgagatattgtatctactatggggagagatagagttcttgtgatatttgattctttttttcgattacacggcacatactactacacaacacacaccatacttatatatatatatatatatatatgtggggcaccatggtgctcgggcaccatggtatgaaattcacaaattcgctcaaaattttcaaattgtgagtatatacctagttataagtattcgattaatacctataccaagcaacaaaacaactcaaatttaactttatttcacaatccaatattacatacctaactaattatatgtttggatgctatatacatagaatcaaaatctaacaaaatcatgtttaaattcagttcaaacttgttttgaactagttaatgttaatacctagacattttaaaaaatttcatactcatttgaattgaatatatactcaatttgaatcatgaagctcgggcaccatggagcacccaacatacacacacatatatatatatatacccacgagtgcatccccttctaacacatgctcaatagatggactgatagagagccaagataaattcatgagccttactaaaacattatcaaaaggcggtgaacctgagtgtgtgctcataattatttatttacaatagtttttgtgtagaaatatatttacaatatataattagtattgttgcatgatcgagtcctaattgttggtgtatcttgtgtgtgggagttcattgtattgtattaggtggttcaggtaaagccacttaagtgagtcaaacgatggaatggacagtagtatgataaaagttgttctgtggatgatgtccgatttgtagttgcgtcctttcatttcgtggatgaatatgactgtttgatacgctaggagctttatatatacagctcctgcgagtgacaaatatcgatagattctctgcgattgaaagatataaatatatatccatctttagattcacattgttatagctgggtctaatatatataatttatatatatatcagtctttgtattgcctctgtatatattattatcaactagattaaaaaaacgtgtgattgtatcagtgtgtgcatttgtacgatcctggcgcaccagcagtatatatatatatatatatatatatatatatatatatatatatatatatatatatatatatatatatatatatatatataaaagcttctagtatccaaatataatacacgcgcggtgtataaacatacgtaatatatatgcatgtagttttgtattgcagttttgaaatgcacatatagcagagtattttgggacatgcatcttaaagtttttggcacatatatatgccgtctatacatcagctgtgagttggtactacaagaatctgtaattttcttagaggcaaaaatcgttaaggatagcataaaaaccgccaaggtaatgacgatttttgtatagtatatacatacgtgtacgcatataatacgcatgtccttccatactgtctacatatgcaaaatgattatgcaaatctacgagcataaggctttttcagttagcttatattatgtcatgtttaattagcttattatatatgctctttggaatatatatacagcttggctagcaaaataatcatgtcttttgttgtgctgcattacatatatatactgaagaaattaggaaagactcaagcatcgacgaaaccaacatttggagtacatatttattttgctgcaaaagattgagatttcgctgatggctgagggtcccagcagctttgcatgcatgcatacatgctcgattatctttaattagaatggttaggagctctgccaatttattgaaaagagtaacttgaaataaagttacagcagctatcaaagatggatacatcaacgccataacataaaggaaacatgcatgcttaattatcttgagatatgttaagttaccaatactttggggatgtgtccccatctgaaactgaggtgaggatattcacaagatcaatctgacaacctcttaggacattgaaccttgcttaccaaaaaaatatatatacatgatacatgcagacagagacacatgcatggccatgctaggtcgatatcttggcaattagtgtgaaatagtccctgacaagcaagtcactaatttctgggccagggcagctagctgaatgtcagcacggtatataccatggagtagtataacgacaagtagtttgttcgcttgatcagatgggccgtgcaccacctaattaaacccgattgagaccagccaggactactgctatctgatttttttacttgactttattcattttttcgatgtgattgccacattcattctatatgattttctagttacccggaacctcctgtccctgaactccggatgtttcgggctgcctgccaggaagttccgggccctgtttaaatttgaccgccgcgattatttttagtgtttttcagttaagcctactcaccctccccccctctctaggttacatcttcagcttttatgtctggcagcggtgagtacggtgtcagtgagcgtggatggctcttcctcctcgccccgactccatgcgactccgggatagtggtaacgttggccatctccttgctctagcggcatagcagggcttgggtcagccttcccctttcgaccatggcacgggagcaagcaggtgctctgcagcagagcaagaggacgaagctgggttgggagggtgaggtggtgcggcggtggagataggggcaggtacgtacttttatcgctatttctctctccatttcctcctaatataataaaataataccgcaggtgtccagcaaataattaccttttttttgcggtgtcctctagcagaaacacgttcttgtggtatcctctagcaaagagagccattgagtgttgagtaaattttgctttgtaaagctgcattggagggattcctcaccgaccgcactcgcgagaaaattaattttcgcatgcgttcgctaaagaaccgtaaaccatactaaaatccccacccaatccctcatcccctatctcacatcaagtccccacccctacctcaccatgccctctctcggcttcctccttcactctctctccctctccctctaggtcgctaatgcgcctcgtgggggtgaccggttgctcgctccatccctaccctagtccaaacctgtggcagtgctcatcaagagaatcggcaacgatgattggacgaggcaatagatttgacaatggcgtgtctagaggtgacgaatctagtagtggtagtgcctgtaggtggcaacctgcaacggtaggtggtgacaaagaaaagacactactacaagaaccctaattggtgtcggttgggaaactcccttaggtattggttttcccaacaggcatcacagaaccggcaccgctgaccttcattggaactcttttcttcttcattgtactattgcttccaccgtcatcatccctgtctccacaattataccgagaagccttgcatactggacattcatcaagatatgcaaaatcaccccggtaaagaatgcaatcatttcgacaagcgtgaattttatgtatctcaagaccaagggaacatataacttttttcgcttagtacgttatttcagacaagacattatccgcaggaagaatttctttcaacaactctagcaactcagtgaagctcttatcagaccatccattgcttgccttcaggtgaagtagagataggaccacctggagcatggtgtgctccgccttacatccattgtaaggtggagcttttgagtcctccaccatggttttgaacatgcgatatttcctatcatcagtgtcagccttctccccgtcgcgcatcatctgatctagattagcttcactgtgatcgacacatgtttggtcctcttgctcacagccgacatcctcatttggcatgtcacagttgcctgcacttccctcgcattgctcctcttctccatagaacttgtccatgagccgccttataagaagatgtgcatggactcgatgcgccagaaattgcctgtctttcttgcaatcattcaatcaaagcatggacaccacagataatccggcgtatccactgagtttgtgctcgtcaccatggcaacgaaagccgttactcccctgatatactccatagagtcacgatccgcttcatacacccatcgtagatccattacaacaggcgggtacatacaaatattacttaatgtagattactctgaatcatacaaattcaatttacccaataacaaaaccgatagatcttataaatgaacaagaaaagataagcaacatctataacaccaaattagttttgttaaatctaacattgaatatattttgataacatgtctttgtattgaaaatgttattatattttcttataaccttggtcaaactttaaaaagtttgacttagaaaaagccgaatgacttataatatggaatagagggaataataatttatcgtttattaaaaatcgtgcagaaaaaaaatacaatgagggttttgtaatttacaagaacattggaataaaatacaatgagaaatgatcattttatccctaagataaaattgatattttttttgaaaatgccatgtcacattaattattcatggttaaaaaaagaaaaataatttatattttccatcaatgaggaaaaatatcggatcatgccatgggtacacatttttccatagcggtaaaatggatattttcttgtccttaacggtgtttcactaacatttgactaacatcgatggcatagatggtagaaaacatcaactcaaatttagcatatcatccaagaatagatctaatgagattaatggacacaaaaaagaaaaagagttatccctaaaaacgacacataattgtttcgatcatgtattttacatgcatacgtagcacacggtattgtaaatcaacaagcaaaagtgaaacggagtgagaaataatgaatttcaccttgtaggcttcaaccttcaaccaaaccccaaaaaaaatcgagcaaccaccccctccccccgcttccagctaatcgggcaagaacaagaggcgctgctctgttcttactcaatcagctcgagtgggatgatatatatgtagttggctcataggtgccggggttctacatctaaaactagcatctatgtctgagaggtaccaacagttagtacaggggtggaggtagaaaggtgttggctcttaactaaaatccagcacttatctctttcaccataaaggtgtcggttctagggtgggccctgcgccaactaatccgatgtgatgggaaataaaaggtgccggattttagagaaaaaaccgacatatttctctaacagggataataggtgccgattctatttaaaaaccggcacctattaggagagataggtgctggttttagggttttggtaggctggcggagggtgtgggcaagataagcactataggtgccgaatttacctactccagcacctatagtatcggcacctatttgatgttatgtagtagtgaggggcaacacggtggagggagcggagtatggcgtaacagcgaagaccgctcctccctctaggtgcaacggcagcggcacgatgaagggtcctctcctaccactgctcgtccactccccctcccttccctctcccaaatcttgctcacgctctctcgctctaccagatcttttggtcgaagggggaggagactgcattgctcggcgaccgtcctcggtagtagcggatccaaagagccatcgtgcttggcaacagcaaccgccccgtctctcccactctcttcccctttgccgttgttcatgtttgcatgcatgcttggcgacaacgacctgatcattgtatgttgatgtttgcatattcattgatgagctacttgc

SEQ ID NO: 59509 - DNA, 13787 bp, Oryza sativa
tgcacaattaatgcaagggagtacaaggggataataatataggggttacgttttgcagtaaacagcatttaaaagtcacttagttgcccaaagccattttgtaaagacgattctagagctacacagtattattaaacaaggctgtgaaccctcacgaacctgccttaacccaaggcctacgatgatttggaccgaactggcaacccgacctgggtcccagctcgtcccaagccaacccaggccaaccattccatgttttagttgttgagcaaattttaagaattaaaacactgacttgggtacattgctaggcttgcccatatccgagggctcggctattcgaatagatttactctgatcagaggtgtacatctttacccacaagacacatcttcctcacgtgttaccacgcgccacataccaccacggtatacagacggaagacgtgacatagtttccaacccatcctagccataaacaagagtaccgacccaatcctgcctacggccgggatacccgggacaggcaggcagaactgagcccctagcattgggcaccaaccctccgccgtatgacatctcgactaccgggccgcagctcgtgtagccttcatttgccctggagaatgtccatcgacgcccgacttcatccatctccaatccgtgtacttttgtttaagactagactgagccacaaactaagccttacccattagacatgtggaagtacggtagtgctttgcaacagaggcccgagcttcatccttatagtggccggggtgctacttcccataactggcatgcacccaaaccccaccgaaaacaggttttaggggttttgaaagaggaagagaggtgtatgtccaattccaccataagccaaccattccatagtgtccaaatgatatgaaaattcccaaagtctaaagttataaaaccacctaatgttgcctaattaatcagcgaagcatctacctaaattcatactagtggaaccaggaatagagtgtccactagttggggttttgtttattctagggtgaacaaggtaataataacaatagcaataataatgtcataacaaaggtaaataggcatggctaaataaaacagtgataacgcgggaatttaaataaagcgataatgcattaatttaaattaaaataattttgtaaactgggatttcaatatgctcaaggatgatgtgacttgccttgctcgctttcccaaccaccggcttcaacttccacgaagagcggatcttccgaagctgcagcgtctacacgaccaacggaaaagaaaaggcttttactctaataaactccaaacaacaagcaggaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaattttcaattaaaaattcctatttattgcgtcagccgagggagcgggcgcgcggaccgggtccacgggaagtggggcccacgcgtcagccgctcggtccacggtggaccgggcgctcgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgctcgcgccccgatggtcaccgccggcgaccaccggtgcggcggagcggcgcccgagagagcggagagaagggggaaagcgaacggcggtcttcggctcaccccgggacaacgacgacgacgagaacggcggccggagcggaagaaggcggcggcgcggttcgggatgacgatgacggcggcgctccgacggtcggcgagcgaaacggaggcgcggacgaggtcgacggcgatgcggcgatgccgagggaggtggcgccgagtcgggaggaggtccggagcggcggcggcggcggaacggagttcggcggcgacggcggagagagaggagcacggcgcgagcacgaatccgacggcgagagcgagcggtgagcggcggaaacggaagagcggagcacgggcaacgttttaatagcaccgggaggaggagagcgcggccggagagagaggaaacgggcgcggagatctcggccgccattgaagacgccggcgacgattgcgggatgaatccggacgaatccgagggagagagagaggggaaaacgggggaaacgggagagggaatcgcggggaataattcccccctcattaaggcgcgcggggaaggcgggatgcggcggatttggcggcggcggcggcgctagggcacgggcggcgacgggcgcggcgcgaggaggaagatgacaggtgggccccacccgtcagcgagggtggcgggcgggcccgcctgtcagcggcgcgcgcgcgcggggagccgatgggccggggggagagagagagagagagagggaatgggccgagccggcccaagagggaaggggggggggaaaagaacttcttttaggatttttctttttataaacctttttaactttgtttatttcttctcaattattatttgtgctctgaaaattccactaaaatttgagggctcctttttagaccaaggagaatttaacaaaaattctccgggccacatttgaatttttcttgtacgtattttagggtttgccaatttcttttcgaattttaattaattctattattccttttagaagatgatttttatttcgggatgaatttatcaggacgtgacagagggttgggaaccttcacttcccagcacacaaaatgaagcagcgtttagcgcgtgattaattaagttttagctattttttttcaaaaatggattaatatgatttttaaaacaactttcgtatagaaacttttgcaaaaaacgcaccgtttaacagtttgaaaagcgtgcgcgcgaaaaacggagaggaggagttgggaagatgtcctaccgaacgcagcctaaaaagaggactaacttgatggtacaaataaagcatctttactaacaataatattttacttttttaaaaaaagccactaaacattcaattaaaaaagacaaaatattttacttttaatttacgtttaattcgttagatatgttttttccaaacaaactaaatagatacttttgaaatatgagagatgtttatatggatcatagataattgtttgtacgaatgaattaaatattatatattttaaaagctaacaaatagtttggaaaaattatctaagcaatgccgatgaagtaaaattatggagaaatagtacttatgaaacatggcaatgtcattgagttgatattcgatctatataagtttttcgaacgcaatctaaaatacatgcccgcgcaatgcgcgggctaccttcctagttttatataatttgctgatagacatcgaaaaaaatgtgtcacggatgatagataatttttttttggtaatttgctaaaggacactttcggctcaattgaaaagataaatttttaagaaagactagaatgcgtctaggaacacatgcttcaaacatgacgttagtgtaaaaaaaattagaaattatacaactcaaaatttaccatcaccccaaatacatcactagcatactacatcatatttcatcttcactccagccttagctcaaaagtttttgatcatagagacattcttgtcgtttttaagattttctatctccaattaagtcgaaagtgtcctcagcaaattactagtttttaaaagtgtttttttagcagtgacacttttttacgatgtctaccatcaaattacatgaattttgaatatcttgtagcaaattttgccaattaattttgtgtcacaaagattatatgccttatcttttaagaaaagtagtactattttaaaaaaatctcagggtatgttcagattgattccaaaatgaaccttacaaaaatttgacaatatcaaaattttggcaaattgacaacattgctaaaattttggtcggattggcttaataatattgtcaaaattctatacacattaccaatatttggtgacaaactaaacgtatcgacataattgtcaattttaacaaataatgatatgattgaaattttcatcaatctaaacaagccctcgtaaccagaccttttatgaatgttgttagataacaatggcacacttcctccgttttatatattgtaagtcgttttaactatttttttcaaactttattagatataatcaaattatagacaaattagcaacatctaaaacacaaaattagtttcattatagaatatattttcataatatatttgttttgtacagaaaatatgattatattttatttataaacctagtaaaaaaaaaggttgaatatgaaaacgggaggatttaattggattgtaatgttgttttgagttttcaggcgtcagcgcaggagtgttggtggtgctagtggccttgttgttggcgtacgtgggcatggagaagaggaggatgctgagggcgaagcagaggttcttcgagcagaacggcggcctcctcctgcagcagcagctgggttccctggccgcctccggcgtggcgttcaagatcttctccgaggaggaggtcagcaaggcgacggacggcttcgccgaggcgcgggtcctcggccgcggaggccacggcgtcgtctaccggggctccctcgccgacggctccacggtggccgtgaagcggtcgagggtggtggaggagaagcagctcagggagttctccagggagatgctcatcctctcgcagatcaaccacaggaacgtcgtcaagctgctcggctgctgcctcgaggtccaggtccccatgctcgtgtacgagtacgtccccaacggcagcctccaccggtacatccacggcggcggcgccggagccggcgagggcctgtcgccggcggaccgtctccgcgtcgcggccgagtcggcggacgcgctggcgtacatgcactcgtcggcctcgcccccgatcctccacggcgacgtcaagtccgccaacatcctgctcgacgccgggctcacggccaaggtgtccgacttcggcgcgtcgaggctcgcgccggcggccgacgaggccgaggtggcgacgctggtgcaggggacttgcgggtacctcgacccggagtacctgctgacgtgccagctcaccagcaagagcgacgtgtacagcttcgcggtggtgctcctcgagctgctcacggggaggaaggccttctgcccgccgccggacagcgccgccggctcgcaggacgacgacgacgacgacgacgaccggagcctcgcgttcttcttcctcactgcggcgcacaagggacggcaccgggagatcatggacgggtgggtcagggaggaggtcggaggcgaggtgctcgacaacgccgcggagctggtgatgcagtgcctgagcatggccggagaggagaggccgaccatgaaggaggtcgccgacaggctcgccgggatgagaagccgcgcaagcgattcataaggaatggcagtacccagtccaaaaatataacaagctatctatatgaatttaaacagacactaatttatagatttatagttaaaaaatcgcaaaatctaaatcgagatcccttcgttttagtcttatcgcgcgatgctgggagagccatccgatcgctcgcatcattgtggactcgccgttggtagcttgaaaacctctctccttctccgacctctctcctgttgacactttttcatggccaacacaagatcatctaacgatttgcggtgtaatcagcagagtcgccaaaatcgatagatcaaaattggccagtgaaactgatttcaagattaattcactttcgcggaatcacacgactaatttacaagcaaattaacaaagaggataaaatcttacttacgtgacgacgaacgactagtttccgagcaaactagcaaaggataatcttctcgctttcgtggagaagcacgaccgcctttcagcgcaaacggcaaagattaactaaatcctagggttgctagaacttaaccatgaaaacgaaatagaaaagaaccgaaaagtaaaaaacgagaaaaatagtagattgataatttgttcggcgtcccttgccgacgtctgggatgcaaatttataggcggcgcacaccgcatcaaaagtctctcttcgtgggcccatccttccttcctatccaaatcggcactgcacgcatgcaatcaggccgttgatcttgcataatcttctcaacgtatccatctcattcaccgttgtagcctcatccggatttcctaataattcggctgcacctgcatgatccgtatacatatatatctccaaaccatgtgaaattctacagccacccaacaaactacgcacatatttaaccagttcttaggcaaaacattccataaataatgaaagctaaactaaataatttggcctaccaagattaaataatagaagccaaattacaccacaaacacatgccccctgttttcggtataagtagaatgtataacttttctttttaccgaaaacactgtaaaattaaccaacctaaaccacaattgtcatgtcaaaacgatactccacacacagtatcggtcccgagtccatccacagtcgtcctctcaaaacgacactccacacatggtatcggttctaaacccatccacagtcgtcctctcaaaacggtactcaaataagtattcgttctgagacaatcaagcttcctacaatacataagcataataatctttcaaatatttttcatgtagtacaaattttactactaattcggttgtccctaatatccacctaaccgaattagctcaacttatggtagttcttggaccaaaacattttaagaagagtaaatgacactagcggtccttaaacttatcttaaagtttcatccaggtccataaactatctaaactgtagttaacctcgttaaacttgttttattgtatcaatccggtccggagctcggtttgactggtttggtgcatacgtggacagccaggtgtcgcgacgcgtgtgacggccccatcctcgtggcctttttcacccaggaccctccccttcgtcaaatttcacaaaccctagcctcactctgttcgtagcatggatagatagtggcggcggagaggcgacggcggtgcgagcagcagtggccgacagttgagggcggtgcaacgagtcttgatgagccatggccttagcaagctgttctttgtgttcaagtcgtcgtcgtcggaggacctcaatcccacttatcttgtgcccttgatgcggggtgaagcaaatcgtggagcttactgctaacacggaagctaatcaaggccgcatattcttcacatgcccttcacacgaggtaaatcgattgaggttaattttttattgtgggggtattactgtttttgggggtaaatcttctgaaatctttgcttgttctaaaatgtacagaagggtggaagtggttgcgatttttggtattgggaggaagggtatattaaatacctgaataggaaaggcttgattgagcaaaacacttgtgcaaagttgctgaatgaagcaaaccagagggaaatgcagaggggaactgaagaaatcaagctggatgcagatgtgaagaagaagagcacggttcaagagattagaaaagatgcagatgttgaagaatttaagcaggctgatcatatgttgctcattttgagggagatgatggtgatgatgaagctcatgctagttggtggtgtgtgttcagttggtttgatagtgtgttgtttccttgttctatggtttaagtgatgtgtgcccattgtatcagtgaattttgggttgtattcaggctaaaccatactgtgttggtttgcaatgtgcaatgagatgtgaaacttttgaaatggtaatgtcaggtttgcagtctttagtacatttgtcatctgaaattgattatggagatgcaaacaaaatgaaaatatttacagactgacagtagatgcaaacaattttgcatagcagttttgcatagcatatccatcagttttgcatagcagtgagccatcagttttgcatagcatccatcagttgtgcacagtagatgccaaatatttcatgacataaagtctagagtaaatggcagcccaacatccatcagttttgcatagcagtgagccatagtttggcattacaaaagaaggtaaggtaggccattaggttggcagctacaaaagaataaaggtaggccattagtttggcattacaaaaggacaagcatgcttaacttctagcattcagttgcttcttaatctgttcctaatcctaagttatttctttgcaccatcagcacaatccttctacctcttcttagtagctttctttgctggagcaacaactgcagcctttcttttggttgctcttgcttttcctgcctttgttgcagtggtgagaagggttggcctgacagttggagtgttagtcatgacaaattgattgtcaggtaaaggcccaggtgctaggttcatttgagaaacttgagatgactcatcaaacatctgtgataccattgcattaggtatttgtgtcaacagttggtcatgggtaggaaaatgaggttgagattgagcctacaaaacaaaaccatatcatgacagttgcaaatcaaacctctagggtgacagttagtcataacagtttaaaatttgaaattgcattacctctgggctgattggatcagattcctcaacagtagtagtggcagccctctgtggctgttgtgtgggcctcagtccagtttttttgagcttgcagcccctttggttgtggccaggctcattgcaatacttgcaatgcatctcaacaccatgcttggacatttttagcccatgcttcccctggacttcatgtggtgctttcctcctggacttaggtggcctgcccactttcttttcatatactggaggcctcacttctggcccatttgtcttctcccatttagaaatgtcactgcatggtcaaatgttgaacccatatgcttttgaaaatgcctccacactgtaacaggatggcaacactgactcagcactagaagctgtcgcagcggcttctccaatcgtcgcattcccctctacagctctacccccaccacactctcaccctgcggctgcgtgttgctgcggttccgaccagcggcggcggcagctgtctccatccccggcggcggcttctagctccatccccggcgtcgaggtgagcccttcgtttaccccctttccccactccacacccaacctcttgctaccccatgctttttctcccccaaatccgaaaagtttttttttttgtgttttgcatgtggtctactagatgtgaatgtgttctagtaatgacattaattttttttcagaatgtttttaggtataatttatgaggatgcatttatgagatccccctagatgtgaaaggaatttttttattgtctgtgttgcatgtggcctcctagatgtgattgtactctagtagttatattaatttgtcacagaaggataatctatgatgatctattatgagatatatttgataatctataatatatagtttgcactgtgattgttttcatatggtggtttttttgttttaccatttttgtactgttataatctattatgcatttttttattttttcccttttttgtgttcccatccatgcatatacaatgttgtagtacacattaatattatgtttcatagttttccctggtttgtcttacatagtagtatacacatttttttttgttgcagagcacatgttgtatttttgtctcagacttttttgtgttctatgtgttttttttcaaggatgcctgattggtgtagtggttccaacttcaagcatagatggggcggtgtgaggtttaagcgcactatgcttgagttgaaacccgatcaaaagaaattcatcatagataatggctttgagtcttttctatcactaagcaatttcaaggtccatagtcgacttgcagaatggattatgcaaaagatgaacccagagatttgtgagtttaggttccgtggcaaggttatcgtgtttgataagttgttagtacagaagattactgggctaaatgatggcgatctacctgttaagcttagtggtgccaacagtgaagttgtaaaagagatcaggaccctgtaccatccatattttgtcagcaatagacttggtacaggcatgtgcgagaaattgttgctttctctgcatgatgaagagaagttcttgaggactttcattttgtacttgcttgccaccatcttgtgtcctgccaccggcaattatgtgaatctcgactatttgcattctttggttgatgtcaagatgtgtagtcagtatgattggtgcacacatgtggcgagctgtttgatgcgggaaatcaggaaatatcagggattctctactgagcaacgagattccatttttcagattggagagtgcctccccttgcttgttgtaagttttttattgtttcaccctgctatatatatgttttattgttttcattgtcgtgcttgatccaatatttcagtaaaatacatccatttgtctcatttaacatatatgttttgtttcacacaactgctgtcatatgtttcagtaaataatcagtctagcatgctaataacctacgtatatgtttcagcaaaatatatcaattgtttcatattacacataggatctgtttcatgcaatgctaccatatgttccatttcatatttttttggccaatgtgctcctgctaactacctatatcaaatgccattttttagattgcttacatggatcatttgcaaatgccaacaactggactgcatctccgcatcattgactacaacacaccaagattttgtcatgtcactgatgaggactttgagtatgttgctgttgtagaccgttgtaggatgaaccttggctatgtcacatatgggtctcgcccggtatgtttcacaactttgaatgttttagtatatatacattatgtgtttcaccacttattaagactatgtttcatctttttatttcttcagttccatccacggaatgagatcccatatctagcccaagtccatgctgttgttggtgggtctgaggctgagaatgctggggttgcaagggctgaggatgttccaattggtgctgttcaagatggtgtaggcattggagctgctgtcgcccaagatagtgttgctcaagattctgcttcattgaatgaatggatcaggctatctgcctcaagcagccaagggactacggtaaaaattttcttcactttttcactgaccctcttctcttatctacatttttgcctttttttttgtttctaacttgttcctctcttttgtttcattttgtctcagttttcagcaagcttaaaatctagtattgagaagcacagtgccatgtggcaggatgagtttgtttcagcacttgacaacttcaagagggacatgattgatttgcgtgcaaaaagaacatgtgatatgatttctgacataagcaaggtgctagctgacagcaacactgcagtgggcatttccgaggctgtttcaaacccaccaagcactgggttggcagctgaggttgtttcaaacacaccaagcactgagggggtagctgaggccgtttcaaaaccatcaagcattgagggggcagctgaggctacagattttgatggaccaagccaggaagcttctggcggttctgtgccaagcagcccagctattgatgattatatttttgcttcccactctgatatctcaaatctagatgatgcatgtgatgcaccgtcattcagactcttcaatgaatctgatcctgatttcattagtactcaggacttggctgttgagatgctctccttggatgtttcaaatgttcctcaatcggcaatggatggaaggataccttctccatcacctcagtcacctgtttctgcaaggacatcttctgcaactccttcacccactgcaaggacaccttctccagcccccccttcacccattgcaacaaaaacatcaacttcagtagttctctctctagcagcagtaagggcaacatccccagctacatcttcaccgccacgtgctacaagctcgctcctctaggtaaaatcaccacttttttgttccttctctttctctatctctctctctctctcttttcggtgtgggtaaagtaactatgaacaacacccctacccctctctaatgttttttcctctatagtaggtgctggtagtagtggtccaagcacccatgagaagaaaaataggaagaaaagggcacagaaaggtgatagtgatgtagaggcgaagaagttgaagaccgcttctgaaatagatgatgtgtacagaagatctgttgttgattctttgccaaataggtcaaggaaggcagatgccaaagagttgtaagtgttttcacacttttttttgcgcaaaatatgtttcaacctttttattattaatatgtttcagtgtaggttcccctattgtttcatcagtcactatgacatgtctcaataaatgcaaaacatttgtttcagaacagctttatctgaattttttcccaactttttttttgggaaaaacaggacaactccattcttaaggattggagaattccatgtctcacttgagtatttccgtgaagcaatgaaacctagaggagagttgaacaatgaagttatgtcatgttggattgagatgttcaatgcaaactgtagggaagattctaagatgaaatcaagcataaaaaaatttgtttttcccctggcttgacggtaacatgttttaaccaccccctttttattacatctatttttgtttttgtttttttgcttttaattcaattgttccctttttttccttaggataaattgatttgcaatcctgagaagtttgtgtctgaaagctgtgtaaaatggctgaaatcaatcaacaaggagcataaacttcctaaactagatctggtaccagtttcccatccctctgattttttttcatgtttcagttagtctgctgatatgtttcacaacatactaatacaatgtttcagctatttttaacactatgtttcaatgatcatttatttgtttcaattgttagtttcaccatatgctaacatattgtttcattcatagctgttccttgttccagttatcatttaatatatgctactttttttgcctcccaccccatcaagttgttcttcccaattgtacgtgacaagcattgggtgctgacttgcatcaaccatttgcgggaacaaataaattactttgattcaatcaagagggatgatatttctcagtggttcatactctctcaaaacctggtaagatgttcactggaacaccatgtgttccattataattttttaattgtttcattgagttttaagttcttttttttgtcccaatgccgatgtgccgttcaggtcacaaatttcaccaaggttgcagtggatgctaaaattccaatcaaagatatatcaaagtttcagacttgctctcctccacagtatccagtacaaagcaatttatatgttttgtttccaaattgttgtttcatttttcttttttttttgtgcacaagtgtgtcattttaacttatcacttgcttttccatgc

SEQ ID NO: 59510 - DNA, 10445 bp, Oryza sativa
ctctccgagctcaagaacctgacgctgctcaacctgttccggaacaagctgcgtggtgacatccctgatttcgtcggcgacctgcccagcctcgaggtgctgcagctctgggagaacaacttcaccggcggcgtgccgcgccgcctcggccgcaatggccgcctccagctgctcgacctctcgtcgaacaggctcaccggcacgctgccgccggagctctgcgccggtggcaagatgcacacgctcatcgcgcttggcaacttcttgttcggcgccatcccggactcccttggtgaatgcaagtccttgagccgtgttcgtcttggggagaactacttgaacggctcaattccgaagggtctctttgagctgccgaagctgacgcaggttgagctgcaagataacctcctcacaggcaatttcccggccgtgtccggcgctgcggcgcctaatcttggggagatcagcctgtccaacaaccagctcactggtgcgctgccggcatcaattggaaacttttctggtgttcagaagctgcttcttgatcggaattcattctctggtgtcgttccacctgagattgggcgactgcagaaactctccaaggctgaccttagcagcaatgcgcttgagggaggtgtaccaccggagattgggaaatgccggttgctcacttacttggacttgagccggaacaacatctctgggaagatacctccggccatctctggaatgaggatactcaactatctcaacctgtcccggaaccatcttgatggagagatacctccatccattgcaacaatgcagagcttgaccgcggttgacttctcatataacaacttgtctgggcttgtgccaggaactggtcaattcagctacttcaatgccacatcttttgttggtaacccaggcttgtgtggaccgtacctcggaccatgccgccctggtgttgctggcaccgaccatggtggtcatggtcatggcgggctatccaatggtgtcaaactgctcattgtcctaggcttgttggcctgctccattgcatttgctgtcggggcgattctgaaggctcggtcgttgaagaaagccagtgaggcacgtgtgtggaaactcacagcattccagcgcctcgacttcacctgtgatgatgtgcttgactgcttgaaggaagaaaacgttatcggcaaaggtggtgctggaattgtgtacaagggggctatgcctaacggagatcatgttgctgtgaagcgtctcccagctatgggccgtggctcttcacatgatcatggtttttcagcagagatacagacacttgggagaattcggcaccgccatattgtgcgtttgctaggcttctgctcaaacaatgagactaatttgctggtttatgaatacatgcccaatggaagcctgggggagctgctccatggcaagaaaggcgggcaccttcactgggacacccggtacaagatcgccattgaagctgcaaaggggctctgctaccttcaccatgattgttcccctttgatacttcaccgtgatgtcaagtcaaacaatatccttcttgactcagactttgaagcacatgtggctgactttggccttgcaaagttcttgcaggacaccggtgcatctgagtgcatgtctgccattgctggctcttatggatacattgctccaggtaaaacatcatatctcatggtatttcagttcgttctgcagtgtattgatagtattgtatttagttgcaaagtaatatttcctctggtaaaagaaatgtaagagtaattcttgaattgctgtttttagttcctcgtgctccttcatgaattgtgttgcttaataatctgacatgtctttgttcacttcaaatggactgaaccttgttggattgtatttttgtggatgtccagaatatgcatacaccctcaaggtcgatgagaagagtgatgtctacagctttggtgttgtgcttcttgagctggttactggacggaagcctgttggggagtttggagatggcgttgacatcgtccaatgggtgaggatgatgaccgactcaaacaaggaacaagtgatgaaggtcctggacccaaggctctcaacagttccacttcatgaggtcatgcacgtcttctatgtcgctttgctctgcattgaggagcagagcgtgcagcgtccaacaatgcgggaggttgtacagatcctcagcgagcttccaaagctagctcccaggcaaggagaagtgctttcacacgctgtcgatggttttgcatccaatcctccagctccagttccttctgggtctgcagaagcactaactggtgatgcgaaagatcaacagcagcagcaaacaaattcagagtcaactacacctcctgatctcatcagcatatgagtaaccaagtctaaaattgctgtcaaccttttgttgcaaagttcgcaagcttcagtatcggaaacttatctaggtatggatttaggtcttggtaagtttttaggtgttctgtgctgtacatattccagtttggtgggttgtcctgttaccagtttgtttcctttggtgctgcaatgtaggattccgtagcgagtttcggtactttagagccttttatcatccatcttcaatgtaggcaatggctttctatccaatttagaatcaaaatctaagctttactgtggaaccaagtttcctttaaagcacttcctgagttcctggtcctgtgtaaacagttcaagttgggtcctttaaattgagaaacccatactagaatgccatcatggaaaagcacccttgcatggtgaacagatatgcactaaatcaagcaaagtcaaagtattctgctctttttattcttttggagctgaatgaaatcaaagaatcagagtgcttcttcctttgttctcttttgtgatgtgtatagaaagctggcacaagaatggttaacaaatgattacccttttgtggctgctttgcataacatgaagtgcactattgcaacatcagattatgtgggatcagcatatatgggggagagaagaactgtgctaaaaatccacgctttctaatgtccaaaaatttttgttagcctgtttggaacaaatatttactataatctttttgcatattgaaatctggagtagtgaaataaattctgttaggaaaatcgctcaaattccatttaaaaaaaatgcaaaatgaaatctggagattgacattcagagatcaagactctcccgagcatgactgccaagtgctggagatagtgctgcgtgaggtccatcacatgatgatgcctctctgctcccctactacaatcattcagcaccagtgcctaacctttttgaagtttctctcctgttcttgaatctagagacatttttgttgttaatccagagatataatatacctatcgaacaccacgaggtacttatattcgaatattggttcttctaaaccttttcttcttcaaatattggattgtcttgttccgaaatgaaaatcccgaaaaatcctcgcaaaagtcggtttgctcgtgaaggaatggacatggtcggctgtacctatagatttcattgtgcgattggtgataatgctaggaggcgaaaggaccatcagatcagatcagatcagatcagaaggagagtgcgacggtattgaattctgacgctgcactgctgccgtttattcggtgcagttcgatgcgtccaacagaatggtcacatcggcaacgagacgaaacagcaaatgttgcacacagtggcaacgccatgtattcacacatgcacaaatcctctagtaattactcctatcactcaagagtattaatgtattgttgctctcaactatctatttaagcaggtaaattcagtttatctgcatgtaatgtaaagtaaaagttcaggagcttacattctgtcaccagctattttgcaggaggaggtgcttctgtttctctatctgtatctgcaaaacaaaaaaaatagagattgtcagctgcgaggttaaggttgttttgcttcatcatggtaggagagaaaaacaaagaacagaaaggttccccaagaatttggtctcctttggagcaagcagcaatgctgtcattactgcaatcatgcaaagcaaacagttctccaactacagcttttggttttgtggctggctggtcgtcagagacgagcaccaatactgctaatgccagcctcagtgtctcactgatgagttactgttcaccacaccactatttaccacagtaataaacttagagtagtatgcttcagctaataaacaccccactgtgtgttgtacatttgcagagtatgttcatgcatgcaggcatgagccacaagtgtaccggtagtagaaagcatcaactcgagattcctctcatctggatccattgctggagcattttggacaagaatacaaggtcatgcaggatgcagcaaaggacttggctagctagctagcactgtagcctcatgtgcctaatgatccagccatttgtactgttttgaacaggcaaagtacacttagattctgaaactaagggaggtcactccaaatgatgctctgctaatggcactgaatccactgatcaattcccataatgtgaggcagaagcaagcctgtaattggggtggtggtccattgatgaacagagtacagagagagagagagagagagagagagagagaaagagagcttgctactgctcacatggtaggggactgggactttgagctgctgccattcttctttctctgaagaagatgtgcacttggccgaaacaagggcctacattggcactgctctagagaacagtgacagggcacgcaggagggaccatttgatgatcaatcgctcacgcatgttcttttgtttttcctttctttttttttgtttgattttcgtttcttgtctcgatcagtctctctcttctgttatgcagatgttggatcggaataataaggaacagttttgtgttcgcgtcgtgttaattgcaaggaaaatgattgctcatcatctgtggattcatggagagacaccataaaccctaggagtttcttggattcagaagtgaaaactcaaaaaggaaaaaagaaaaacgcggcaacgaaaaggacaggaaaggagaaagaaatcgaggggataatcaggagagagaaatttaccaagggaagcgcttggttttacccggattcccgagaattttcatggagagagcggcccagctccccacctccgcctccggcgccggcgccggatcgctcgccgccggcgaacctgctcgacggcagcggagagaaaaggcgagcagcagcgatcaccgttggatacaaaccgtgcggcccagatctaactgaaaaggatgtgctggctaatttactaataggaccctctattatgttgtatttccgtaaaatgcccgcttcagtttttaaaactagggtatacctcgcgcagtgataaccgcgaaattgtagggtgactgtaaccctattcaaaacggttcggtaaatcttggttggcactcgattttctcatgtcatcttgctgatctgcaacaacaggggcactgattgcttaaaatgccagcgaattttattttcccatggagaagttggtagagaagaaatgcagaggcatagttgggacacaaatgcgagttaatctaagaccggacacaagtgggacagggagaatcctatggaaatgatgatcacatcgatcagagattcagaggcgcactcacgcaccaccaaacccaacaactccctctattcacagaggacagaaaagggaaatgcagggaaaagctatagagggagagaagaatcctgcagcattttgcgtcagaaatgaagtcaactcatgctagttctccaaaaaggaaaacagtcagctcatgttttcttctcctccatcgatgtactctttgattggcccatctgatgttctgcaaaaacttcctcagaggcattctccttctgataagatactcacatgatgctcagctcaggtaacctgtctcaagcaaatcctgatactgaaattcagaaaggttatactgctctgttccgactgtttgtccaaaacctgataagagatggtctagaatttatgtgaaccttcatcagagtttggactctgtctccatgcggggcagaatcccttaatcaaataacttagacataggccccaattatatgaggccttgtgcaagcaacgcaggcacacaatcggcagcagtaaatgcaagtcaaactgttggaagcctggagcagagcaaaacaatgtgatctgctgaagagatcatcaaatccagattaggccacgacaccatgaaaataagcatgcaaaattgttcacaacaggatgttgtctagtataggatttttattccatgatcaggaaaaaaaggtttagtgcaactaaagggtaattagcatttcacggtcgttttacagaagtgattttacatgtatatgagcccggcgaaaattttacatgtatatgagcactatatataggacactctttacatgtatgcataactttgtcccttcatacacctcacttgttcatgaaatcgatgcccttctgaatgctctccatcagctctttctttgccatctccaagccagctctgtcgtgtcaaataagttaaaacacacattaagcacaccaattatttttggatggtatttgcaggcaactgcatttgaaagagaatatttagatacaactaatgtacctctcaaaatcattcaacggccccagagggagaaccttccccggctccagcacgacctaacctcacttttgttgcaaagaacggcaactcggtcacctagttgaaagaaaatgagaataatcataagatggtgttatcggttgataggaaggatgaatgtttggatggtgtaagcataccgcagatgcaacatatgaacattccacaacgccagcatcaccacgcattgctcgcaagcatgcatcaccaaattttgctgcagcaaaagcctgagatggttttctgtcagtatgcatttataactcggatactattcacaaagaataagcagccatataacctaccattgacaaagttgcagagcctgctcctgcctttgcctgaatcacaaacaaaaggaacattatatgtatgaccaaataattagaaacaccaaaactgaaaaaaagaatccccatagtttcagacatgtaatgacgtgtaactaaagtaatatgcaaataccgctatctactgttatcaacagctttcttcagtctccgttaagggcatccgttacatttgtagtgtaggagctgaaattttcttcctaaaaactcaaaaacgtttgctcatcaacacctagtaacttggcctactaaggctatggggaacgaaattatagttgaggcaatatttgacattaaataaatcacaaattcatagttatatttttttttctttctggaacctagacagagctagaaggtttgttaattgaaatcagacattttgaatcaacaggactagaacttggcatatagacattgcttctgaatataaataagaaatttgggctagattagacaactccacacaaataactacattatggtagctttatgcagatttttgtgtaaataagatgtgcacatatgcatgtactgtttgtagaaaatcaaacaaagagaatagttggggcaaaattaatcacgtgcatcaaggctaatttcagcacttcgaatatgcatgcattgtacctcaacaacttctgtgccaccattctgtatgcgtttagtcaaatagctgatttcatctggggtaaatgagcatggggggtggacctgcagagagacaggtcttggattagcaagttattatatttgcagaagttgaaatgcggataattagtgtttacatgcgctaatattgatggaataatacctgggagaggaggggtaatatagtcactccagcatgcccaccaacaactggaacattgacatcttttgggtcaattccaagtacttcagcctataagcagtagaaaaagaaaaattttatggtcaaagagcagtacacagtatttacatgtatcttaatgttatctaagagatgatatgaaaacaatttgttagaatgcataccacaaaggtgtttgcccttgctacatccagtgttgtaactccaaggagacgtttgggatcataagttccagctttcttgaaaacctctgctgcaatggggacggttgagttcactgggttgctgatcaagttcacaattgcatttggacagcacttggcaacgccttcacaaagtgagcgaacaatcccagcgtttttgttgaacaaatcatcccttgtcattcctggtttccttgggagaccagcagggataatgacaagatccattcctgtaagtgctgcctcaagctggttgggcccaaggaaaccacggacctacaagggaatttgggtacagttatttgttacatcagtatctatgcacagataaataactaatcagtaatccattcgataaataactaatcagtaatccattcgaactatctgaaaatagtggagtgcaattgtaagttgcaagtaaaaaattatcatttttttcacttctatcctttttagcttgcaggcaaatcttttctctttttttcctttttttataaatgaattaaaaatttcaataacaagaggtttacctacagtaccatttactgttgataatgattaaactgaaaaggaactaacataaggtggctttctttttcaacacaagataagatgttatcatagttttctatatatattttttggacttcactggaacaatagaaaaagcgagatctcattgttggcaagtcgtttggttaactacaaggcttgtttggcaacttgagggaaggggattgggagtttacacgagggaattgatggtgagattaagatgtgaatttgatttttcatcccagtctcttgtttggtagaggtggtggaaattgatagggagtttagttggagattagatcattaatgaaaacggatggctgagatttgtttaggcgaagtaaaggaggaattccctcccaattacctgcccctaaccaggtattgaaaaggagggagttcattcctcaattccccatcctcatcccaccaaaattcccatgtcccccaaccaaacaaaacagttaatagcctcatccctttaaactcccaatccctcctagaaactccctccaaccaaacagactgcaagggaaagaaactgaaaagtgatttcaggcatcaatcatcactgccgatgtgcagaccaggtgctagtacaatactaccacaataagctagcagtcgaacgggatggaatgagtaggttaccacggcggtggtgtccatgtggctgacatcggcggtgacaccgggcgtgttgacgacatcatagaggtggagcacagagacgagcgggttcaacttcatgagcagcgacagcggctgcccgatccctcccgccgcgcccagcacggccaccttgaaccccggcgcgccgcccttggccctgcatggcgccggcctcaccccctcctccatctgcacacacacacgcacagattggtcatcccctcacatcacgcaacgagagagcgagagatgaactgtttcgcggcgcacctgggggcgcggcgacgggctgaggtgggcggcgacgcgggcgatgcggtgggaggcggagtcgggctgcatggctggctggctggttggttgcggcggcggcggcggaggaggagagcagttggcgcgcgaggggggaggggggttttgatgggggagggggaaggcgttgcgttatcccgcgggggtgtggctcgaaggggtcgcggggatcgggaggcgggaaggcgagctcagcctcggcggctagctagctctcctcccatctccccgggaagctcatctcatctcgttgcgttctccgccactgcttctctctctctctctctctctcgtcgacgtccacgtcgccgtcgccgtcgttcctccggctgcggactgcggtgcgtcgccaccgtgttcggtttagcccattgggccgaaaagacgaagttgggccggaacgggattgtggcccacgtgcaggccatatttattgggccagaacgggattgtggatttctaactgaggtccaacttgtcaacgaatccgattttcgtctctcaacgtggcactgacgtgacgcttatgtggcaattcaattcgaaaaaataataaaaccagtgggacccacatgtcagtctcacatagaaaataataaaaaatgtgggacccacgtgggccccgcatgtcagtccaactcaccctcttctttttcctcctctctctccccatctcccctctcttcatctctcctct

SEQ ID NO: 59511 - DNA, 3249 bp, Oryza sativa
attgctaggtgcaaattgttctgctagctcaacacaacgagatgcaatttctgtcttgtaatggtgatcagtgatgttaatcatatactcaatcattcgatcaacaatcacttcaacatttgttgattttgtcatcttgtaaagaagctcgaaggtcttgcgtttcaaagtgtcatcaggatcctgttcaaaagaaaccgcactgagtgagaaacaagaagggctagtgtgaaaagtataacacatccaactaaagatgatgacacagtgacatgcatctactgaggtagcaaattaaaaccacaaaactgatgccataagaacagaacaagccagcaactaggtcagcgatattgtatcaaacaacacaatataatcttctgaaaattataagtgcttcttcagctaacataattttggtctttctgcagggaaacgtgaaatgaattacaaatcagcattcttcgtaaaattaatttctgcaactatagcatgatttcagtaaaaaagtcttagcttcattctcttgcagcatgcaacaggaatatacgcatggaagcaacatactaaaaacccaatattttccatgaacacgcaagagctgaattttgctatattcctcacctctaagcaatcaataacagccagctggtgctcttctgcgatatctggatttattttaattaaccggccaagagcatcaatgcccatgtacttaagattatggctatcactctgcaaacataaaagagttaatgaagcaggttaatttcctatggacacaacatcatgaaaatcacttatgtctcacataagaactttgtgtgcaccttcagaaactttgatgttgtttcagctgcagcatcaagcatcttagcgttcgggaatatggatgaaatacagcatatgcactcatacaatattgcattgccaatgttgcttgcagtgtcacccttcctgaatatgtcacccaagaccatgtacatatttccacttgcctgcttatcaccgctacccagcaccgcaagtattttcaatagtttaatctgcaaataagaacagtaaaatctaatgacataagatggtgccaattgaagactccaaacataggaagttgaagctcaatagagttcacatacctgaataaatggtgcaggcatttggtggtaatcataggaagttggaagcctcctctctgcaacttgtttgaggatgttaacaaaactaacaaccaaatccttgtacgaatttggatcttccaaaatcaggtcatagagggggcataaagttgcacccatgaccccaggatcattatcacagagcctctgcaaaataatagcgatcaacactaagcatctctctgagaaacaaatatgtgcttcactaacagttgggaaaccccacaggctacagttgctggaaatcccaattgaggctcaaggtagatacgaagacacaatttaagacaataaacactggtattctaacatggaaacacaaacaaatagtaaacaaatttgcatctttggtgttaatcgaatccataactcttgtagacagaacctaagactagctaacttatcttaaattggcatgaacaaaacaaagcaaaagtcacatttctaggttaaataagtggctaaaaatgtaattggagaaaacagctagctgcatcatatgcaattacagacatatatacaaattaaacacagaaatgtgaaccatagtaggactgatagaatgattgtagccgagtgtgcatttcagaattgagacaatatatgactgaggacgacttattctacgttcatttcagttgggaaacgaaatgggagggatttagtttggaccttgcggaagttggagacaaggtgagagacggatgagggggatcgctggtagaatcggtggagcgccatgacggccttcttccgcacggcctccttgggatgcgcgagcagctcgacgacctggggcagcacggccgggatggcctcctccccgatgaggcggcaggcggcggtgagcgcggcgcagacgacgaggtagttgtcggacctgaggtccttctgtatggtgttgacgacgaggatgacgaggtcgtggcgctcgtcgaggaagagggagacggcgaggtagcccgtgcgcttgagcgggagggactcgtcgtgggtcatcttgacggcgtggatgtggccgaaggaggcgtcgtggccgagcatctcggcgtagacgaggcggaggaggagctccttcatcttccggcggggcacgtcggggtcggcgaggcggcgcttgaggtgatccagctcccgcgagatgatccggtcctcctccgccttggaccgcgcctcgccgatggacttgacaaggtcgaggaactccttcgactgcccccaccctccctgcgaccccatcgccagctcccgcccgatcgtccgcagctgctccattgcgcccctcttcgcccgcccgttgcccgggggcgtcccccgccggtttgctcggggaggccgaggtgatgtggggccgatccgccgccggcgacggcgacggcgagtgggttggtggcggcgcggcgaggcgaggcggtggagatctggatccggcgaggcgaggcgaggcaaggtgggtttcgggctttcggtgtagggaaggaagggggagatcgggatcgggattagtgaggaggaggaggtctagtctagttctcgtttttctttttttttccttttttttctctcgttttactacctactccctctataaagaaaatctcatttctgagtatgaatgtgaatgtagcgtatattcacatctatagttagaaatggggttttttaacggataaaatactctaaaagtaatcattttagagttttgtgaaagtaaaatataattacatttagagtaaataaagtgagaataattatatttggatctgataaaataacagtactctatttttttttattgatgtgtcgaatggataaaaaataaatttattttaaaacggagggagcaccagttgttttgctttgcaagggaggtcttgtactgtagtgtaatcttcacccttccataggtgtccttttgtttgatggagaattttgtaactttgttccagagtttttggtttcatgttaaatttgtgcgtttcgcattgcagtttgggttttatcttttttttaaggaaggcagcaatgcgtaataaagtttaagtaaaagtgttaaaatgcatttcggata

SEQ ID NO: 59512 - DNA, 60580 bp, Oryza sativa
ttttattaaactatttagactaaaatattagcaaggtttaccactgttgaattgtcagttaaaaagtccattgtgttgcattgccgtttctgaaaaaatagagagaatttacagtaaaaaccaacatgatgtgtgtgctattttagttgttgtgtagtgttcaataaatagaaatagcattttgaacttgaaacaattagactaaccttagaagcagtactatacttgtttaggcttggtctaacaagcttgcgggtaaggttctctttgttctgcaatacaatcattataactagtaaatcatgtgtgttatagtttcaaagagcttatatctgtagacatggtgacttaaagtgatgaaaaaataaccttgtgtgtacttgtaactttgtgtgcattcaacatatagttgtcctggttgtcaggtttattgttctacagtggaaggtaacaaataaattttacaaatctatatatatatttatatatcgaaattaagctactttcaaacacttattgactatggcattgagtttgaaaggataaagagagaacttaatcaacttaccttgtatgcactagaaatactcttccctggttgcataagctcattctggtccaaatttcctttgcgctgcaatggaataggtcataaaattggcacaaactataatgttccaattatttgtttactctgacatcatgcactccaattaatgaaaaagtgaaaattaaccttgtttgcacaggaagtaatcttcctttgcttcccactgtgattctggcccaaagactgtgtattctagagtaaaagaaggcatatgattataatgaatgctatgtaaataatagtgaatatatatatatataataatattttaaatgcaaaggcaaggaccttgtaaacagtagaatgcttagttggtggttgcaaattctcatcgtgcacatggctttgtgtattctatagtaaaagagagaaaataaatgctattcccaagtaaaaaaacacagctattcccagttataagatggtgctatatcacattaccatcaaactgttgtcctgctgatccataatgtttccctcctcaaacatacaaatttcttgcgaggggttgtcaccatacactctctgtccataacagaaaatgaacagagatctataccacagtttatgagataatgcagaaaatgttatgatatttcttccataaagatacatagcctcctttttgaattaggtatgtcatcacaaatagcttctttgtttgtagacgctccatctaaacctccctgtaacttcaattaggtaagttagatgcattcattgggtcacacacaagctcatataatttttttaagactcaactcccttaaattcacctgattcttttgtgccttttccaacttggttgccttctcttttaattgtaaaagtttagcatcattattctcaacatggcgttctaacttttccatctgcagtctaatagccattacatcttcactggagttatcctccactgtagtaagatttatattctgcaaacgtcgggaagttggcacatcaagcacttgtttaggctttggaactagtccaagaccatgcacacgcccaggcttgtcatctcctagtatttggttcaatgcatctcctttccaagcagtctttcctttactagcatccgctaaagctggttgttcagctataagtctcttcaaattatcctaaacatatgaaaaattaatacgaataaaacaacatatgagaataactgaaaaatatctatggttgagtgttaatagtataccacatgcccatttatattcttgtcacttttgcgcttgtgtgtgtggacataaacaacagctctatgtgggttcttctttgcaggatctttttgtctctatggaacacatgaccaaatcagtaaagtcctaacagtagctatacatgcttgaaatggaaatagatgaatactattcaagacatgttttaccatctcttctcttgtgcgagcaaaactctttgtccctgctgtgtgaattgccttcttcttttggcagtttttcttattctgctcacttattctctgttatggtctcgtagagttagcaatcaaaaaagaatattgcattgttttgtttagtacagagttctaatttgtaagaccattacagaaatgaatatggtacatgtaccttcgatttctcgttcatccaatgattgacaagagcaatccactggtcagaaagcacaccttctgggacattgttgcaattagcttccttagtctcattcacatcaaaatacaaatcttttagttttgctttatattgccgccatctttctccaattttttttaatatgaactcttccatccgaggagcataaaggaatctcatctacatatagcaacacagaaactcatatggccatatggggatatgcataacataatacaagaagttagcaaaaatgttgatctgaaaaggaattacctttacttgcttaagtatgtcctttttaacttttagttcatttgtatttttctctctctttcctattacatatctccagtctgtgtagcctaagctacacagactaccattcctagctatcattccaagaaatttacccaaaattccagcttcttcccctaccgcctgattgagatcattgcattgaaccacaattctaagccctttcggaaggttccaaacatctttcagttttgtcttgccacgtgtttcaggtgctccattttcaactgttcggtgttaaattgcaaagacaaaagtgatccttagtaatcagggatacgagtaataatgtcattatttcttaccattaggactgttaaacttagcagttacctcgaacattaatatcaacatcagtatcttcattgccttcatcatcaatatcaacatcgtcattagtgtcttcattaccttctccatcattgatatcaaaatcgtcatcaatgtcttcattgccttctccagaatcatgacatacagtttcttgttcagatggtgtggcaagctgtggaagggtattttcttcttcaatctgttcctctgacaaatattcctcattgctctgaacaatacgccttcttctactccttgccatatctcttgcacccaaaaaaaacctatctgtcatttatggcgtcgaaagtatatcattctcattttagaagtaggactgtgctgtacatagtttcagaaagaataatttcagaattgattataccctgagccattttggatttgtttttgaagaacaacagagtactgctgtcccaaaagtaatgctataatatggatctgtttgtcatactcactaattcatttgtccattttataggccaacaatttgaaacaagtaatgggtagaaataacaaaatttaattggctgcaaggtaaaactagatcacatattgtattgcttacagttgtgtgaagcctagccgtacgtacaccaggctccttcagctatggacggtcagtgcatctgactccaaacctgaaaatacaacacatcaaattggtaagtattgtagtactggaagggaattagcctccattgcaatttggcgactcagagaggtagtaagatgtgcagagggaggcagagattccggggcttggaaacattgccgccagccgcgcggcgtggagcagagcgaagtggacagccggtgtcgggaggtataacccgcatcaattgcagtgccccggtcacccggcacatcggctgggggcgtctctggcccgccgcatgccctacgtcatccatggggcatgggggtcgcctgctcgtggctgttaatcggcaggaaggtgcgacagcagcgatggctggtacagcagccggcggagcggagcggtggaagatctaggagcgcctgcttggggctgtgggtcagtaaagcgcccggcatcttacctacagatcaacaccgatgaagacgaggaggagaaccgtagaacgacgggagagttcataggagaaaggaatcccacaacaggaaagagatttactcagagagtcaggatagaggaaagagatttttaggggcagttggcttgtttttctcgatggggaaggtgggggcaaaaaaaaaagttggcggcaaaaaaaagaaaactgagaaaaaaattgcgggagcaaaaaaaaaggagggaaagagtggagggagaagaaaataattttcggagaggcacaaattgctaaattcagatcgatttggggttgatttgtccgtcaaactagttatttaaattatattagcacgataaaaaaatcacgtgttatttcattgtcgatcttgaccggacagaccgcatgaaaaattatatataattaaataacagtaatttaattttttttagcacaaccaaaaaacaagtgttttttcgttgtcggcccggtctggacagactggatgaaatttggacgtaacatattttggtcttaaaatagtacttatttaatttatctaagcacgaccgaaaagactggacgtaaaatttgtgttaaaatagtagttagttaatttatcatagaacgacaaaaaaaacacgtgttttttcattgttgacccggtccgaacaaacgggatgaaattcggacataacatatttttgtcttaaaatagtagttatttagtttatattagaacaaccgaaaagacacgtgtttttccattgtcgacctggtccggatagactgcatgaaaaagtggcataatatattttaggtcttaaaatatagttaattaaaaatgttagcacgacaaaaaaatcatgtgttatttcattgtcgacccggtccggacagaccgcatggaaaagagatgcaatatatttttggtcttaaaatatagttatttaaaaaatgttagcacgaccaaaaaatcacgtgttatttcattgccgacccgttccggacagaccacatgaaaaatatatataattaaataacagtgatttaattttttaggacaacaaaaaaccacgtgttttttaattgtcgacacgatccggacagaccgtatgaaatctgtacgtaaaatatttttttgtcttaaaatagtagttagttaatttatcatagcacaacaaaaacacgtgttttttcgttgtcgacccggtccggacagaccggatgaaatccggatattctgaaaataagtttttgaatggtttatttttaaaatttaaaaataaaaaagttcaaaaaattaaaaaatttctggggcaacagaattttttttcccgttcaaggagaggaaaaagtttttaggaattgccactagagaagaaatgaaaaaattatgcatttgctagttctcgaactggagttgtcaatacagtagaagaagctaagtaccactaggctatgtcccccttatttattttttcacgttagctgcaattgagaatgtaaatagacttctccaggtatttatataagatggaaatttaaattctgttagcacgaccgaaaaggcacgtgctatttcgttgtcgaccagtctggacagaccgtatgaaattgagatgtaaaatatttttggtcataaaataatagttatttaaattatgtttgcaagactgataaaccacttgttttttcttgtcgacacggtctggacaagccgtataaaattaggatgtaaaatattttttctttaaataattgttatttaatttatgttagcacgaccaaaaaaaccacatgttttttcgttgtcgtctcggtccatactgatcgcatgatcaaatccataacatattttgtcctaaaataatagttgctgtggccaaaaatatttatattgaaaaaataagttttcgatcggtttaattttaaaattaaaaataaaaagttcaaaaaattctcgttatctggccagctaagaaggatagggaaaaaaaagaaatggaaaaaatgcatttgttaggatttgaactacagtcttcaatacggctgaagaagccatgtaccaccaggccatgtccacttcatgttggagttgtccgttcgacttacttattcacattaggtgccattgacaacataaataattttctccaggtatttatatagttggaaatggaataacataacacaatagatgcaaagattataaacgcccattcctttttctcatcatataaacaatatgatatcctggatatttaaaaataagatctaaccaccaattctgtatataactaatgtagaacattattacaggacttatgtatgcaaataaaaagttgaatcgatctggctcaatcacttagacaatccaaggaaatatacgaatgacattttcatccagaaaagctattgtggtgaagaagccttcatcgcagtaaatctccatccaaaattactgccataaaaataaagtgctccccaagtgaagatataaacaatataaggaaatcattgataatggatagatagatagtgaaaaaccttcataacctcacctttaattagttaccatgttatcgacagttgttccttctatatctcttcgaatccatgtctgaccatcatgtgcactgtcaaatagctccccaagattactgacatggtatggttcgcattccacatcattccattcttcgcccagttcaaatacatctctgggtttcatcttccttacaatagaccaccctggatttaaatggtcttcaatgtaaaacacttggtcgacttgatttgcaaatacaaagggctcatgctcaatcttttcaccggtatgaattttatttgagaaattcacaagtgtgcagccaaacttatctattttcactccttttcctttagttacatcgacccattcacatttaaacaacacaactgagaaatttccatagtagtctaactcaattatatcaagtatccttccgtaatacatgatatcaccaaggacagggttagtatcactggcggacgtgtagctcgatgtttttgcagtcacaacaactccactgttttgagtcaccctgtcataacgctttgatctgaacctatacccacgggtattgaatgctctatgtcgttttgctacctcaattggtccacgtgccaaccatctaatatcctcgtcaatactatcgatacctctttgattctccaactgcaagatctacaccaaaccaaaagatgtattagttgtactcatatttgaaaaagagaaacctaaattttgagacttacatgatctctgaaccaatcagggaattgttcattttgcatgttctcaatgttttttggagttagccttttgcgtttcttcctttgtaaatcagcagcatgttctctgcaaaacaaataaacataaatttgaagcaaaacacttacaacacataaaaaaaaaggctatgtgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtatgtattgatgtgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataattttctctcgaaccagattactccaaagccgagtgcttcaatcatctttgtcatggtctcccgagtacttttaccaaatctgaagactgtggaggctgtggagggctggaaaataaagtcaggtgcaccgactagatgcacctaataggtgtagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatctgagtaaataaactcataaaggatttaccaaccgcctagaaaatgaccacaatatataatcagcctaagccataatattggtcaataaaaatgcacacttacgtggcgaaaagcaatgatattgtacctaatcaattgcttaaaaacccaaacagcaccttgacttatatataaaaaagtcagcgggacagttatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtgacatgctcccgagtaataaatcttccgagtaatatagaccaagcgtagctcatatgaatagcttctgatctgagtggttatcccttatgggatactccaaaatagatgtaacaattgaatcccgactggcgcaagtattcagttgataacccttacggggaataataaataatccagtctttgagcatataaaatagacccatgatcatgaattcatgttgcatgtatccggagcaagtccaaattgaagatataatacttgtatttgagctaataagcccctgaacacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacgacaaacgcaaccgacatgatgaagatgacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttataactgttgtagatgcttcacttggaggagagttgatgttgttgcccaactcgtctaaaccgaaatatttgaagttgttgaagtagaatgtctgctccgaagcaaagatgaagataatgactcctggagttgactcgttggttgatgaattaatttcttcagcttgacataaaatttgtcaaattttgagccttgtatttgtgtagcccccgactctttgattagttgggaaacaactgaacatagagtcgagaattatagcttcttgtcgtcgagtagtcattgcttgattgaagatatgtgttgaagatgtccaagtagaaatccggtagtgaagacgcgcagttgtgaagataaaagcaccagtcggcggcggcataatcagtcggcgacggaagatgatgatgtccatcagtagtggtagctgtataaaccagatgtagaggcgaggacactagtcagcagcagacgagatgaccagcgatgaagatggtaaggccaatcaacactggcagaatcatgcagccatggaagtgaagaaaccagtcggcagccatggcaaacgtaggcagcttgtgttgaagatattgatgcctattagtagtgacagcgatgtagccagccgtgaagaagatagcatcagttggcgttataacaggccagctgtgcaggcggtgacaccagtcagcggcggatgcggcggccggtcggtgaagacgtagacgcccaacaacggcagcataataggccagccgtgcaggcggaaacaccagtcggcggcggtcgaggcggccggtcggtgaagacgtagacgcccaacaacggcggcataaaggccagccgtgcaggcggaagcaccagtcggcggcggacgaggcggccggtcggtgaagacatagacgcccaacaacggcagcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtaaagacgtagacgcccaacaacggcggcataaaggccagccgtgcaggcgaggacaccagtcggcggcgacgaaggcaagccggtcggtgaagacgtagacgcccaacaacggcagcataataggccagccgtgcaggcggaaacaccagtcggcggcggcgaaggcaagccggtcggtgaagacgtaggcgcctaacaacggcggcataataggccagccgtgcaggcggaaacaccagtcggcggcggccgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcatagcccacaagcatcgggagtcggcctaggcatttcccaaacatgcatatgagtgatatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattagcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaaaaataaaataaatgatgacttagctttgtaatattccccttggagatggcagaagtggccaatgtgggaacaaagtcgtccatcaataacaatgaagacaccagtcggcggcgacgaaggcggtcgacggtgaaagcgaaaatgcccactaatggcggcataataggtcagccgtgcaggcggaggcaccactcggcggcgacggaggcaggccggtggtgaagtcgtagacgcccaacagcggcggcataataggccagccgtgtagacggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggcaggccggcggtgaagtcgtagacgcccaacagcggcggcataacaggccagccgtgcagacggaaacacaagtcggcaagagtagtgccgcggcgttacatgcaaaaagcagaaaataccaagagagattaatctgacatttagagatcaatctaataaacaacaataagttgaaaaggaaaaaaacccggtgaagtcggagattaaaaggaaaaaactcgccgagattgatctcttcgactgactccgagacggagcggaggaggcggaggtcgcagtcgcgggcggcgttggtgtccatcagcacgacgcaggacggcaggaaggcatcggcgtggctgcagccgtctcctatgcatccgattagatcggttttggcatgcttcgtgtttgtagatccatcttgcaacaccatggcatcctcgttgggtagattggaccagtaggcttggtggtggacgaggacgaccatcaaatccgtcgaactgtcgttgccccgtcgttgccgtcgtgctgatgcgaacaagatcaggcagagaatagcagcgacgattcgtcttgttgaagtcgtcggcggcgaggaatcaaggagctcccaaagcgaagacgaagccggcgactcataaagttgattccatcgcactcgtcgtcaggaaactcggcgtttacccctacctggcgcgccaactgtcgaaacatgaattcggcaataataaaagggggtagcgcacgagacctaaaagtggatggatgtagagacaaaggatttagacaggttcaggccctctcaatgagaggtaataccctactcctgtttggggatttgaatccgccgggtgtgtattgatctgacgatcaggttgtctcatctgccccctagagggcctcctgcccaccttatataggatggggggtaggattacaagatagaaaccttaaccaatacggtatcggtttcctaaatctactttacaatattatcaaaccaggactttaggccgttccgtaatatacaaggaaacgtaacacccaagtcatgatctgttacatattacataaatataagttatcccctataactagtcggataaccatgccgtatgggtatggggtacccataatatccacactatgttaggacaatacgtacttcagatatggcactacagcatcacagttgtatagcacatatctatgtgcttgcaatttctctctatcagttaaggagtacgccgatggttttcccaatggttttcctactggaggaaacaaagtggattcttgcctactcatgggagtctcaaattgatctggtttgtcattattccttgatggtatgttatgcttggtagggaaaccttccaagtatcgtgaacaaaatgccatgcactcatctgccaaatatgattctgcaattgaaccttctggacgcgctttgttgcgaacatacgacttcaatttacccaggtacctgtaatatacatacaaggcacaaaactaataagttagtattgtatcatatgacatatgagaaatattataaattgtatgctaatatatttttagtacctttcaataaagtacatccatcgatagcaaactggcccagcaatcttacattcagtagctaaatggacgactaagtgaaccataacagtgaagaatccaggaggaaatatcatttccattctgcacaatgtgattttaattgcttcttccaaacggtcaagctcatcaacatggagaacttttgaacatattcctcgaaagtaagcagataagtcaaacaagacagatgtgatttcatcgggaagaatacccctcaaagcaattggcatcaattgttgcattagaacatggcaatcatgtgttttgagcccatgaatttttccttcagcagagttcacacatctagatatgtttgaagaatagccatcaggaacttttatatccctaagaactttacagaacaattgcttctcacttttggacatagtaaagctggcaggtggtaagtagaacttgcttgaagttctttgttgtggatggagctcccctctaatgttcatttccttgagatcaagacgagcttggagattatcctttgactttccttctaaatttagaagtgtaccataaatattatcgcacacatttttttctatgtgcatcacatcaagattatgccgaagaagattgccatcccaataaggtagtgtgaataaactacttactgccttataagtttttgacttcttaaaatcaccgatagcatttatttcatccaataccggacgcccatagtaagtcataggctctgtactaatctctgtggttccatcaaaagaatttctatcaaaacgaaattcatgattaggtggcaaaaatcgacgatgacccataaaacaagatttcttcccatgtgccaaacgtttggaccatacatttggaccacaaggcgggcatgcaaattctccatgcaccatatgtgaagcaagcattcctaaagctggcaagtcatttatagtccacagtacagctgccctcaaattaaaagtttcatttctagatgcatcatatgtggaaatgccattgacaaatatgtctcttaaatcttctagaagcggctggaggaaaacatgaatgttatctccaggacttttgggcccaggaattattaatggcattagaagattaggttccttcatgcagagccatggtggaagattatatattactaaaacaactggccagcaactataggtagagctcaacataccatatgggttaaacccatctgtagctaacccaaatcgtatattacgagaatcagatgcaaattgcttgaaccttttatcaaagttcttccatgccggagaatcagctggatgtcgaagcacaccatcctctactaagcgctcttcatcatgccaacgtgggagcgatgctgtttctctacacatgaacaatcttttcagcctctcctttattggaaaatatcgtaagactttgcttggcgttgctttctttctttctttcttcgttaacttggtttctggttttttatctttccatctagaagccttacaagttgaacaaaaatcatcattaaccttctctttccaaaacagctgacagttattgggacatgcatgaatttgttgataatctagaccaaattttgaaaccaccttcttagcctcataaaagttttttggcaattcttttccatttggaattgccatgtgaagaatatcaagtagatctccaaatgatttatcactccatttgttcatggatttcatattgaacaaaagcactagcagagataagtgtgatagttcacttccatcccataaaggcttctctgaatctttcaccaacttataaaatgcttgagcttctaaatttggtccatcagtgtgtgtacatggcgaatctgcagaatcactcataggcatgtcgtcatacacagtcctaagtgcatcattaattaattcgtgcatgttagcacgcatgtcttcattgtgaggctgtggttgttggttcctaatttgctcctctgaagactcaccatgaaaatcccattggtcataactctgaagcattccattgcacaccaaatgatcatagacatcattttttgaaagtagcatagtatgtacgcatgtttcacatggacaataaatcaataaatctttgtatcctctaacttaaatcaataaatctttgtatcctctaacttatctttatatacaaattcaagaaatccatctactccagctaagtactcaacagaacctctagggtagcgcaaaagaatcttgatggtttctaaatccatttcgacctatataaaaaaaattgatatttcaggttcttgtagataataacaatgacaaggaattgtctcttatgatcatgatgtagcaaaaatagggcaattagaaaagtaccagtataaaatcagtgtcagctaattttgtcacaacctaatagacctcctttatacactgaaacaaaagcttttactctgcaaaaatagagaagagctaaatcaatttacagaaaaaacatccagcaatctaatgtcaaagctgtcatctccaagttaaattccttactataaattacctctagttaatctacagatgatgactccagaagcacatgtgtttaaaacctatgttccaaatatccgttcggatgaacaagaaaaatctgcaggtgttattaaactcaatcagatagactcatgatgcaacaaacctgaataataaaaaaaaaagctgacattgacctggatctgacactgacctggatttggggccaaatggggaatcaacctatgagaagtggctaagaaaaggaccgtgcttgccgttgacccgctgtcgtcggcctcggcccgtcgccggcctgccgcggccgatcccctcgcgggctcgccgccgccgctgctgagaacgcgccgctggccgccgatgcgcgctgccgccgccgccgtcggtgtgcgccgtggcagtgatgtgcgagagcgtgagaagaaaatgagatgcagtgtgggaacaggatggggcggcgctctcgtgcgtgttgggtgaggtgagagacacgagaggagaggagagaaggtgggagattaaggttgcctgctaaagtgcacagatcgtattttagttgttataatataaacaactaaagaaatcatttaataagaaatgtgattagctcagttggttcggttgtgcatattctatcctagagacctaggttcgaatcatctgtttgcatctttgcccccctaatttattcctatcaggtatcagcagcctatttttttcccctatcagcagccacttcgcttgtggcatttttttttaaaaaaactcgcttgataaattttttagaaaacaaaaacagcacgcccagtacacaatgtaaaaaaacagctcgctcaattattattattttttaaaaagcatgcttagtccaaaagttttaacaggaaaaaaaaaagcaactcacttcataatttcttttaaaaaacagttcgctagaggtccgaaatgtaaaaataaatatctcgctcgattattttaaaaaatacaataagttcgcttattctaaaagtttttatagggcatcaagaccattgcaacgcatgatatctgttgtaaagtggattcggccgttgcaagatactcaatctctgcaacgcatgttctgcaacacatattatctattgcaaattgggctcacccactactaagcgttgctagggtcgcattttggcaacgcatgcttaatgcgttgccaagcatgtattgctagaggggggttcttgttgtagtgttgcaagaatgaaaaaaacaaagtcggcttgatgcatcggctcattcgagcagctccagttcacaccgaccagattccaaagaataatagaatgaacattttaacaacttgatcaatcgagttcaatcatagaataaacattttaatcggctcgattcaatcaagttcgatctaacataaaagaacaaaatcaacacacaacaacacatagaaagagttgatgaagccacactaagaacacaagaacactaagaacacaacaatagtaagcctgccgctcaccgttgccaatgtcagggagcacgctgctaccaccacctctgggtggggaacccaccgtctccccttccgttggatctggcgtcggggacggcgccaccgctactactcacgggaggagaggttgttgcctccgttgccaccactgggtggggagcccgccgccatccctcttgctggatctggtgaaggggaaggtgccaccaccgccactatgtagggagccccatgcctaccctccaaccagatttagcggtgggagggcgtcaccgctcgcaggtgggaagagagaggcgcgatggagagtgtcgttcacttctcaccttatctgttcgtgaggataaagatgaacagtcggcttggtttgtcttttactggtgctgtttttagaaaaccgacacctacaatatattataggtgttggtttttaattaactgaacttatgataaattaaacgtgttggttttttttaaaaaaacaatgtgcacctataatattggtttcaatttatctctagaaccaacacctatagtcacttaaaggtgccggttgtttattttaggtgccggttgtttatgttttcagcctacgggggtgggaaaagttatgggaaattttgctacagaacactttttatgtatggttttacccataggacattgcccagactcacttttgggggaaaacactccgtaaatatggtaatttgtcaatggacaccgcgccgattaaaataataatttccggttgaagaggatagagaaatcgcgtgaaatgtcaaaaatgcccttgggcccacatgtcagctctatctcctatttctcttctccttctccttctcttttctcttcttctcttcttcagctaccacggcgacgaagcatgcatagagcggcggcggcggctagcggcaagcgtgagccgcggctggtgtcgtgtcccaacacaactctaaaatacatcctctaaattatgcctagaataattaaaaaccgtgtgaaagcctccaacaattaaaatgtgcaaggttaaaagtcaaataaggcttagaggatttttgtatatttcctaaaagcctaaaatacgtaaataaattttagtggaattttcagagcacaaataataattgttaagaaataaacaaagttaaaaagattttataaaaagaaaaaccctaaaaagtcccccttccctcccttgggccggcccggcccatctctccccccctctctctctctcctctccccgcggccaatccggcctctccccgcgcgcgccgctgacgggcgggcccgcccgccaccctcgctgactggtggggcccacccgtcatccccttcctcccgccgctcccgccgcctcccccgtgccctagcgccgccgccgccacgaatcccgccgcctcccgtcgtccccacgtgcaataaagtggggggaattactccccgtgatcccctctccctttccccctatttttccctctctctctctcgttcaaacgggcggatttgcccccgcaaatctcgccggcgccattgatggcggccggacctcccgcgccggtttccttccccgccggccgctctctccctcttccaaccctatttaaaccctccccacacctcctccgtccgtttccgcctctcgccgcccttcctcctcaccggattcgagctcgcgacatcgctctctctctccgccgtcgccgccgagctccggtccgccgccgtcgtcgccccggaccaactcccacctcggcgccgcctcctttgggttcgccgcatcctcgccgacctcgtccacctctccgtttcggtcgccgaccgccggaacgccgtcgaccccgtcgacccgagccgcgccgccgcctccctccgctccggccgcctcctctgcgccgccgtcgacctagggtgagccgtggaccgtcgcctcttttcccccttcccttcccctctctcggccgccgctccgccgtgcctatggccgccgccggcgaccataggggcgcgggcgccgcctcccgccggccgcgccgagtggccgccctcgggcgcgccgagtggccaccgcgtggggcccggccgtcagccgcccgcgccctcgggtgcggctgacgcgtgggacccacggcgccgaccggtgtgagcccgggtgcacccggtccaccgtggaccgtgaggctgccgcgtgggccccactcccgtggacccggtccgcgcgccccctcccctcggctgacgcaataaaccctttttaaattaaattttaaatgaagaaattcgcaaatattcatttaaagagcacataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttatctttgttatgaccttgttattgttattgttattatttccttgttcaccctagaataaacaaaaccccaactagtggacactctactcatggtaccactagtatgattttaggtagatgcttcgttggttaattaggcaacattaggtggttttacaactctagactttgggaatattctcatcacctggacactatggaatggatggattattgtggaattggattcacacctccccctctattcaaaaccctcaaaatagttttagtctgggctcggggtgcatggttttgatagtagcacctcggccatataaggatcggtcttcgggcctctgttgcaaagcactaccgtacttccacatgtctagtgggtaaggcttagtttgtggctcagtctggttataaacaaaagtacacggatggagatggatgaagtcgggggtcgatggacatctctaggacaaatgaaggctacacgagctgcggcccggtagtcgagatgtcatggcacagggccggtgtcctgctgctcggggctcagtcctgcctacctgtcccgggggttccggccgtaggtggggttgggtcggtactcttgtctatggctaggatgggttggaaactatgtcacgtcttccgtccgtataccgtggtggtatgtggcacgtggatacacgtgaggaagatgtgtcttgtgggtaaagatgtacacctctgatcagagtataacctattcgaatagccgcgccctcggttatgggcaagccgagcaatgtacctaagttagtgtttttaattcttaaaacctgcttaacaactaaaatgtggaatggttggcctgggttggcttgggacgagctaggacccagggtcgggttgccaattcggtctgaatcatcgtaggccttgggttaaggcaggttcgtgtgggttcacggccttgattaataatattgtatagctctaggaccgtgtttacaaaatagctttgagcaactaagtgtcttttaacgctgtttgctgcaaaccctaaccctttatactataacccccttgtactcccttgcatttattctgcacttgtggatgtgtcttgttgagtacggtggttgtactcagtcttgctcaatttttcccaaactcagaagaggagttcctggaagatgaaggctttggtgtctagctcgtgcctgccgtcaagcgcctgtggtcgtcgccctagtcttccgctgtttttcgtttgtcttcttgtgtgctgggccttcgccgcccatgtaatagattaattaattacgcttccgcttgttaaactctgaattgtatcaacttttggtgtaccttgcctcctgggataaggaataatgcacgcacgtaaggaatgcccgttgggttatttccggtcgtgacagctggcgagagcggcggtcgcctcttccccctctcccgctggcgcagccttatcctccccaccttctcccgccgccactccgccagccgccgagcgatcgcccgccactgccggcgctccactccacctgccgccgtgcaatcgcccgacgctgccgctccgccggccgcgcgctcgtccaccgccgacgccgccccgctccactccgccggccatcgcacgttcttccaccgccgacaccgccccgctctaatccaccggccaccgcgtgcttgcccacctgcttcggtcggccgcaagctccgctccaccgcagctgacgccttgctccactctaccagccgccgtcctcaccatctcctccgctgcgacgagctcaagccctggcgaccgacgccgccacatgctcctctgagagagaatatagagagagagatgagaagagagataggagatagagctgacatgtgggcccaagggcatttttgacatttcacatgatttctctctcctcttcaactggaaattattattttaatcagcgcggtgtccactggcaaattaccacgtttatggtgtgttttccctcaaaagtgagtttgggtagtgtcctagggctaaaaccacatataagcagtgttgtgtagcaaaatttgtcaaaatttatatagttgtcagttttaaaacttccggcacctataggcacgtcccctttttgcttttctgttgtagtggcatattgatgcagaacataagtaagtgctaacggaaattcagttttatagtttacaaaaaaatgtgctaagacttattttcaatacaggttggccatcatgggattcagaggacatcaatatttagatattcgctgttgttagcttgagttattcattccgtgaagtcttattagtttgattaattcaaataagtcatttaattatcttatttgatttacaagttatgatggatcataaagctcgagaagaaagctaacatagtcctccctccgtatttcaatgtatgacgccgttgactttttaactaacgtttgaccattcgtcttattcaaattttttatgcaaatacaaaaatagttacgtcatgcttaaagaacatttgatgataaatcaagtcacaataaaataaatgataattacataaattttttaaataagacgaaaggtcaaacgtttgttaaaaagtcacggcgtcatacattaaaatacggagggaggatatgccaacaatccatctttgtttcccttgtcatgatctcaccacaccattcttctcttttctgtaatgaaacagagtccaatcccgcaaccccccccaaaaaaaaaaaagaaagaaagaaagaacaaccaaataagtcaggaaactttcctaaagaactgatccgtgtgtgtctaatctgcctcgatgtttatcatacactagttaatgaaatggcagagctcttccctcgaaaaacaaatagctcattatgtaatttcaatatcgttatttttcacgagaatcttggtgctgcggatgatcatggtatgcggtgcaaccaaagcaatccatgtggcatcaggctggctgcgtgagataacaagctgcatgcctcctaacacttctcttggaagttatatcctaatttcaagtgtattttgcacctatctaaagtagtgaaattactaaagtttctccaatcttgattgtgccacgtcatcaattaaacacagaccgttggatacacaaggaaatcaatagctgctatcagatgcaaagtaaagttgagttgaaaaataaaatctggtcaatggtagaatcctccagattgtggcaaacagcccatgggccatggagctgaagcgtcgtgtacgtatataaagataaagagaatcacggagcaggtaagaggatacgaaaaagaaaaaaaaaagagcgcagaacccatctcctcccgaaacccatcgccgccgcctccccattgccgttgcctcctctgcctcctcctccaccgcgcccactcgcccctccatacccacgtcgcttgcgcaaccccaccgcctcagatcctcccctaccatccggcgaagttcctcatctgcctttccatccaccccgactcccacgatgtcgccttctcctttccgcccccggcgtcgtttcccctccccctctctgcaaccggcatttcttcctcgcacagtccaccgcctcctcccctcacccattgccgccacctcctcgcctccacgcaccctccactcactttctcatccccatccccatccccatcccatgatcccaatcccaatcgcagctccaaaacagcatcggatcacaactaaatattttggtaagtcacaaactcagataatcccatcacctcctatctttgctttctcacactgtagccgggaactacatataaggtcaaaaaaatatcagtaataggatggactgacaaagagcaatgctataaaaatatattaaaaaacacatgtacaattatgtttctgttaaaaaaaaggattgttgttgtgttttgttcagcaagggaatttaatcttaaaggcggatagccaactcaaatgattcttttttcttggacgatggtttttttagcatcatcagcaatgatctaaaggtttggtttgacattaatgtgccttcgatgacagtaaaagacacttggtttcttgccctgcgtcagtctgttgtgcaaatatgcgaatcaagggcatcgatgtattaggagtttaggacacaattaaatgctaagcacatagaatatctattattacctgttcactttaatatttttgccttctgagttttgaagctaaaaaccaagcaaacagctcatggtcactatgttattggttctctggtgtgttcattaggcctgatggcaccttaaccttaacctgttaattaacaacaaacatcgatggcacctttttagttgtacaccaatcacctgaatagtgtaatttctgactttgcatttagcgtatgtaattagtaaatgtcaatcatatctactttctcaggcctacagggaagagttgagaagtcctccttagctttgggctgaagggtttttggttggcaacaatgaacaaacagacaaactacattaattgtgatgactctggattttttactacacttcataacaaaattgtgcatttttattttgtgatgtttattatgttattttcttgagatacttagaggtcaaatgatctttgagcaatttgtgttggtttcaaatcatggactagattgccgtttagtttgctaatgtgtattgcgttaggtttgactattttatgccttatgcatcatattgctgagtaaacattctcatcttttgatggtatacggtaagaggttgatcctggacatattatttgaaccttcagttcaaatatagcttgagctgaatctatagttctaactaatagtttatcaagttgtatgattctgtaaaagaaaaaaaatcaaaattaagtatgattgtacattacgggcacccaaagtcgtgcaacgcacgactaagtggctagtaatggtgattcttcatacatatagtttcccgatgcttcctaatccaagcatataatttccttggattatgtagggtcttggataaatatacttccccaatgcttcctaatcgaaacatataagataaggctacaaaattcagatgtatggtcttggatgttgtgttacaactagcattaagaaaatgttaattataagttcttgaaagtaaataattgactatatgatgtatatagataactacgaaaacatgtaaaagaactatagctggttccacaatgcaactgttttttttattttcatgccttagcagtcaatgatgtgaatggagaaatattacattcactaccacataacaccacatcagtgctggttgggaaccccacatagatgtcggttttcccagccagcacaaaggaggcagcactgatgtaagtattcaaaggtgccggtttaggaaccgacacctttgaggtcccaagaatccaaaaaaatagggctcgatgaattggctcgaatcgagccgatgcatcgagccgttccccgtcaccccgagaccattgatccaaaacaaaatcacagatgtttctcacatgagaccaccttcgatccaaaacaaaatcacagaagtttcacactatcaccatcgattcatccaacacatatccctcgaagcaaatcacagaagtttcacacaaatgacagatgaaagaatcacaaatcacagatccctcaacaatttcatagaaacaatcactgttgccactgcgtcgcaggatccatcgcaagacccgccgcagacgccgacccctgatgcggctccgcccgccgtcgccacccgaccgccgccgaggccggatcagtcgtgggagccgccgacgccgacgctgccaccaccaccgccgaggccgcctcgcccacccccaccgccgcatccgccgcgggagaagcagccaacgacgacgccatatgcggggagaagaaggacggggtgagagagagagagagagaaactgagagatagaggggcgagagagagatcgagaagccactagcgagcgccttatccttatctcgtcttggtggggctagccggctcagctcgatttggatgtcagtctttttaaaaaaccggcacctataatatcttataggtgtcagtttttaattaactgacacctataatatattataggtatcggtttttttaaaaaaatacacaatatataataggtatcggtttttatttggaaccgacacctataattgcttaaaggtgccggttttttacgatttcaacctgcggaggtgggaaaaggactataggtaccagttttagcactaccggtatctatagtggcgagaactatttgatgttttgtagtagtgattgggagaagagtgaagttcgcagcaaaagagatgggtgctgaatatatgcacgaagcacagaagaagagatcgttgttagttatactaaatgtcaataatagaaataggattaactcctataatattttaagcgtgcataattttaagtatccctttgtacttactagtataaaaatagatggttgttcgtataggattgttgtcaaatggacaactatgccacgtcgaaaggcgtggttctcctaacagtagttggaatttaaaagtaattgtattgattcgtagaattttttgggatcccccattacatggccctagaggtctatttatagccttagcacaagcttgcaccttctagggcttagggttataggggattttacatgggtgcccttatgaaagggacatttacatgggtacgcagtgtcatttacacatatgggcctttaatggactgataggctgggcctggtctatagtgaacaggcctaaaagaccgggggcagcctgttgggcctccttgatgccgaactcgtcatggcgaagtctttgtagttcgctcgagatgccttcgcccaagatgcctttactttcggagtaccgacgcggctttccagccttcgccatcttcgcttatagctttcgctatagggcttcgcttgaaaggtcttgacatctttagcttgaatccttgctggtactatggtttcggcaggtccggccgaagggcttcatggcatgcctccaacaaggatcaacattgcaataagtactgattgacttcccattgcaacccaccgtttatatatatagcgatgcaagagaaggaagtaatacctgcttcttctccttcctacaatcctaagcggaccaacaattcagggtgtttaaaactggtagagatgaaatcttataatacgaatttcatgcaaaaaattgaaagaagaattgtgccacgtggcaacaccggtttcgcgggacggctcgatcctgcttgcgtgcgtacagtgtgaaacgctcgtgtgcgtgcgtgcagcggttgtccagaaggtcgtccagaagtttctattgatcgagcaattaggtccatgggggcacagcaggctatgtgatttttcgcgttgccgccgtacggctggcaaagctcaggcagctattgcttcctcctaccaccggatattgaggactaaagaactaaagaagtaatgatacatactttggttagagactaaaagaggattaacaggatgtaatcaaatcatccactaaaattcctacgttgcaaacatccatcctttggcagttcctgcgtttccttattttgtatctgtactcatgtgatttatattatttcttttctgtgttttcctctacggaaatcatagaaccttttctctttgggggcaatttcattcttactcctactttgatgtttaacattgatgttgcccagtattttgggttaattcgatccatgccactgcaactttaacaaattaaaaaaataccactactattcatcatatcggtttcatgccactaaaaaattctaaaattggaaccatgccactcccgtcgctttttacgtcctcctccctcacgctgtttcccttcccgttgtcgacaccacaccacatcttctttgtccccaacgccaccgcaccacgtcggcctcgccttctccccgccggcgagggccgccgccgctgctcctccctgtcctctccccgcacgtaccatgccgctgctgctactcctgctccagagagcaaccagccggaggagagctccagatccggcgccgccaggaccgccgacgaggtccaccgccgctgctcctccctgtcctctcgtcgcgcgcaccgtgccgccgctgctactcccgctccgcagagcaaccagccggcgagcagcgttgcggggatccccgtctcctctagatccgacgccgcgggcaccgccgatgagggccgttgccgccgctcctccccaagctcttgtcgtcgtcgcccaccgcggccatctctggtgagaacctcaagatccccgtctcctcctccagattcggtgccgccggcatcgccgacgagggctgctgccgctgctcctcccccatgctcttgtcgtcgtcgcccgcggctcctcggcctcgccaagaagctcgccaacgattcctcctgttccgatctcctctgccgttccccgtcctcaagaacggcagcgccgcgtacctcctccacggcacaccgccgccgacgacgatgatgatgccgcggtgccccatccacatcaagagcttatcgtcgccggcgcagcatgttcagggagttccgtgacgcggcaccatctcccgaaacgcctgacgctgacgccaccgacgacgactacctcggggagcttgacttcgaagatgaggatggattcgacgccgactctttccttgccgccaacgtcctgtacagtgccgccatacatccatacataagaagcctcatggtgctcggtctcatgttccggcaaggctggctcaacaccggccaagcaatgaagcagcatggcgatgagagtgattggtggatgtgccctgctcaatcgccgtgagagaggacgaggacgggaagggaaatggcatgagagaggagacggaaaaagggatgagagtggcatggtttcaattttagaaatttacaatggcatgtagccaatatgatgaatagtagtggcatttttttaatttgtcaaagttgcagtggcatggatccaattaaccccagtattttagggttttgtttttgcccatggtttcttgaaataaagataaattttgctcctacttttgatgggcagattaacaatgttaaatctttagcgagaaggcattaaatacccttactcatgttgcaaacttcccctgtttttgtttatgattgagaatttgcccacatttagcacatgaaccttgcaaattcgataaacttttaccaatatgataattttaacataaacatcaacaaaaatttgcttcaaaatttcatatcttgaaaaaaacaaacagacaagtcaagcaaatctgttgcctacatgtgccaagctgtcgtcgtcgcctcctctcacaaactgccgccaccgttgttgcctcctcttctcactgagccgccgccgcctcctccccacgtcgagccgccaccatcacctccccgcgctaagctgccgttgtcgcctcctctcatcgagccaccaccaccgccgttgacctgttgtcctcctccccatcgcctcctcgacacgtcgagcagctgcacctcctccctacgctgagctacagcagccgccattgtcctcctctctaccatggcctcttgcgcaatgcctagcctcctcctgcacgctgcaactgggttgggtggcctgcacttgctcgggtcgtgcccgttgcctggccggccagcccacgaacactgccgccactgcttcagaacggggatttgggttcaggaagggaagagtcgatgccaagtgctcaagcctggagggacaccaagcggtacttggatattttctaggggtaaaagggtcaatcgataatttaaaaaatcgttatctcttttttttctctaattctttgccgcattaagtccaatcccactcacttccatcaaaaacaggggtaaactcctcattcgtttgaaaaaaatagggcaaaaaacaacaaccctaaaatgtagggtaaaatcagtattgggcatcaaagtaggggtacaattgtactagcaaaattgtccctttctcttttctccctcggtcaaatgcaacctatatatgtcttgtaagggctactttgaaataaagattgagggatgaataggaaaaacatagaattctgacaaaaaatcaagcgcaaaacaaagaattataaaacacataaaaaaatatataaaataatcatttgattggacggtacgaaaaatgcaagaattagatgagagagataaactcataagagacttcgcgtgatattggacctcatgttaaaaatactccaaaacttgtatgaatttgggcattccttagaaatttgataagactcaatagttttcaataatcctttggttcaaagaatcatatagaaaattttcctatagcaaaatttattgtttctatacacaataaaagttcctatatttttctttcaagtaaggggggccctaattagttactccactaaagtcgaatcagctgggttcactttaccatgcgtggcgaagccacgcggtttttctagtttaacttagcgcacgtaaaacgaaaaaatcatttgcacattattaattaattataaattattataaacttaacaaatagatatatttgatattttaaagtaacttctgtatagaaatttttcacaccatttagtagtttaaaaagtgtcccgacggaaattgaggtaaaatctgaatcttaataagaaaaggaaccgaatgtgagtgaatgtgtttccgtaaatgcaataagctgagtggttatagttttcataaatgcaataatctagagtgaatgtaaccaaggctgcaatgtaagcctcggttgcgaattcacatgtgaaaattttgagtcactaaagattgggagatagaaagaggagagagctgcttacttgttcgggtacttcttttgcattttgtttcgtgtttttatcagcattaacagcaatataaccagctagcatagtcacgacgacagtattcttccatcctgctcacttgccgaggtgaattcactaatcagaaaaagttaatctccgtgatagtcaccagtacgtaaaaagaatggagtatgtttaaacagatcatggaagtagacagtatttgaaaataattgaataatgtgtcatttaatttatttgataaatctattggtttatcgatctatcttaaacaaataggatattaacaactgaatcatctagagaatgctgtctcggaaggaagaaaaactgaaaatatatgttttttccttaaatttgtaagaaaatattggttgggaattgtataggaaaaaaaaataggagacgactccgcgtcagatattccaccaaatatgcctacgcgcctgtcatgcctcctgcgtgcagcatgcatcctccgtctatcatgcacctccgtatgcctccgtatgccacatgcagcctaccacgtatattctagcacatgtgcctgtcacaccacctcttgcttttcctctttccttctcacatatactagcacttttttctcctttttttctttcaccaaaagttaatcaaaattttcttttaaaatatacatctagtttgtgatttaattataccattaagtttgttatatttgaaatttttataacatatcttatacagttatattttgattaaaaatatatgtaaaaaaatcaactgttgtttcacaatttatataaaattgtttcacctcactaatgaaatgtgttctagagaaatgcaacatataaaatatattgattataacaatgacaaccattatacgaaacattaaatacgaacgggtgatacacaaaaaattcatatgaatatacaaaatatttgtaaatacttaattacttttaatattttctttatctcatccatgtagcacagagttgtaattgttgaaaaaaaaacctgctgaaacataaaaaaggattatgtgcaacatttgtaaataaagtaatacttattgaaacatttatataataccatatgcaacattaaaaacatccattaaaaaaactttaaatgtgcaacattgtctaattttaaatgacacattctcttctcaccaagtgaaacatcgaattttaacggttgaaacatataaatatatgttatcgaaatataatcatatgatatcttattttgaaaccacagattacaaaatgaataacagaactcgatgataccgacgagaccgtagtcgagttggtttgactagatcacccggtgacttggctcctataggcttcgacttcgtaggctgtggtggtttgtgttggtggtgagatttgatgccttaggtccgggggtcccttttatacccgtagaccggatatagagggtattggggtacgctggtataaggatctacgtagtatgacatcaagcaaacaggaaacagagattatactagttcaggccccttgataggtaatagccctaatccagttgatatgggattatataatggaaaccacatattacaaagggaatagcagaactagatgataccgacgagaccgtagtcgagttggttcgactagatcacccggcgacttgcctgctgtaggctccgacttcgtaggctgtggtggttgtgttggcggtgagattcgatgccttaggtcctcccggggagtcccttttataccgcgggtcagttggtctccaagtagaactcagagacatcggaccccacacgatacagtaacgacccagttctgtccgagtaggactccttccatccgtgaactccgtttctattacgtcatgaatttccttaacgtgtacaggaaacatccgtacacgcgcaggtataccatatcagtatacggcatacatccaagggtaaagagtataccttatccgtaaccctaacagtagcccccgacttctgcttaaatgaactcatgtggccgatcatgacttctgatgtcggaatcgttatcgctctcaactggtcgatctcggtatgagaaccgtagagacaaagagttatcgataacattgtatgaagttcaacggtcatgagtgaatttaaattgaagtccgaaaactactgcgcgtaacggacccagaaatttccggcggccatctctctcctttccttgaaattcacaccatcggtagtgcgcttatttaagggagttttggggatccattttgaagtccgtttgctgcaaaactttccagcccccaagcgtccctcgtcttctccactcccgcagaaaaaccctagcttgctcatctcggtctattcaccggcgatctccggcggcgatggatctcgacaagtccacctccaccaacgcgtccctgaagaagctgcaggatgacggtgccctccctggtcgcgggaccatggagagagaaccaggaggtattgaacccgaacctatcctgggccgcatggttttggttgaggattatattctttgcggttttcttcctccgccctccgagcttcttcttcttgtcttgaatttgtacggtctttccttgctccatctaaaccccaattccatcgccttcctcagtattttctcttatctttgtgaggcctacattggggtaaagccatttattgatctcttccgcttctactatgagttacgctggatggaacctaaaaaggtatccagatgtgtcggtttccgacttcggaatggcctgaagtcgcgatacatccccttccagtgcccctcttctcgtagtaaatggcgggcgagatggttctatcttcagatagaacattcggatccagtctttgttgtccctgaggaacaaccagacaagatttcggaatggaccgccaaacccgccctaactccccccctccagtctttcatcgatatcatcgatgacctccgagtacgagggttgtcggggtatgaagttgctgccgacttcatcggtaggcggatccagctgctccaggctcaagcccacccagcctttgactattctaggccggaggacgcgacccgggtttctcctcggggtatttttcttgtatttcggatttcattctttatgtgcatgttcctcctgacttattgagttctggttctcgatcctacaggtttgaacaacgaaaccgtggagcgccgcatcggccaagtgatgatcagcggccctacgacagtgagcaacatccccgtccccctttgcgagaagggaaaggccgatcgcgaggctgcgatcaacgtgagtgtttttgatgactcctttacttttgctttcctgggatcgcattgtgacatcatgtatgcaggctctccctttaacggacgtcatcgagctgctcgcggatcaccaggcggcagcgtcgttaaaggagggcgttgccaaggaggcgtccgacattgctgttgctgctgccacgacgagtggcaacaatgttccaaagaaagggaggaagttctcctctgtacttggaaaccgtcggaaagcgcctactccgtcggtaagcctctcatgtttcttaatcgtgtagtcggaatactttgacctcatatcgtgctatcttgttcaggcctcggatgcgtctcctccgcccaagcgaaggcaaaggctggtgacgcttggcgagaagtaagtagacgttttagaagtcatcctattcgcaaactcttgcttgcatgtcttcatgaaattgcggaaatccttcccagggcggcatggtcgaaggcggcgcaagatgggtccggcgcgacctccaatgtgtctcccgtggtggcctcgacggacatcgtagtcacagttagggaccgggaggcgacgctgagtggacccgctggcggtcttgcgcccgctcggggcccgccagttgatgccctcacctggggggagctccaagctgagatggagcgcatcctccaggctggtgcccgcagcgtgggccgcgagatcgaggaggccagggcggcggcggtgtcggcaatccaacgcgccgagcagctggcgcgagatctgtcgaagacccgcgaggacctcctcaagatgagggagttggtggccggcaacgaacggcagcggcaggggctcaagcacaggatgtcggagctcgagaacaacctgtcggagatccgcggctcgctgcgggtgtcttacaccggtctacaccaactcaccggggagtgtagcgtcacgaccaccatcccgacaacccccgatgagttctcgctgacgtcctcgctcgcggagctagctgcggcgatggaggagatcccctccaagcatgcggccgggatcggcgaggagacatcgaatgggatctacaccagggggtgccacgtcctcgcgtacgtgaggttggcgtgaggattctggatcagggggccgccaatgacgcgcgcaagggcgtgatggaagaagtcggtgatttgggggagtctattctccccatttttgaagattaggactttatttcccttgtactccttactcaattatgcttgtaaaactttcgtaggttcaaactgcttttgtgtatgaagttgtttccttcgttttctttagcatgttgattccgagtactttgttgtcgttgtagagatgtcgatgtcgaggatgtccagcagcgcgggcagcctgagtcgccggtagtcgttccagcacttgcgcttgagccgtatgtgcagcgggacgatatcgatcaaagcctgtccggggaggcggacatggcgatgactttcttaggttggtacttttagtcttcatctccttggctcttttgttcggatcgaattaatttgtcgtgttctcgaaagaggagaatgacttgacttagtcatttctgtgttgagcagacctggagagtgtgttggccggccgagatcatcggatctaatattggaggacgaagtccgaggtggccaaactcaagaggactatggtggaagtcaaaaaagaccaagccgtggaagcgctccaaggttgcgaggtgtggttcaactcgtacctcaggagctgttgtatggccatggctggagtctgcagggaactccgagtacctcgcgggaatcccgaggagtcagcggctggatacatctcgtggttgaatggggcctgcgctcagcttgaaggcatcggcaagcgtatcgacgaggccctgaagcaggagtttcgtcgatcgagccgatatgccagagggcacgtgctggcctgtatccgagatcaccgcccgcagcgacatctcgagttcctccacgaagggttttcacattctcggaggactcccacagagatagataatctggcgaagtcgatggagccgcttgcggagaaagtctttcagtctatggactagcgttggccgtcctggtagtctttatgtcctgttaaaattatctcaaggagacgtgtaatatattttggagcaattatgaattgtaagaagtacttgagaaatagaaaaaaaaatctatctaactaagttttcttactctagatgtgttgtgtatgagtgttttctcacttcacgacttcgatcagtcacttgagtcatacactctccctagcccccaaacttgtcttcgaagaattgttctcggaagataaggctcttggacccttgacctgccttggttgaacaagcactgatcctagcccccagccgtgaagttggaaaactcagtttccgattacacggcttggttaatacgcacggcgagaactcttacatgaccagatcttacatggtcgtttgtctctacatgatccgacaaggccttatccgctctaggcgtccccagccgaagttcccttaggttcctcagaggcctcgtcaagacagcataaagggacatgaggataggtttcaacgctaggtgtcgtcgtggtaagggatcgtcgggaaggaacactttgatcgtagtctttacctgaaatcaactttattgaagtctccacccgcggtgactgccagcgaagtccgctcgggagagccggagaggatcactgcggtgacctcccaaccagcgcggggctccgcgtcgtctccctcctgatccggaagcggcctggcctggtagtccactccgtgtggataccctaagaccacgcacatgccccgcagctccaagacgaagccagtcatgtccaaaccacgacgggtgacgctgccggccatctacaaacaaaaacaaaaagaaaagcaagatttcaaatgtcagattttgatgataagtgaagcagcaagacagagagagactagacagttttcacaaataacaaaggatttttatttttgaaaatattgctaaggcttgggatctacggctcgtcctagggtcaaggatggctctgataccaacttgtcacgaccggaaataacccaacgggcgttcctgacgtgcgtgcattaatccttgtcccaggaggcaaggtacaccaaaagttgatacaattcagagtttaacaagcggaagcgtaaatagttaacttattacatgggcagcgaaggcccagcacacacagagacaaacgaaaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaagggaattataacataaagggttcgggttgcagtaaacagcatttaaagacatttagttgctcagggctattttgtaaacactatcttagaactatacaatgttattaatcaaggccgtgaacccacacgaacctgccttaacccaaggcctatgatgattcagaccgaactggcaacccgaccctgggtcccagctcgtcccaagccaacccaggccaaccattccacattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccgcctacggccggaacccccgggacaggcaggcaagactgagcccctagcagcagggcaccaaccctctgccatgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaaccatttttggggattttgaatagagggggcggggtgaacccaatttcacaattcaccaacaattccacagtgtccaggtgatatgaatatttcccaagtctaaagttataaaaccacctaatgttgcctaattaacttgcgaagcatctacctaaattttaaactagggataccacgagtagagtgtccactagttgaggttttgtttaagctagggtgaacaaggtaataataataacaataacaataataatatggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaccgacggcttcgacttccacgaagagcggatcttccgaagctgcagcgtctacacgaccaacggaaaagaaaaaggcttttactctaataaactccacataacagcagaaacaaagcacaaaaatgggttcttgacttcttaaggaaaaattagagacttgaacggtccaattccgagttcaaatggccaagatatggccatttgaagtttatatgctctttaaatggatatttacgaatttcttcatttaaattttaattaaaaaccgggtttattgcgtcagccgagggagagggcgcgcggaccgggtccacgggagtggggcccacgcgtcagcctctcggtccacggtggaccgggcgcacgcggctgacggcggccggcgccgtgggtcccacgcgtcagccgcacccgcgggcgcgggcggctgacggccgggcccacttggcagccgcgagggcgcgcccgaaggcagcctcgccggcacggccgacgggagggggacgcgcccgcgccccgatggtcaccgccggcgaccaccggcgcggcggagcggcacccgagagagaggagggaagggggaagcgaatggagcggtcttcggctcaccccggtcgacggcgacgacgggaacggcggccgaagcggaggaaggcggcggcgcggttcgggacgacgaggacgacggcgctccgacggtcggcgagcgaaacggaggagcggacggggtcgacgacgacgcggcgaagccgaaggaggcgacgccgaggggggaggaagtccggagcgacggcggcggcgaaccggaactcgtcggcgacggcggagagagaggaaagcggcgcgagcgcgattccgacggtgagagcgagcggcgaacggcggaaacggaggagagaggcacggggaacaattaaatagcgtcgggagagagggaaagcggccggaggagatggaaaccggcgcggagatctcggccgccattgattgcgccggcgaactttgcgagcacaaaatcggacgaatccgagggagagagagaggggaaagtgggggaatcgggagagggaatcgcggggagtaattccccccactttaatgcgcgcggggacggcgggatgcggcggattcggcggcggcggcggcgctagggcacgggcgggcggcgggcgcggcgcgaggaaggcgatgacaggtaggccccacccgtcagcgagggcggcgggcgggcccgcctgtcagcggcgcgcgcgcggggaggagccgatgggccggaggagaggagagagagggagggaagagaagtgggccgagccggcccaagaaaggaagggggggaagaggacttcttttagggttttttctttttataaaccttttcaactttgtttatttcttctcaattattatttgtgctctgaaaattccactaaaatttatttacgcattttaggcttttaggaaatatacaaaaatcctccaagccttatttgacttttatctttgcacattttaattgttggaggctttcacatgaattttaattattctttgcacaatttcgaggatgtattttagagtcgatttgggacgtgacaagggattatactggttcaggccccttgataggtaatagctctaatccagttggtatgggattatataatggaaaccacagattacaaagggaatagcagaactcgatgataccgacgagaccctagtcgagttggttcgactagatcacccggtgacttggctcctataggctctgacttcgtaggctgtggtggttatgttggcggtaagattcgatgccttaggtcctcccgggggtcccttttataccgcgggtcagttggtctccaagtagaactcagagacatcggaccccacacgatacagtaacgacccagttctgtccgagtaggactccttccatccgtggactccgtttctattacgtgatgaatttccttaacgtgtacaggaaacatccgtatacgcgtaggtataccatatcagtatacggcatacatccaagggtagagagtataccttaactgtaaccctgacaaatggttttagtcaattccataatttgtacttattaaatttaatatttatatagactcatgtttttacccccacaaacggatttacttctattgtcgtgacaagttactttccttttgttttaagttacttctatatatgcaaattacttttcagctttattgaatttacttttatacgtctaagaagtaatttaatgaaatctaaaggtaatttatatatattgtaaaaagtattatgtaagttttcattaaaaaaatataatcatgtgatatcttgttataaagatttaattgttatgaacacaacagtgtaatcggatcgtagatcagatgagtaatttaagagaaaaatttatttgaagcatagttggtaggaaaatatttctctacttatttaagtagattcttccggtcaatgccccgtcgctagcagtggcagttccaatgggcggttcaggtgatccctggaccaccctagaattttgcccatgaggacaccccctgatctgtgctagggttagggagaggcacagacaaccgccagccatagtcgcacgcattgctggctggcagctgcctcctttgtcttcgcgtcccgactccgactccgactccaccttcaccttaggcttggcacgatggtcccgacacatcgcctccccggttcccgcctttgcctccgcgtcggcatgccacctccccatctcctgcctccctcctcaagtcctcctcggcaccacccgactccgcctccgcctcggcgccgcctctatgcctcctccagtcccccacccctgtcgggcagcgccggtacgccagcgggaggcggcaagcgcctataggccggctgcctaggcgcttgggcccaggtgcccagtccggcggtcgcccccaccccttggaaagggaagaaagggaggcgttgaagcgacgtcgccattctgccggcggccggtgtcaggtcccctccctctccagctctcctgctgcccgacaaagttcaaaggtcagtagacatttattgttggctttttgcaatgttgccctatgcagtagtgagtagacagtagtagtgttagtgaaaaattgttggttatgtctttattttgtggtgtaaattgcagtgagacatgaaaaggaatggagacattgcatcacatttttggaaacatgaagcaaaggtgaaaaaaaggcatatcctattgatgaggaagttcaaattgaagaggaggagccaccattggttgagccacaaactcttggatttatgagatatattactacatttcaattatatttttactatttttgacacattttgttagaatagatgtcgaatatactagtcctatttagctacagttggacttggagttgtaataaatggtagggggtggagttagagtcaaactctgtaactcgccatctctcttaaatagagaggggggcaccactatataaccatggtgactacaatgtagcgtagacacgcagggagatgatggcggcgaggccatggactcgtagcagctaggtgctatattggttagggaggagcgcctataatcagagccccgaggatgggatgtaggcttcagctaaaccttgttaacaaatatcgtgcgttcctatgtcatcatctagcatgtatttggtggtcaatgattgaagcgatcgagaaaaggttagtcgtcgttccgctatatcgactaacttttatagcgaacgtcttgatgcgatcttccgagaaaagtttgatggttcagggctcgatatttgatgcatttacataagtttgttttagtttgataaaatttgctacaggacactcaaaagtttgagttatggtctttgttgctaggcactgtaaaacgtgatatgaatctagaatacccaaaacccaggtaatttgccgggaacaccacaactatttgttattttatcatttttacgctacatagagaggaaaaaatttagaaacgacttatttgccccaaggccagcaacttgtaatggcctccgcggctccgccgtggacattgtcgccgctgcctccaatttttaggttttgatcaagaggggattagagcacggaatgtggcttgggtctggtttgaaccagacccagccgtgttacaacttgctagcctgagaggcaaaatagtttttttatgggatttctttctccatttgacttgctcggaaataacaaaataatggatacagtatcccattgcaaattacaggtattctttcattgtacagtcgtgtcatgttttttaggtgtccaacacgtttatgtgtccttcagcaaattttgcctttttagttttttagggcacaatgatgcctttgtacctccaaaacaagtgcatttactatgacactcacacccattttcacaataacgtatggctcaatttggattaatgacttttatgcatgccaattttgacatagcagggttgtaattcaattaaagataaactattaaaaaaagaaacaaacatatcagggccatgtatgcatcacaaccacaaacgatcgagtcgacaatgatagagtgagaaatgctgcatcatggacttgtcaagtcaatggaaaaatggatggatggatgggtgcacaacgcatgcagctggtaaataattaggtaagtttcatgtttggtggcaattaagcttcagttgacatttgcaggaaaaatgaaagcagcagctaaaattgaacaactgaattcgttcgaaagtacggctgtatatactatatggatgattgtatatgttcatagatggatagatagatcgcgatcgatgcaacgcaagttgcaggtaccaacagcactagtatctctggtcgaattaatcgatcgattgatctgcgaatcataatattaagctcaagtccaagtcagcaacagtgcaaaaacataggctaccacaaaagcaaagccatccacacgacatatttcgatccagataaaaatatctgcccagcccggccctttcctcgggatagcccacgccacaccgaagaaggtatcaagccaagccgtaccgcacccgcaaccgcaacgcggccacctaccatctccgtcttgtccaccctactctaacccctgatctcctcctcttccccaaaatctctctcaccttctgctccaacaaaatctctcacttcccgtgcctgaaccctccttggaatcctcctatacagcagcagcagatcagatcttcgactcctccaaggtacacttcgtttcttctgttgcccttccccatttcccaagggagatattcttgatttggccatatagatctagagccctataatctcccacaatctttctcctcaattcgaatcccttctttctttgcagaagtgaacaatcaatccgactggatctggggatgatggaggaggacagcttcatcaacaacgatgttggggaggaggtggtggttgcgaacggtggtgacggcgaaggggtcggggggatggcgaggagcgacgacggcggcgatgggggaggggggaatgtggtgcaggacccgccacttagcttaggtgaggtgcgagggatcctggagcagaaccacacgctgatccaagagatcagccaaaaccacaaggcccgcgatgccgatcgcctcacccgcaacgtcgccctcatccgggatctcaacacaaacatcgcccgtgtcgttgacctctacgccaacctcaccggctcctctcactcccacaccacatccgacgttgccagcgccaccaacaccaacgccaccaatagttcctccccgtccgccgccgccgccacagctgaggtgagcaagcaaccccacaccaccgacaccgacgctaagtagagcacctacaactccagcaattcgatctcttctcctttcttttatgtctagaattttagatttactgagcaacaggaggagaggaggtagatttggaatcctgctaaacttttttctcttaaatttccgttttctttctctcgatgtaattcagcgatgagatagacatggacaaccgtaaacacccaacttatcagagatcaaagaaagatgcagacatggtaacaatgccatgccagcacccctcattgtagtgagaatggtagggacttttccgaccgtgccaatgcaaatggtgtatggttttttcaaccaagtatactgattttattcggaatttatatatagtttgttatatcagcactcagcagtgttacatggacacgaacatccgactcaggacttgcgtctccaatttggcacaaaagaactatagatgagaatccttcttggagtctcacacgggtgttagactcaatgttgaacataaatttggatatagggtgtccgattcggtaaaaatttaggagtccaggtaacactgtatatcagaactgtgaaccgattcatctgtggagctttcagtcataccataattgtttattctgatatcttaatggtataaaaggtttgtcatgctgtcataatggtatagaagtggaaacggatcaatagagatttatttcattgagctagatatatatatactagaaaatcagcttggcgcgctgactatatgaccatcatgtctttatcttatatgcccattagtcaatggcacgtacatatattttagtgaaatatgaatttgctaaaggagcttcaaagaacctcttaatgtgttttagctttcaatgtgataagtatctataatattgtataatattgtagtgaaatgtgttgtattttgaaaacaaaacattttttttcttttttcctaatgctacttttcctcatctatttatttttctattagtgactaaattaatggacctgtaaagtagtacgatggaaaatacatttagtgcataatcagattagtgagctagaggttgggtattgaaacaaccgatgaagaataagagagcagatttctatctcattctagttcagatttgagaaagttctagacttcccttccttaacctcttctctctgtttttgatgcagcacaaatgagtttttctccttttttttcctattagtaattgcatgatttatctcagtttttatgatgccatgtggtccaatcacaatccggtaaaattgccggcttgagaataataagatatgccgttttcctacggaatttatgaaaaataccacaatatattggcaactcataagaacgaaacaaatggcgtgcttggttttgatgcatttaccgaacttttttgtatggtgttgagtgagaatggttttagaagtagacaatttaggtgtggaagaatataagacaatgtttgatgttcggttggttactttaaaatgctaaaatttgttgtggctgaaaatggtagcaaaccaaataaccctcaagccttaaacttaaccttaacctcttacatggttagtgttgacgctatgctactgtaataatgtattttaaccagtgacccctagcttaatttgaatctttgacaatagttgtatgtgaagttaatttataacataaataaacatatgattctggttttcttgttgctatgtgccatgtttttatttatgtactgctctgtctgttcagatagttctgttccaaaaattctgatatatgcgattgtggagaaacggaggtaattgcaatttgcaaatgcaatctccgcccaatgatgtggtgtagggtcagttaaaaggagtggcgagttgcacgtacgcttgcattagaaatttagaatatcgtatcttcatcatggatgaaacttgctgttttatttttttttctttgcgatcaatccacaaacagcgtttggcactttggcctgttttggaaagaaaagaaaagaaaagttcatttatttttctctcatctttacgtcttgatgtttgaattgcatccttaaactgcaatatcagataacttgcaataccgatatacctgacgtttcagggcagaatagtccctgatttccatcaacgtgggtcaaagtgggacctacatgtcatacacacacaaaaataccttccacccctcacttacagaccacccgtgagcagtccaccacactgatactggagccacagttgccaacgccgtgagatggaacgtgggagcggctattggggaggaaggcggcaaaggcatgctgccagtggaggagagggacgacggagctcaaggaggatagagagatagtcgttgctatcatcgatgaagattaggtcgaatgcgtcggcggcgcaagggcacaagcagacacggtgatgtactcggccatagcagccatagcagtggggagttgctgctgctgctacgacggctcgtcctagaggaaggtggagcaggtttacccacgccaagaacatgcaagacggtagatcttgtcagtggtggccccgtccgtgcaccgtcgccgaggtctattgaggtaggatgccgaagaggatggcgttggtggcgtcacctaccctctccagccaagcttcacccctggccgctccgtctaccactttggcatagagaaagagaggggagaagtagagagagatggcaagaggagagaatgaaagggtggagaagctgacatgtgggtcccacacccgactcggctaggttgaccgtaagcaactcgccatgtctgcactatactgctctatgatcttgagtacactgaaattgaggtacaccggaattacaagttaaaagacgcgttacacaattcaaattcaatgtcaagattatggacctaaagtgaacttatattccatgaaacttccatgttgctgaataagcgttttgttgaggcgagcgaaccatggattggttttcaataactcgtcatggagaaacattttatttaactggatgagaatctcatgttactgcaggagaattatatgataaaatggtaattcgcttgtgttcagattacactgttgatataacgaattgtgtgcaaattccaaataaaatcggtatacttcgtcagaaaaaccatcaaccatttccaatggggcacggttggaaaattccctaacattctcactacaaagaggggtgctggcatgacagtgaaaacatcagtctatcatatctgcatctttctttaatctctgacaaggcaggtgtttactgttgtcatgtccatctcagctctgaattacatcaagagaaaaaaagagggaaaagagaaaaagagtttagcaggataccgaatctacctcctgtcctcctgctgctcagtaaatctaaaattctagacagaaagaaaaaagcgagaacaaaatgggggcgagaaggagaagaaatcggatagccggagttgtaggcgctctactcggtgtcggtggcgcgggaccgcttgcttgccttggctgcggcggcagcagaaggggaggtgctgttggtggcattggtgttattggcgctggcagcggcagtgacagagcgggagaaggagccggagagattagcgtagagatcgacgacacgggcgatgttggtgttgagctcccggatgagggcgacgttgcgggtgaggccatcggcgtcgcgggcctcatggttctggctgatctcctggatcagcacacggttctgctccaaaatcccctgcacctcgccaaagttcctctgcagcacctgcaccaccttcccccctcccccaccgctgctcctcgccgtcccccctacccctccgccactgccgttcgcaaccaccacctcctcctccctgccgccgttgctgatgacgctgtcctcctccattatcccctgatttgatcgctcgctcctgcatcaaagaatggaattggaattgaggagaaagattcggggagattgtgagcctaaatcctaccaacagcacacacataaatatactacaaaaaaatcaaattttggcagcaccacctctgcaaaaaggacactagagactagactaaccaaataatcatttcaacataagactaaacaagctcacaggtacagcagccatacacacataaccatgactgacgatcattaatgtttcgcttgcagccaaagctcaaaagacaccagcacttcagccctacttgatttagattatcgagtagattgttgttgcagattatctactctaatataggggtaaatcaaatatttcgagaaataaacttaacatatactgtagcttaaaacaggtggtctacacaatgtggtagaagttttttcagaaaagtgtggagcaaataatatgtttaataatccggtgaataagcttaaatattaactaagcatctaaagtagtgataaggttgcataagtgatatatagtggtctcatatggagctacacccgttccccatgcatatgttggcttcaactattacctaacaaggaaaaacatcaaaacaacaagcatgagtacaggattcagcaaagcatatgaattaaacagtaaacatcacataggaactattctattgccatgttaaacatttatcatactccaaatgcaatgaatagctaactacatgctcatttgctcatgtcattacttatattggtattgcttgggtgaatgccagtcaacattcaccctctttcataacatagaaaagtaggcccatatgcccacacaaggtgggccttcttcataccatagatgcatataatgcaaatgcatttaacattaaatgccgacttactccattttcaccttgtaaccgttattataccaccataacatttccataacttcataacaagcattaatgatacagaaagaacaagaggcggcatcttgtgacattataatttataatcaccgcccatttactgtttaacaatatacttgccttaaccgcgtgaagatgagcgatgggtggaggtttccacttcttgattcgcaccacgacctgaacattcatcaaataacattaaaaaaacaactcaaaacaggacaggatgacaaccaaagagaacaacaatcgtgctacgtgcaacctgctagagctctgctctcaaaatcgtcacttaacactccgtccaaagtaaaatacttttcaggtaatagactaataaaagttcgctaactattcgttattagccgttgtccctagtttgcttaaaaagactctagttttaaccgatgattgctgttctgtccaaaactggacagttgcttcgcaagcacataaccgcctcattctttctccaactcctgcaacatttggttctgtgaagactttctagttatgagcccacatagccatcataatttataagggaaagactgaaactgctacatgtggtcatcaaattctaaacagcagcactcccaggggcttttctcccaaaccacctgaccaaaagtttaagttctaatactctacggaaagcttagagagaaatctacaacttccatttagaccaagagccccgattccccatgaataaatcccagatttcgaaacgatatatatcagctcataggtcgcaagaacagattccaatcaactatttgatgtctaaaaaaccttggttcctaagtgtaggtagtgcaactagggactaacaagagcttaccctggcagcaagaaccacaaatcgaaggaggatctgacgaaacccacagagaaatccccgaattcttccctttccccgtttcttctcttcttcttcttcttcttttttcccccctgtgttcttcttccttctcctttttactcctcttcctttccccccttctcttcctctctctccctggtcaggtggccgatgcgggcgaaagcagaatcagcagcccgcggttgagggcggccggcggctgacggcggagacacacggcgacgagggcgacggccggcggcgagggaggtggcggcgtgaggttgctagggtttgggtggaaccggcgagcacgccgaccatgggggaagggatcggcctccacaatgccctcgggatgccctctttaaccttccttttttttcttctctcttctatctttcttaaatctaacgcccaaattaatctgattaccatgaaatcagagtaactctaatttcatcagagtataaatacacaaataaaacaaaaaaaattaaaccctaaggtgaatctagacacacatatgtccagattcatctctagggtttgattatttttttcttgacagagagagtactcaactatatcgacacgaccgtgtttcttgatcggcgattcaagcgctctagcgtaaaaaggaaaaaaagcatgttttagcactttctcgttcgagttattatatgatgatatcttctctaggagtgagcaaggcagcgcagctaatggaatataccttgtaggaatcgaagatctgatccactcaggaggattccaaggaatgttctggtaacaggaagtgagagattttgttgaaactaatggtgaggagattttgttttgttggaaaggagagagagagatttgggggacgatgagaacgggggttagggcagagcggatgaaacggagtcaacaggtgccagtattacggttgagatcacggggctgtgctgcatggttttgacgtactagataaaaaaatacaaaattatatcaagagcataatgcatgaaaagaaaagcaaaagaaaataatgattatagatgtctaaggtttaatgttggttgtataccaagatgggagggtcatttggaaatttagtttagcattaatggtagggttacacgcttatactaatttttagaataaagcctaaaatagacattagtcaaaattcattataatagcacttcactcattcttaggaccagaagataagaaggatggtgacattttcaaatgcatgatcctcttaaccattagaatggactttattgaatccacccttgtatttcacttagaaaaggtcatagactaaaaaatgtatatatacatattatacaaactttatacacgacttcatttaatgaataggcaagtacaatattagtacataaaataggcaagggtttatctatatccgacggatatggattcagattcaggtagttcggagatagatgtggtattgacaatatacgtgggatgcggattattcgccatttcaagcggattatccaatagatgttttagtagactatccagcccatgcatccactctatttggcctattccacataaggcaatccatccataccatctattagttaatctaagtaacgcactctctctgtcacaacaagcataaccagaggcacgaggcgctagcattggcaccatgcgccatggtgaaacatgcaaaatggtctgttgcgccgcagacgcctcctaaggtcctcagcttctccctacgccgttgattgccaacctccaccgccaacgtcgtctctccatctcctcctccttgcagaagtccacataagagaattcggaaatcggaagtactcgaggtgaagagagtcatgcagtggacgctaccaaccctgcattagatcaaacgtttgtggaccccacccacctaggggtgaaaacggtacggaaactttccggattccagacttattttcgaaaacggaatcggtcggtcggaatttttttggaatttttcggaaacggaaacgaaatcggaaatattttctcggaaatggaatcggaaatgataagggcagttttcgtcggaactcggaatcggtcggaaacttcttggaaattttctcggaattttcggaaattttctcggaattaccagaaattttgtgactgaaataccctggattcttttttttaagcgctaaatagtgaataccatggtgtttggctgttattttttaaaaaaatatttgttatgcaaatctaaaattacataagaatattttttttcctacattgggatttatcaacaacattactcttttaaacatagataacttattcaattggatttattagtttgaggggtttttttattccgataaattttcgttaccatattcgcgccggttcgtttttgctccgttttcggtttcgataatattcaattccgttttcgtatccgaggtttccgattccgattccgaaaaaaatatgaaaacgaaaacgataaagatggtttccatccgtttccgtaccgttttcacccctacacccacctacccaatacataaggcctgttcggctgccattcttgcggcagcactgcggctgcagcgcttggttgtgcgaccgcagctgtgctgcttgcagctgcgataaatggtagccgaacaggcccatagagagcatgagtgaggtgaaaatcaccgagagtcacattcatccggctttcaaggttataagcaatgatagtataagagttaattcattatctccaatgcatcctaacactatgatagaaagggatcctctagtgtggactcccctctgacatgttcattaacatgtgggtttatgagtccatggacccacacatgtcactgaccacatccctctaacttcacgtcagaggatccctttcctctacatatagtgtgtcggagattggttgtgtttctaaggctatgtatttttccttacctttcccaatttctacactctagttttccacgtgcatactttttaaactactgaacagtgtgtcttttttaaaaaaatcaactgaaaagttattgtaaaaaaattaaactaatccattttaagggttttttttaaaaaaataattaatcattacactaatgagctaactcgttttttatgtgagagaaaaaggttcccaactcaatcaaacaaagacagcctgatgttcatgctcaacgtctgacctggtttgttacaagggagaaatcacaacgagacgaatgccatatagagaggtataggatgcagagacctgtttaacatagtcctataagctaataaatttaattttcttcaatgctcttactaaaaattggaaaataattaaattaaagaacttgcttgcaaccacgaacgtggtaaaccatacaatttcacaatcatgcattccatacaagaccccagaactgaactggaacctccaaatttcagtcaaatccgttcatttaacacaaccaagaacacaatttcaactgctgaatgctgatcaccattggcgcaactggacaagatagccacactcgaacagcatgcacgaaaatatatcagttgtaaacagccaaagagatcattgatattttaataaacatcatgcataaaccacgcaggttatcaagtcagttttaaggtccagcacaactcttgcacactagggactatgacacacaaagagcggcagcattacaaggtttgcgacaacataatagttattcagtattcactcatgcaccaacagaaacatcctgcatggtatcaaaagacccagcataggttacgcaaacattttggctttggttgctccaacactatgcttcagggcctaatagtagaacattatttcttgccgcgcagctttgttccaagagccctttcaagcttcccgatgatctgctggttcggaatagctttacctgactcgtactcctggatcacctggggcttctcattgatcatctgtttgcaaaacacaccatattttagttgaaggttagtgtatgtgcgagtggctgtggtaaaagttaatgtaacgctaggaaattctaaaattgtatggttggacagggcacctgtgcaagctgtgcctgggtcatcttcttgtccagccttgcttgcatgaggtttttcttcaggtcacttgagacacgctcatctagcatatgttgagaataacaagggattagagaacagtagaaataatgaaaaggacaagcaagtccaagtaatagattgaatttatgctttctcggggctaaactttggagataacacaaggacctgatccatccaatgaaattccatgtaaaaaaatcatcttttagcaaagaacagacagtcaaaattcctgtcttcaggcaattatatccgatggatgtttagaatgccccatcatttggttgtacgattgcttttgcacccatggtaaattttcatttaagatgtaaaaatgttcatatcaaatatatcttgtttaggcgcacacagtggcatataaagtcaacatagctcaataaaattatgatattgcatcaaagaagattatcttccatttagctgtttgattgctgtagatcagcaccatcaaagctacaaaaacaattatagagcgagcccattgaataagcaaacttacgatctaaatatgggcccaagctaggaagtaggatctaaagttacaccccagatttgtaaggctgagaccttatagtcatgcaagatataactggaacatcatctcatcaccctcatcgttcaaagtggtggtactgacctatcccatccaatccaattacatgtcacacccaatacaagcatatatatatctccaagttacgtgacaatcttttttggagcccaccagcatcagaggtatatatcagagggtcagagcaagtgcttagaagtatatagtgaagattcaaatagaattcaggtgcattttgttacaaactacagatgcaaatattctaacatgaacaaatgttagcaagaccaaataacatgtagaaaaaaaaactagtgatgtaccaactaggggatcttgatatgcacaacatggagtatatatatatatgaagttcccggttccgatttgaccattcatgcatggtgcacatacagacacatatatactgcttgtgaagcttgcagcatccatgaagatgatcataaaaggatgtatcaagaagacataggtccttacagtacatattcagcaagaatttgaataacaaatgtcaaggaccatcttagtagtatgatactcattgttcacagaaaatcaatattattaatggaatccaacaactgtgaaataaccatggaagaatttaagcaatttgaagcaagattgtcatgaagcgcaaatgtacacttcaatcaggccatcaatgaggtggaaacatttaggagctacaaaactagacaacatcatatatctatgtaagttatatatcaatatatgcttagaacataactatgtcatgagaccaataacctcgaaagagaaattgaaacttagtgatacatagtgattgttcaaacataatcagggctcgtcagtgacaaatactcttgacagaacaaacagggcatttggtaaaacctaacctagttcataaagaattgttcttgtgcccccaaaaattaaaataaaataagaccacattgatcaacctcagtatccaacagaagttttcctatggtcgtataacttttaggataaataagctcgcaagtcgcaaccaaaaagattattagtagttaacaaataagatgatacgggcttgaagatgactcacgggcaaggctctcggtgtcgtcatccagccgcttggtgttgagggatgtgccactggacgccgccttgtttgttccagcgttatctgtgcatagatcaaacagaaagaatcaatatttaagcgaagaccagaataaaagaaggatctttgaacaacatatagatcgaacaaaaccctcaaaatcagacatcaactccgcccaaaaaaaaacgaaatcttttttcccaaaaagagtccatcagtaataagcccaaaaacctataacctaaaaagaaatcaacagaaaacaaaaacgaactccccaaaccgaatcgatcgattccctctgcaccggagcggcagggatcgatcaaatccagaagaaaaatcgcacccaaaaaaaaaagaaccccttcgattcaaagaaaaggagagggaaaagcgaatcgaatcaaatcaaaagaaaagggtaggagggggtgggggaggcagtagtacgcacacttcttcatggtctcgatctcggcgccggagcggcgggcggcgttgacggccttctcatccttcttggcggcggcggtgggcgccttcttccgcaccaccaccggctcccagtcctgcctgatcggaccaatcccggccatctcgacgagacgacaagaggaagaacaagatgaacaaagaaagggttaggggatgaacgaacaaggaagaagagaaggttctggagtcgcaattgatgggcacaccccccaccccacccccgggccgggatattatatccactgaacgcgtagagtccgtgaccctgacaggtggggcccacctagctttgggaatccacggtgggaccggcacgacaagtctgaatccggttttgtttctctctcttgttttttcttctttcgttagcaattctttttttttcttttcttttctgaaatattgttcgcataaacacgaatacacatacaacaagtacactttatttgagccagtatcttcgaactgttggaactgagggactgtgcagattgtagctaaaataaaccttaacaatattgtcaaaatatataaaaaatggcatcaaccattatcaagttttggtagaatttcttatatatttaccaaagtttagcaacaaactaaacgtggtatggctaaaaatggtatcaatctgaccagcccctaagcatcatgttttgagattaataaaaccattacagacatcttgttgtcgatataaacattatttacctattaaagaatagttagagatgaatacaagtggccaagattgaaaatgaaagtcataagttttttcttcgcaaacagtttggttttatcatgtgctcatgatcaagtcacgggtcatggtaaagtcataagatattgttgatgcccaagggatagaacttgacatgtgcaattctaattgcgcaggataatggtttccttagcatgagcagtgataataatgttattagtattcaactgctatactcaagtcattaacatttttgttcataaaagtggaaagatgcttccgtaaccatcaaaaaagagaaaaaaaaaagaatcgaaaaagaaattgattccgtaaggaatttctacactggcgtcggtagcaaaggaaagaaaagccaaaaattcaagagaagtataatagaatctgctttaggccacttttcgtaggtaccattaatttgggccagctctacaaatctgtttgggccaagctgagccaaagcacaaaggccgaagagagaaggaataaatctacttcacctccctcagctcttgctcctaattgaatcgtctcccacaaccgtaaataccggctataacatctccccaatcttcgaaaaccagatcaaatcgagttcctcgactgtttgggtagcggtttcgtcctatgtggctctcatatgggagtcatcggagctagtgaagttcgtcggcgtctagtgacatgtgggtcctatgagtgacacgtaagacaaacccgctattcaaacagcctaagactcgatttgctctggttttcaaagattaagggggcgttatacccgctattgcggttgagggaatgagttgaaggatgcaaaatagacttatttgaagagagaattggtcaggctcaaatgccattattgggttcaaggcccatagcaaagtagacagtaccacaagtgaacagccgccccagtcgcaattacagtaactaaatgatgcctcacactttactgtaggatatatgttagatattggagaaatgatgaaatggtttagattgaaatattataaaaatgatgatttagcatgtatgtgtttagttttagaatgaaataaattgtagatataattactatactagaaagtaaccgcggaagtatatataggccagcacaattgaacgcggtttatttaattatcaagtcttatcatcagctaaataaagcattaatcatgttctgattggcaagctcatattgcaagcccgaaattcctcagttctcctcgaattacacgattcaaagtacgaagaacgtgtcgaatgaattctttttctttagaccaacaatgcaatttttactctaggtacaagatatacctgtatactccatctcgaatatatgcaattcttactctaggcagcctatacgttaccctgctcaatcatgactcaaaaaaagttccgagaacatgcaattaatgcaacaattaatcatgtttgtcattagtaaatcaaatacaatatcaaccacaatgctttgagtaagtaatagctctttgttttcagaaaatccaagtttttctcacacttgaaacatcaagctattaaataaaggtgtagttaattacctggcgctattcatctcatcccgaaatctgatgaacttgtagatatgattgctgcactggagacggcaataatttttccaaaaacatttgcaaaaagaaatcaatagagcgagacaatgatgtgaacaaataatatcaagaagcaagaaagggcagaacttaaggagtgcagtaaataattcatgtacagaaatcaatgaccatatggtaattgaatgaccttggatgggaacattttcactttctgcattggacattgaaagatcattgtcttgtggtagccctggatgaattctactttgttaaagcataaacacaaatccctgtagcaaaatcagagcaacttttaaaagcttatctcagtttgagcaacacataagatgcgcggctagtcacccccctcccccaccgcgcgactggacacgtggcgtgcggagagggggtggggggtgaacagtgtgatttcctttcttttctttccccacttctttttggttttttatacaaattttgtatacaagtatataaactttgtatacgtgtatatattgttttcgattttttatacgcacatatacaaactttatatacgtgtgtatacatataaactatatatattgtatataaatacatatgtatatattttatatacatatgcataaactttgtatacatatagaggg

SEQ ID NO: 59513 - DNA, 12818 bp, Oryza sativa
tcaaacatttcgaaacggagagagtatattttactagtagtattataaatctgaataatttgatttattttgggttaaaaggaatacatgtttaggttcgtgcacccatgtttagtcgtaaactagctgcactagtattttccagacactgttgtgttgggagtattccgtacaaaagtaggtgtttaatgaaatataactagaattgtaactggtgaagagttgattagagttgatgcctttggtgttgtgtcagcgtgcgcgtctcactctcacccctgtcggcatttggagtggccaatcatgcaagcgtccatgtacacaaacaatctcgacgacccaggtgaagacttggaccgggcagcggccttcacaacttggatcattcggcgacacggcgcatcaaaatcattcgtcgactgacagctatatgctcggacatactatatgcgcacacacaacaaacggaatttaccacaagtcgctcgagtggtgagtttggaattcttgctagatatagctagcttcagccggtaacgaaaataagtaatcgtttcttccattgctacttttccacgtgcagttgccaggttgtgaacttatcatgttgctctctcgagtcgccgtcgtagactgagtaagagtaacatatacactcgtgtgctagacattttgaacgattttcttagaacaggtggagcaaattactctttaaagaagatatataaagtgtcaagtaaaatgacagctatctataaaaccatacgaaataagtggagcaaattacataagtgtaaatgtttataacatttcgaagaaaataacctcgagcgaacacgatgacacgacgagcggcacgcttcctcttatcgtgtgtgtaaaactgatcgagacgccaccttcgtgagctttcctttccgaaaacgacacgagcctaaaaaaaggcgaagtgggatgcgagagaacattccgtatcgcgcactagtaaagagtgggtcccacagacaaggcgacctaaacgtgggccccacagaccccatggcccacgtgccagtgacgcagcggcacacgcggggggtgggaatccagtccggtcagactccaccatctgtcgtttagaacctcccagtggggcccacttgccagtgaagtgggagggcctcgcagtggggtccacttggcagtgaggaggagtggggggatggtggtctccacccgcgtccccccgcgggctccgcgtggtcaactcgccggaagccgaaataggcaggcaggaggccgcccaaaaaggcgaacaccttgcgcgcaccacgccaccacctccacctccacttcgctcgctcccgctctcgccatggccgccgcgcccgcgccatgaggtggccgccaccgccaccgccacgccactcctctcctctaccctgccgcgcggtgctgtttcctcgtccgtccccatgctcccgcgctgcctcgtcgccgtcgcggttctcctgctcgtcgcgtcccacgccgcgcggggggaggagcggcggcggctgctgctcgcgaggcaggacgtgctcgcgctccacggcctgcgcgggtcgatcggggtgcgggcggagtactggccggtgaagcgctatccctgcagctggactggcgtcgtgtgccgcgccgggcgcgtcgcggagctccgtctcaccgggctccgccgcacccgcgcgggtgcacggagccaggggttcaccgtcgacccgctgcgggagctcacggcgctcgaggttttcaacgcctcggggttcccgctccctggtcggatcccggcgtggtttggcaccggcctcccggcgtcgctggaagtcttggacctccgctccacctccgtcaatagcacgcttccagccgatcttggcatgtccgggaacctgacgacccttgacctcgccggtaatagcatctccggctcgattccggcgacattgttcctcatcaagggcctcaaatttctcgatctttctgacaacaatctcaccggggagctaccaaacgtgtctatctctgccggtgatggaaccggagttttcaacgcttccgggaattcgttgtacggtgccattggagatgtgcttgggcccctcaggaagagatttcgtcaggttgatttgtcgagaaattacttcactgaggtgattggaactggatttgggaacagctccgatggagcagtggacataaacatgaattgcttgtccggatcaagccagcgaagccagggggattgtgaagcattctacaagaggattggtgtttcattgccagagccaccaaatgcattgccatcaccaagcaagaaaggggtgaagtggaagtatgtacttgccggagtcctggcagccgcagcatttttggtggttcttttccttgtagcattagtgttctgcttgatgaagagtgggggacggcgaccgagaggaagagggttggagcagaatgaggaagggattcgttcggggcgcaggagtagcagcgttaatcctgtgatgctgtcatccatggcagcatcaccggcagcaaatggtgctgtgaaaggtctgcctaccattgtagatgagttcacctatgagcagttgcataatgttactgggggttttggggatgacaatcttgtcaagcatgggcactctggggccatttaccttggtgaactggagagtggcttcaatgttgttgtcaaaaaggttgatctgaagagcagtaataagaacttgggggaattgggcttccttgcaaagaattcccatgggaggattgttccattgctggggcatttggccacagatgaggaggaattgctggtctacaagtacatggcaaagggagacttgacttccgcattgcacaggaagtcagtggatgctgaggaggggctgcgctcgttggattggataacaaggctgaagattgccattggtgttgctgaggcattgtgcttcctgcacgatgagtgtagtccaccattggttcacaggtatgcctagtgatattattggcctgttagctaatttgctaatataatgtgcagctgattggtttatagttagtgaaaatattttaattgcaaaaagcatatgataactgtgctaagaaaagtttgaacattaacgccatcataaaaaagagcgcggaagttccacatgttatttagctcacatgaattgccaatttaatgaagaagctgcactgattatggcaagtgcgtgagtgaaagaaacaggacaatttaatatattaatttaaaactgtttctagttacacatttgatagtcttctacttagcctcttgtggccctattgcatcagttggcccactatttcttttctaagaagtatagctgaaaggggaaaacaatatgtgcgaagcttccctgacaaactgtttacttgtgaggacatgaaatcccacatttaaaatataatattatacggactatttcaccaagttgcattggatccatatcagcactaccaatactatctgactgtacttaattgatttttaatgattttcccccagacgaactgcttgcctttctgaacttttagaatgttgcttcttgttattcatgtgcatatggcttgttcacaacttctcatgtgcaatgtatcgtaggaaatcaggaaagtttcatgcaagtataagtactgtacagtatgtataattcattatatgattatacactgtctaactatgtgagaaactcatgtctctatcatgaaaaaaaattgctgcagttattttatggaaactttatcttttgaggtttagtgtcatcaatcattgtaggtaactcaatgcactaaatatcgatgtatttggtgctagtcatcttttattccagctgcatgacttagctgcttcatctttctatttcattttattttactctgcagttcttatttgatgcatgctgttcaagttcttggatgttttaattactttcaagccaatcttttttccccttatcttttcattataactgtagagatatccaggcaagcagtgtgcttcttgatgacaaatttgaagtgtgtcttggaagtttgagtgatgtatgcactcaacaaagtgagggaagcaggagtttcttctccaggatgttgagatcatcgaagtaagacttttatattttatcgtctcctcatttttatgcatgagtttagcatgggtacaactgttcttatgatcttaccaattgctctgaaaattgagtccatcatggcatattccttttaaaagaaacttgattttatgatcacctgaacggtgctaacttaagggtgcctttagcactaaaaagtactaagacaaaagcaataacttctttatgaagttaacactttaacctaagtttagttattgaactgaaggtaatgtactggattttgttaacaaaatatggcggcagtgttttttttttgggtttgagtatgtataaggggacacatattcatttgtaagtgtttctccttacatgaattcttgtcaaatgacttctaaaaaggaagttctcatcaagagttagtcttgtaaattaatggccagacccacacaaataaaagaagaaaccctaccacctgcagatcataaaatatggcaacccacttgttattttgttaacatggcaacatcacgtttgctatgaaactttagtctttgtttaaatctgtaaagaacatcggggccttgcttaaacactgatattcgtctctttcttgtggcaggtctcttgacaagaacgcatcaggtgtgtaaagcttctgcataacttttttatggatattttataatctctaccattatactatacagctatttgtgtaggaattctaatgcgcaaaataaagataacctaacattactgtatgtatctctcacctaacaggtccaccagctagctgctcgtatgatgtatactgctttggaaaggtgctactggagctaatcaccgggaattttggtgtgagcggctcaaatgacactggttcagaggagtggttggcaagaacactggattttattgacgcccatgacaaggagggtctttcaaacattgtagacccttcacttgtagtagatgaagaccacctagaagaggtatgggcagtctccattgttgcgaagacatgcctgaacccaaagccctccaggcgtccactggctcggtacatcctgaaagcattggagaacccgctgcgggtggtgagggaggaattacagtcgaattcatcactcacgagtacttcatctcgaagctcttggcattttgcttttcatggggactcgcgcaggagctcggagctcaggccaacattggggcagtcagccaggaagcagtcagtgaagtcacaaggaagtgacgaggatgaggacgaggaggaggattcattctccttcaagagggcttcaagggagattctccctgacccggtagagttggaaaaggatgcagttgtgtagaattcaccacagattagcaatacatgctactgagatttcatctcagtgtgtataattcatcctctgatgcgcatctcctgatgcctctaggtgaaaaaactgtgcatataggagttagacttgtttctctttttccttttcatttcagtgttgtgtaatctgtaactgagattttgagaataagtggagcacaagggtgcgcggtgcttgaaatgcaagcggccagaaattttcgtagacaaccattttgtcattctggactctggagtgtgaatcgaagcacaaattttatagtgtaagccaaaggatcagagagatgaatgaatcgatctgcgaaatgaaattatatgttgctgatccagtcactgccgcctgttacaagaacattcttcctgactattttctgggttttctgttctctgctgcttggaagaataagattgttgtctgtgttaaaaaaacacacaataatttagtttcatattactacagtagaaaacaataagttactcgcgaacggatattttagcactaaaagagaattaaagaaaaaagggggtcccaccgagatttgaactcgggttactggattcagagtccaatgtcctaaccgctagaccatggggccattttgaacacacggatttttaatctctatatatccatacttgcatctagtctagcatgggccccggcccatgatacgttcacctgaaagcccactcatgcgacgacttgtcaaagcccaacaagcgaagaagccgatgcttatagaggaagcccggctaccaccacgccaacgcgctcatttcgttcattctagggtttacaactcacgacctccgccgccgccgccatgggacactccaacgtgtggaactcgcaccccaagaactacggccccggatccagggtttggtaatcctctctactctactcgcgatcccccgcgccgtgttttcattcagttcggtgacgaaccataggagtatttcttctatctgtgtgcgtagcatcgggtcagatttgtcagattttgtggcgtgaattcgcatgttgctagattttatactgtagtagtttatctcttgcttccggtagaaaggttcgtgcgcccctttttcttggattgcttgacgagtgcttacggatttgtggtgtggatttgttgttgcagccgtgtttgcggcaacccgcatggcttgatccggaagtacgggctcatgtgctgcaggcagtgcttccgcagcaacgccaaggacattggcttcatcaaggtatactcttcatattttttttaggttgctagttgcttcctgtaatatgcaggctcaagttagcagttttactttttgatggtgaaattgtttggtgcaatagtgttgcatcccgtgtgcggtgttgtggtagttcctaacgacgtagcgataatgtcacaaactgtgccgcgttgttcctcttccacgttttatttcctgcttgacagcttgtgtattgtgttatccgttgtcgcctcatgttcccattctcattttgtcagttctgttctggtcgagctgatatgaataattacagatcataagatggccagttagaattggaattgatgcacacactgcttttgtttctgagattatcttttgcagatgccaatactataacaatattagttaattttgaaaacctgtcttatttgttatcttcaccacttatccaacatagtatgagtatgtgccatgtgccccatgtgagctcattagctatcacttgtagctgccttctaaatgtcaacacttcaaacgtattgcaaacatctctctgtagttcaacgaataataggaggatctattgctaatcaatagactacaactatcatctttcatatgggttcccttcttttatgtttttcctttttgatatgttgcttccaattaaagcagggtagtttccttttgttaaaaaaaagttgctaaccacaattcaaaggctacctcttgcttaaaatattaatgcacccgatttcatgctagaattgtggagatgttagaattttccacatcgtctcatcttattgttatggaatacttgaatgaatgtggttatttacttattttatcgtgcagatgtaatgcacccgattttatgccagaattgtgatgttagaattttctacattgttttatcttattgttctggaatacttgaatgaataagcggttatttagttatttttttgtgcagatgtttgtgttatctagctttttgctgttattttaatccctggacctctcaaagtgcatcttattcatttgcagtaccgttgaaagttgggagctcaagtggaatgggagcttagatcgggaaaatttttatggaagtgtaaaagccttgtcgagtattatcccttttgatacaattgtcgtcttatgatatgtaacagattattgatatttgaaagtgagttatggtctgatggacaatacatgttctggtattaattctcatattatcgagcatgttctagtgctgtaatagaagatgattatatgctatcttgagtagcaagcttcccttatttctgatgctggcactttgacccttaaccggtctcagcttgctttgatatcttatatgctttattattagattgttttgatagttcaggctgacaatttggccgggtacaataggcaacggccattcggccaacggtgcaaaaatgccaggtggcactgcacaaagatttcaactcgacatatgggacaatatggagatatttcacagctggatagagtatttcgtctaatcttactgtgttttctacaacaaacagtaaattgatgggtttagaggtgattttttaactttcgtgaaagtatagggtataaaatggaacctgcgaaggagcaacaaatcttcaattgagcgtctgaacctataaacaataaactaataagatatattagtataaagaataatattgatactataatttactctttttcccggactatataatgtactctacgatacatgtttttttagataaagtttattctacacgttgtccaaacaatattcttgtatttccattaatgccatggtagagtatcagacgagccgagctccaagcctcacatagcattgctcgagccgagctcgagcctaacaaccctcaagagttcaatactaggatagggcgataggctccagagccccgactcggctttgagcctattcaggttggctcgctcgagctcggctcgttcaccgccctttggtcccaaattcccctccgccgctcaccgccaccctctccatctcactagctccggcggcgagcatgccctagcttcgtctccatcgcaatcgcagcctcctcgagcaggtttggatccagaggcgacgccgccggcctccatcgcatcgcggttcgaatcgaaggtatttcattcttctttttctctagtagctcttcctccccctcgctcagcttggattgaacatccattcagaattcgattgttgtttgtttcaatccaattaatccatccagtttcctgtcgatttcatgcgtgatgcagtactaatcgaagcaatttgtttccaggatcaagaaaaattgggggttcagctgagctctatgccccaagtgaggcctgcctctgccgagaagccgactcggcaatgggcggcatggacacgccaagaggaacagagctttttcaatgcgctgcgcctggaaggaaaagtaagacgcatcgatgttatgatgctacgctgtttcttgcaatctgatcaatgtgtgcgctgatcgatagatgcaacaataacttttcctttgtgtcagaattttgagaagatcacgctccgtgtccagagcaaaaacaaggatcaggtacaccattttcggccaagaggtgtaagatgttcatatgatatttaacattctgtattgatacgttaggacgttgaagcagtggtagatacacattagatcataaatttagtatttttttatgatatttgtcgttctttatttaaccaattaggaaatttgaatgaaaggaagattcaagttaggctgtaaattttagttctacatgcaatgtgctaaataactttcactatgatgggatgccaattagaattgaataaatctattttgctttgagaaaaaaaaatcagaagtaactgtcatgggcaaatctcattttcaaccatggtcgttgttgttgcttgacatagcaccagcatcctgtagcatatacctacattcttgctgattttcgtggttcaactggagaaggctgcagggtggatggattacaacatccctccttttagattcccatccagattgtgtactttcacttggagccgatttatcttcctcacttgcaattgatccctcttctttactaaagctgatttcatctttttttcaagtttctattgatatacttgcagccgatctgttatgggaaactcaaacttcagaacatgatgttttttttttcgggaatacgccagaggcgaattttttccattaagagaaataaaggttatttacatttaaagaaagagcagcaggggacagggactggaaagcattacaaaatcaaaggcctaattctcgcagcacattttggctaccatgattctctcggaagagtagggcggggattgctgaattcgcttgacgccaaagcgttgcctcttgagccatttccctcgccacatctgtccatgccctaaaactttggttgaagactctggcattccgctccttccagatcgtccaagccacaagtgttgctaccgtatcgaaactccggcattgagacttgagactctcggattttcaaccggctgctacacagccactggttgaaagaagtttcgttcatcggtaggcactccgggtgacctattgctctcaatgccaaaacatgatgtttagaattggcactaagttttattcaggctttagatgtatctcgatattatccccctattttgtccatctttggccataaagcacactcctcagcagcttaccacctaagattctgcacctggaggctggaacatttagagaggaattttcctgcactgctcgttcctgatcatctaagcatgttctgttgactatgtgggcactggacatgcttaagtgatagctgccaataaatcagtacagttttctctctgatacatagacacttaattatctctcaatcctcacatagctagcataagtatgttcatcatatataaagttatagataatatttgcatcaattagagaaaacctgaatttcttctgttggactgaaaattcattgccttttattttttgcaatataggtcagacattattactatcgtcttgttcgacgcatgaagaaacttcttggtcctgagttctcacttgatgcaaaaaattcaaaggacactgttgctgctatgctccgctggtaacggaatgaatgtctgcatgcaaattaatctgattagatgtggtccctactgcttgatattatttatataacatgattgcaaagggtagtgtttggcctcaaaaatttgctgagctatcttcatgatatatatccttttcctagtaggctaggaacctaggactgtagtaggtacgtgatccttttaatttacagaggacacgtctataatttactgctataatgcctagtaggttagaactatggggccttcataccaatactgtatagacaccttaacatatttactgcttctgttttagattgtcagacctgtcccataaaatggtctctgaaattttggtggcatacttcgtggttcagaatattcttctgatgaaagatatattttttatttccatgcagattgcattctagtctatgcacaagaaagatactgtctgttgtttattgtcattgcttttgatttgatctgatgttgtttcttttacattgcatggaaaactctccgatactgaatttgttctatgcaggtggtctctgcttgaaaaatttagctgcagtgcatcaaaactgcatctgaagcctcggagattcaaaacattcgtagaagcattggtgcatgaccatttgttactttcccactcctttgtaactgtaaaaatgttcatttttgttttttttttctcatgtgatatatccaactttatagggaaatcaactgctaaaggacaggaataaaaccagaaaaaagtgtccacgaggggatgagtgcctttcttcttcatctccaattctgaacaggactgctggaaatgaatcttcctcagtaaaactcctacctgtggatgtctcaaatggtagcaaagtagcatcttcaaaaggggcagttttcaagaggggtgcagaaccaaattccaataacaagtcaggttcaactaaatgggacctctctgccacaattactgtgaaacagaaaaggagagcaggtgacactgctttttttttttttggtttcatgtggcacaccctttacttttttcattttatgcgatatgcagtctgtatgtcttagctaaatgtcgataatccaataaattttattatgtgagcttaaagtgtcgaattttccttacaatagttttgagagcagtggacttgtattttaggtggtggcattgcatctactgcatataaaaaatgggagagagatgccatggctggtgtttctttagtcgctgatgcagctgaagagcttgagcgcaacacagtgaatgttgatgcaaggacattatctccctcatcaaacaatgtttgtaccgttgatggtattctttcttatcactgctctctgactagaaatggctggtactggttcctattgtcttgatgttttatcctgcactggcagatccaggcacaaatcgtatgaatgaagcagatcaacaagcacctgcaaagctgaaattgcagttatttccaatcaatgaagccacacgaaaggcattggaaaaggtaaatatgcctgtttgttgccaccaagctgcaatatgaaattatgaatcatgtgtttcctgcagcagctgtgttagcacaacagctattactgatttactattggctcggacactcaaatcactgtggttgataaaatttctcaggataaatgggactaatggaatgtggagtgcaaataaccttactagcactatttaccttatgaattttcgatggtgtttgagatattgatagtcctatcttttttcaacaggatgaacataatccacatctggaactcacagttagcgctaggaaaaaaatatcttctgtactag

SEQ ID NO: 59514 - DNA, 22020 bp, Oryza sativa
gatactgcatccggccccaccgcccgtactccggcgggatctcaccggagaagaagttgccgccgaggtgcaggtggcggagcagcggcatctgcaccacctccatggggagcgggctggtgaggttgttgttgtagaggtcgagcacccggagcccccggaggcgcgcgagcgccgccgggaaggagccattgaacgcgttgttggagaggttgaggtaggtgaggaactggagccgccccaacgacgccgggatggggccggagaaggcattggcgccgacggacagccgcatgagcccgcggagcccggtcagctccgccggcagcgcgccggagaggttgagcccggacacgtcgaggccaaccaccgcgccgcgggagctgcacgtcacgcccgcccacgcgcagtgtgccgcggcggcggcggtggtgttcgtcctggtcccgttgccgccccacgacgccagcgcgccggtcgggtccgacatggcggccttcgccgccagcagcgcgtcggcgtcggcgtcggcgtccgccgccgcggcggcgacgccgacgaggaggaggagaaggcggagatgcattggggtttcttggcttcttggattggaagagaggagaggggagagctcacgctcgcggcgaggagaggagaggagagtggagacaagagagtgagagggagtgaggggaggagggaaggggaaaggtgggggtattttgcaagtttgctatggttttgagaacactacacacaaggccacaagggggattgtgtgtgatattggggtcataaaaaagatgtgatatttttcttgttttcttttggggtggggtgatgtgtggggtgtggttcttctttttgggggattgggttggttttataatgttatcttgggtcttggatggatagatatggccatatggcagtttgacaactttgacccatgattattctttgttttgttttctttatcataaatttagtatgtttttttattgaattaacctcatatttaggctgagtttcagatgttgtttggcttctacaaatactctattaccgtgatcatgttttttaaattgttaaatggtatattttttaaaaaataacttttatatgaaagtttatttagaaaattaaatgaactatttttaattactaagactcaattaatcatgtactagtgacttatctcgttttatgtatcgtcatttagctaactcagtttgggtttatttatctgttgttcgatggagcgagtataaattaatggtagaaaattttgtatacataaaaaatggtatgtgttctatatatgataaggaaacaaaactacttgaagttcattctaatgaccctgatttttgaagcatttggtgaaataggcggtgatcggttgtgctggctataattgtgcagcacagccgtagcaaagggaagggctgcagcagctgccatagctagtggctgcaacagataaccgagcacgctcgtagtttcttgataaatatttttttctaaaaaaaattggccgctctaacaatcttccaaaatagaatgcacctagttttaaatgcttaggtgcacaaattctacaattcctgcaaattgtttattgtggattcttactatccgaagcatgtcctacgatacatatatagctgccaagagatataataatttgataaaaaaaaactaaatatcacctctcaatcctttacttcaaaataaatcccaaagtaaattactgatttactgctagctaatataaaatgaaatatccatacctgaaggagaaaactttagaaaaccagttatttcatagttaaaggtataaaacaaaccactggtattatgatgtatggcaatataacctcaagttacatggtctcaatgtttcataaaacctcacttttattcaaatcttgataaattctagcatatatattaaaaattaaaagtaataaagaattaaactgtcaatcttaatcaacaacttaataattaaaaattacatataaattctatgttttagaattttaagtaaattcgatctcaaaatacataagggtagtattatgtaaaactttataaaaccatcatacctgaattatgtgtcatatatcataatacatatgatttctctaactttgaccataatacatgtaattttaatgaatgtactcactctggaaattacacgcaaaatcaggattcagatacaccgcgcatgcgcgcaccaaacggataccgatgaaaaagacggggtgacgaatgcaatgcgatggcagcatggaagtggcgcgagccagcaaaaacttcaaagaaaaagaggaggaaaaaaaaaaagcaaagcttcagagcaacggcgagacaccggcagccgagctgctttgcagaatgcggcatcaggcttccactttcgtagtagggcaagcagatcgacagcgacgcctgcacaaaaactgcagcaaccaaaaatcatcacccagcagcagcatagcacggtacaattgagggccggatcctaacctccggcgaatgccaattccatgaaatttcagtcgaatttgttgtttcaaatttaatttgtaaaaaaacagtcaaaatgtcccactgaatctgcttctgtcccgactcaaaattctaaatttttgttgttttcgatcggttttcgtctaaaatgctacctagtacagtactccctccgttcgaccgttccgcaatagttatagttctaaattgtttagcaaaaactatggtttaataaaaacgtctatagtgcctcctattaaatgatatggggtttggaatgagaggatagctgagggcagaatgaattaaattttgaattggatgtaattgatgtgacaaaagttactctaaagtgatagtaagtttttggtaacaaattttgaactctaaaacgataactgttttgagacggagggagtataatccaacttctttttttctgatttctatttttgccaaatcagatgcagcaaacaaacagtgcgtgataatggcactgacgcagagcagctcattgggcttcaagcccggacataaccatcattacgccgcaataatcacgctaaattccaacgcggaaacagcacaagcagatcactctccgtgcacggcaacaacaacaccagcagcaacactcccaagctgaagaagagcagcagtaataactgattagaggacaaaaacgtgcgagagattgatcattgatggccaccgtccaatccacaaaacaatatctcgccggtcgccggcgccggcgagatcggtcggctacggagtactgtagtagagtacagtacagccgctgctgctgcttcttcgcaagctgccggctgggccgcattcatcactcgccgcagaaaaagtcgcggccacggccggcgaatttacaggcttcaccaataattttgacccttcaggatggcacaacagtgtgtgattcagatactgctgtttcctactgcgagtacatgctgtgtatctgcttgtagtgtgtacttctccagctacggggatttcggaggattgttacgggctattactccatctgtcctaaaatatgttaacttagaactaaatatgttgtaacataatactccaacgaatatagataggaggttgtccagatttattatacttcgtattagatatatattttagaacaaagaaagtactaattagtactcaccctatcataaaatatagaaatctagtatcaaaacactagtactatgatctggagttctggacataccagtatgctcaattcaatactacatttttattttttaagacgaaagaaatacatgtactactataggttgcaggcttgcagctgtgcattgaccaactgacaatttacatttaagcggctgcattcagagcaaatttataatccgcaacgataatcttgattggaaatatggagtatgtttgtatttgttttgttcaggcggagtattgtattattataaggctgcatttccagcagctttataacttcaccaacaatgttgacctgcaggaggaaaaggagtaaaatcgcaatagtaccgtgagctgctgtccgcaattcatcaatttttttcagagccgcagttaattttgcaggccttggtgtacatatcggcgtttgcaagaactggccggagagcttgaccactgcaccctgaaaactaaaaagtccatcttttttttcttatctaaaagaatccatctttaccaaccgcaattacagtttttgttactgattttgattgcaatttcagaacttgatcaaagtgagggcccatgagagtaatttactcgttgctctttgtccagtttttcttttgcagattttttttcagaagtactccagtgctactactgctttactcgagcaggtaggcagagggcaggcagcgagcgtatcattgcttttctactgctggctttcgttctttctctgacaccgtggggcccattcctgcctggcactagatgagaggagaggagaggacagtcaaattctcgagcttgcccattccctcgcagcatcgcaatcgcagcggcagaaaccatctctccatttcctcgcgtaattccaagattgccagcttacttcgctgttctattcctcggggtgtgtttggataatgggttaagagagatgggattgggaaatggaaatgaatggatggataggatgaaatgaaatgagaagaatggatggctaaaattgaaacttaccttttgaggggtgggaaatcatatcccaaacccattatccaaacatggccttagagtttcgccattggcgatgactaggcggagaggagaccaagacccgcggtaaaaaaaaaaagcactccctttttattactgcacatatttactgtggtaacatccactgatccagagttaacaagaggatgctaatggctccttttgaacataggattttttataaaaaaaacaaaatgtgaaaaactatagaaatgattgtttggatggaatgaaaaaaaaaggtaagaattagatgagagaatagacataagagatttttttaaaaggttggacttcattttaaaactcctttaaaaccttcaaatccctatattgcgagccaatctgaaggaattttataggatttttgaatagctatgtttttaaatccaaatgctatgtttttaaatccaaatgaccatacagagtttctttttctatataattgaatccatttaaaatttcttcccaaaggtagcctaagaattggagtgatgcatagcttaatctgatgacgagggatgcgcgtatttcagtcgtcagtctaccaagtttctgcaactgcaacacagagaacaccaagaccaacaaccaccacttctgtagaataaccttttctgtctctcattttaatcaatggctaatgaactgtaagagcaggtacaatagcaggctattagccagctataaatatattttaataagataaacgatgagagagaagagtagcgggctacagatctgtagccagctgcagcatggactccaagacacactgtatgtatgacaggtggaaccatatattaatagtatagtaagcaactattgtatgaattagctattatatcggctatatatgaattggagctagtagtgggctatactgttagacttgctctaagcatagatgctaaacagttgatacgtgggcaactgggcactgcataaagaaattgaccaagtaaccacaaaggctgagcttcacagctcaaaagaaaagaaattaggaaaggctaggacctgcagagctcgtttgctgatcaaaagtgtacaccccttaatcaccggggattaataacttaaccccaatgatgacgatgttctattacagtattcccactgttattagatctataaagtttaagagtatttcactatggtgatgtaatcaatgtggtcttttagcctatcagctggttttcttttaaagttatcctttttatttggataagaaagtgttttatggtatagttcaggatgtaagacatttctattatctaaaacaattagatctttgaagtgtggacatgaacttgcctctatcgaacgcagattcagtgacattcccccatgacattctcggtgacattgtgtcactgacatatgggtcggtgacattgagtcactgacatataagtcccatatgtcagtcactcaatgtcaccgagaatgtcacgagggaatgtcaccgaatcccaatccctatctttaagctgcatgtgttgagttctgaagtctaaactccggaatgatatattgatatctttaatcaccttcagataatcaaatgaactcaaaatcaaaatgtttgtgcgtttttatgggcctctgctttagtaaaagaaaggtccagccaaggccctttaccccacacagccatgtgaaggagtgccttgagatcggtgaaaagaaacaagagaggagattcagagattctccctgctactgtagtaggcgaccatgggtgaaaaatggccccaaagcatgcagcctctaggtggtgagtggtcacctccatcaaaaacctccatggattcttctgatcttctcctcctcctcatatggtcccttgttaattatctcaatctccaagtgttaatcatgtggtactagtgcttacccccactgaacttgtgtttgaaacccattgaatgaactgaaggttggggttgataaatggtactaatgcttgagccaaagttttcaacgtagtaatgatcaattatgtccttgattagggtgtgcttgtgattgtgttgtttagagcctaggtggaagtaaacaaaagtgatggcgtattgttggcctagcaaaataaagtaaaaattgtgctttggtgtgagtgagggtcgccacttgcaagctccgagttgggtgcaatttgtcccccttgccaacccctagtacgcattcacactcatagagaaattaatggccaagcattctaattaatcagataaaagacatggtttatctgtggctaattacagtaatttccatcacattttcatgggacaaattgattaagtaaattactataaatttttagtagcacgatgcatatgcaatgaagccttggcaattgtgacaaagacgtggttccaaggaagccgcgctgttacgtacggtaggtgtctgaattctgcaatctgcagaatgcaggtggctgggctcccagaagaaaccctgtcgcatgcatcacacttatctcactgtctcaacgatagtggctcactaggacaggccaagacgactaacagctaattaaactgctaaaatgaacgtgacgcatgcggacagtgctatcaagcttctaatcatgtattcatgtactatcctaattgaagcctacttattgataatgcccatagtaaatttgatagtatcaataacattcttcatcgcagtatcacaatttggctccatattagactagaggccgggagtgatatcaagatggttatcttgatttcaataaaagcttgctttcttttttttaaaaaaaaaaaaaacttggctccgtgttaacagtaaaccgaagaattgacagggtagagggatccaaaacggccccaagttcttagcaattgtgcagtggtgcacacgaagttaacagggccttaacctgtcagtcattcagttaagaaggtagccagactgaacaagccccagctggctgtcattgtggatatggcatttggtgcagttgcaatgtgctcgccgtgctgcagctacagctgcagcgtagcattcatcaaccagactgagagagcatgaatgaattgagcatggcaatggccgggaccattgcttgtgggttaccttaccagcttacctgagctgacatgaatggtggtctccagagtaggtgaggtgagtgacgcccaggaggttattgaatgatccggaggagatggagatcctacctgcaacaactagcagcccatgcacaacacatgcctgtgcccatcggccatgtgtcctgttgatcaatccatttatcagtgtggcaagaacaattaacatgcacatgccttgcattccagaagagagcacaaagttgatgtgaacagtggtgagtgatgctgatatctgctgaagtagtactcattttgtttcatcagtgttttgagaccgatcttggaataattctgttgatttgatgggtgcaaaggggtacaatcacagcagatttacatgcttacagcattctgaaaaatcggattcatcctacagaaaagctactgtacaaaggagaagaaactcaagaaagactggagactaacagctactgtacagggtggagtgagccatcttggggttcatcatagaggcatcaagatcaaaatggccgtggcctcatggccgcagctttggctgatatcctaacatctaaactgaagcattttcatgaactcagggtaacattggtgttgggcctgttggcagaagatgtaggaacgggctccagtggcaaacgtccggcctgataatgtgcaatggaagagtgctgatgatgtccttccttcctcactgcctttcttctgtataccaggaatcctgcagattaagacaagttgcaatttcacttctgaaatattctgttgtttgagataacattgttctttttaccttaattggtgcgctagtaacacatttggaatgctatgcttatttaagttgatgttacttcctttttcattttaggttctcttactacatgaaaaaccatgtctacttgggaccacgtgcattacagatttccaatcattgtttttgtgtataagggaagactgtttacctttatttgtacaagcgaatctccattgcgagaatatgaggtggggtattccttactgcagggagttctctcgctttcagttccaggagaaaagttatacatttcttttggttttcccggggtagaaaagtatggcattgaccttccatttgtcttctgttttccatcaccatcaaaaggcgagcactcagacatcatgtagtaagaactgaggtgctcctgcctacatactgtaggcgtctcatgttgatttctgagataagacatggtgctgaaaccatgttggacaaagcaagcagacggggaataaggctgtgattgcgggctaggaaatgacatgaatggtgatagccttccatggggtgaaaaggaaggtggggtagtaacatcaggacttgacacaggcaaaggacagccttctatagttaagccttgcttcgcagctagtttagaaatctgtttctggtttagccctgttccataaataatgttccacagactccttagagattccctctggttatatattacttgatccctcatagccatctcaatttgaagctcggcattagtcatcccctaaaacacacattatccataagcagattgtggagtatcaactattatgaggaaaacatactaaaatgtggtggttactcacaagaagtctgtactgactgagaatgtggaggtaggttctgttgccattgttactggtggcttcctcgatcatatcttggagttgacgtttgcgactctcattcagttcaatatcctacatagtgtttgccatataagtttgttttgaggaaaccaaaaacaaaggacaatccgaatttatattacaaatacctttctgtagccagcaccagcttcatcattgtcgcgtatgttgtcaagaataacttgtctccgtgatgttaatgcttgcagaacagccgaatccttatctttcacctgaacacaaattcatcagagttctgtacactgcaaagaaaatttctgagatactattgtaacaacatatgtggtttagagagctgcaacagtctgcgatgccacaatacaattcttagttatgctatctcaaagatgacaaccagtatttcccttattgatgttgcactacaggtattaactagagttctgattggaagaggcttgtaagctgccagtgtgtaaaagagtagttttttgagttgtcaacaaactgaataggtgagtaatcaacctgttgtcttgcaattgcatcatcaagatgctggagctccattcgattgcgcttattggtttcttcaagttcaaacagtgctttctgcagattaatgcgttcttgaacattctcgccagtttcctggctcaagatatttagccaagatagctcattgtctgcagctttttcagtaggttttacacttaactgatgctccttctcagctaattccttcttcaactgagaaacctcaacctacaaagtcataatggaacatattttaatgtgatggagtgctgatagaattgtagaaagttcatttgtgttttttcagtaaggcaaacctggagattgtcaatcatccttttgtagtcttcaacatgggtgtcaagatgtccaatgtttttctgtacaggacaacaaacaacataagaactggttttttcacatttatgattcagaaccaattaaatattttgcatgggtgagaatagtgatgactacatagacacagcatcttgtaatttgttatgcagactaaaagaaatggccccttacatggacatgtgtttttatctcctttgcacgatcagcatacttgagtgtattggtggtgtgatgatactgatcatcagctggtgatatcgtagcaaccataacagtacgagagttaccagagagcccatccttcaggattcgtgttaatttgctgcagagtaccattgtcatataactaagatttttaaaacgatggattccagaatgatacacctgaaaatggaaatacctgtttcgatatggaacatatgcaagacctttcttgttttgcttgccaagggcattgatgcagttcgctagcgctagaagtgaacggttaatgttggctccatctctaagcttttgcccaaagttgtttgtttcagaggccctctcactgttataatataagcgttgctttatagcttactttcttagcagggtgaaatgagaaaaacaatccaaaaaggagtaggtattagtgtattacctgcccgcaaggtcaaccaacgcaagctttccacgaagaacctgactaccatattgtcctttttgttttcgcttcacagttatctccaggacagcatgtgaccttggatttaaaaaaaaaggataaatcttattaatagaatgtagtaaagatgtccagcactacgtcctacagcagctgtcttcgtagaaacaaaatctcagtgatacatcagattaagatattaagtatcctccttaaatagcagttcattaaacagatagaaatgcattgttttgctaagcaagatatcaacaaattcttcaaaagctgaatggccataacagcatctacttacagaaaggaaagaaggaaattcacaatatgtaattaccgtgaagaagttgagtttgcttctgtgctctctgtcttgcgccgactgttgcctatgttcaagagttcaagaatcttatctgctgagtgaacctaagcaaataaaagattgatcatcaaaatattcttatatgtagaggtgaatggaatgttgactaggcctatttttacgaatatgatgaggaatggcatgcaaacacagtagaccacttgctgttgttacaaagggcagaaattggttgtatgaactaatcattaaaagaaaaaagatgaataaatagctgaagaagtctgaaagggttggtatctacaagtatttcttccagaaaggacaaaaaaaaaaccatgcagataaattaaatagtgcaacttaaaaatcatctcttccttaattggctcaatgacgagaggatattatatgcacaaaagaggttacaagcattaggatggccaaaaaaatatgaagaaaacaaaacaaaaaatgccagaattgacactattactacaaggcatttgttttctaattatcacaaaaattaaacagattagaggaagctagaaaccttaatgcttcttaaaccagcaaccattataccatgcacaggatcttcacgaagctccaggtgacctgacgatttttcaagcaaatcatagataacctggaattcagaaagcacagagttttttcacgaaagtttatatgtagtatagagaatttaaggactaatagttaacttttttaagaaactatatattgcacattacctcattgtacacttcaagatatgaacatgagacctcaaacgtatctttactgtcatccttctttaccagatcaaagattgtgcgaaagctcagaaccataagaccaggatcactatgggttccaaccattgtataagttttcccactgcacaatcacaaataacagaatatttcacattatgcatatgaagcgtaatactaataagagccatttcagcttctagatcagtattgaagtatttgtaaaacttcattattaatggacacaatgatgagcgtggattcccataaaaaggaaaaatgaacttgcccaaatagtataatagcttcaccaaggaagctccgtaaagtggctaagtcatatttttcatattatgtcatgattaaaaaaaaactaaagaagcctttcttaccaaagttcaagtttactgaaaaggtaggatggtctcagtttgttttagcatttatttaagtttcacaaaacaagaatggcaatggactaaacataatcatgattttgtttacaattggcatgaggtgaactcagcagatatagtatatatcacatatcacaaattcacaatagttttaagttaggcatctcaaaggaaaaaaacataagaggaaatcaggcaaacataatgtggttgatttgaagaaacactttcatatcataccaactgagtgtagcaagtttttcaaatgtaaaccatatctaacaatagcagcaaatgagataattcagggttcagaaatttacggcagtatgtgtgatgatagcaatatgtgcagcaggcagtatgcttgcaaacaacaaaactatccagtgagcatgtaccttccagtagaaccataagcaaagactgtcgcattaaggccttgaactacaccagcaattgtagaagatatattcttatatacatcctgcacaagtaatgtaattgcattatcaaagcacgatcttaaaatgtgatagtggagtacaagagaacatggcatttgcccccagcagttaacaagcaagcaagctggtgcatacgtgtgcgcacacaacagattctcatcttgtaattctcatacattttttcagtaatggaaatatagatactgaaaagctcccaagatcaaaaacaaaatctatcaagacttacagttttaggcaactgcagttcaagaaaacatttgtacataactgcaaaccagttagcatataattgcaaactggttagcccaattatgtataagataattaaaatttatttacagagcatatgttcatttacatgtcttcattaatcagcccaacatggtccaatgatcacacaattatttatgttttgtacatcttgtctatatgaatgtgactgacagatgtcagatatagaacataaagcattttagcgccattgaattttttttcttgttttttttttaaaaaatagggatgtatttctatgaaaaagataattatttttgtagacctgttggactacaataataagataggctatatggtagaataagttgctaccatttgatagtcagttttcttgtttccggccaggatcttgctgactacaaaatttgcagatggattttgctttaaacaggctaataaattagtacacaagcaatttggcgctcctgcgctcagcgctctcatggttgtatggtccaccaaataaacacaagacatgtgcggtaactcactaccttacataattttcagaccttaatacaataggcacaagaggtcgtgtatatctaagatggccgtggtgtcgaatactgtaactgtgtcaggaagactggttttgacagggacccagagttgcaagtattaaaggttggagcaatgaagttaatgtataagcgtgcaaagcatgcttacagtgcaggttttcctaagaagatctaggttgtagagtttaatacaacaactaaactacagtccttttcccttaaccagacgtatgtatttgttaggtagactacctaacactagtaacagtacatactggattgctccagactgaacaatagtacaaatacttcgtgttggccttttgttggtaccaacagtattgtttcaactgtacaaagcacgagaacctcctaaatttagcagttaatgatccaaagaagtaggttggggtttggcctttaggggcatcatttcctaacatgctagttatgaacaattcaggaatttccaaactgtggtgcagttccaagcacttgctgtaatcagcatatgagcccatttggtaacagacaaagcagttccagtttagagcatcacaatctatctgagcctgcataccgcattggagcacccgggcgcatacacatgatcgaagctgtatcttctctccttggtcctgttttggatgagttcaaggtagtccttggacagatcagggtccagcacaacgacattctggggggcaaaaaacatacaggcaacacattacaatcacaatctggcagaattccaactgaacaactgcacaacaaattacgcattttactactaaactagagcctgcaccttatcatcaatgacttgtatgatatgccgcgaacgccgctgctcgctgtctgtcagtggcctgcacttcacagccacctgcagagagacacatgattacacatcgaagcaacagagcaagcagcatcatcccaacaaaaaatcaagaatcgcgagaaattactccattccatccgtttcatcgcagaaggatctataatctacctgtagcgtggccgtctgcttggaagccggagctcggatgctcggcattgccaggaaccttcgctcgagagctcccaccaaacaaaaaagatgcgggtactatctaccagaaaccaacgcaattgcgccgacgcttgatagccacgccacgcaaaggcgggaaaagggggcgaggcgcatacctaccacacaccaaaagtagcacaccgcggcggcggaaagaaagaaaaaaacacaaaagcttccacggaaaggcgccactgcaccggtgacgacttgcccgggcggccaccaaccgccgccgccaccgccgccgcccaagaaaccgcgaatgccggatcagaatgccacctgaatctccagaatccgcgcaactctctctccaagaacagacaggaaggtcggggcccccaatccacgttgctccctccacccaaattgccgggaagagggaagaacccgtcacggcccccgagacgagcagttggtgggcagcacgacacgacgaggagacgagaagattccggaggaggaggagattgggcgcgaggaggaggggagacgacgagtgggggaagtggaaggaagaacaagaagaagggtggaggtggtttaatggggtggtagaataattaattggcggcagctgtcgcgggggaagaagacgacacggaacagaagaggggtgtgtggggcccactcgcagggccgggcccaccctcaccaacggtccgtttcccttccctccctccggtacacgacgccgtacactacctccctcccatcccacacagcacacagctgcaccaaccatcatccaacatccatggcgcctctggaccatggtgataaactcctccatgcctttgccatggcgccatcctctgcctgctgccccctcacctgacattgacattggattctacacactgatcggtgaaaaatcccaaatccgtggattactcccaaaatgcaaggatcggatttaggagtggtatagaaaatcagcgtaccgttgtgccgcagccaacatcaacagtgtcataaacatctcaatgcaatggcaggctgcagcaaccatagccgcacccatttcatctgaacagctttataatatattgttttacaataaaaaaagaagcatccttaatcatggcatatgcatttttgatgtgttctttgtacggatagatgagtatggaaacacttcgatgcaatggttactgtttatttgtgcgaagaaaaatgattcttttttagacgaaaaaacatttctgtctggtggcaaacaacaatgacatgatgtttaattagtaccttttgattgccctgcctccttaataagccctacgttaaccggttgtgaaagcagcagtaacgtgtaatcaacggaggagtacgtatttaagtttaatgttgacgtacgttggtcacgttcataactgcatgctaaattaattcctccatcaaaatagccatcatctgggatctggaagttgctcccgtggacgcaatcttgcactcatacgcatgctgatgcctgaggagcatcttttttggggacaaatccaagattaaattttaatgtcaatttctcataaatatattcataataggtataaaatcaactttgtgggggaaagtattttaaattacgaatctattggattagttttaaaacaccgcttatactttgagtttgactaattttgtgggccaccgttggaaaatactaattttgtgggtaaattatctggaagtttcgctgtttaaaaacaaacccaataagagaacacttgatactttgatgattgggtaccctatttgaagatcgatcgaatagcaccgtccagtgtactgctagctacaacctcgaatgtttgattttgtatcttgtatttccgtgctaaatctaacctgcttctggatgcaccaaacaatcattgagatttggtccggatcacgaacactattcatcttgaattttgaaacgaacacgtcaacaaaatcattaaattgcttgcacaattattttttcttttttacaaatatcattttcttgcattagtggcatcctccgtgccgcacctaacatgggcacgactttctggtggaccgatagaactgttcactttctggagatgcagtgccactggccactgccaacccgccttctgaacttgaactaaaaaaattttgaaatgtacgtgaaataattaaaaacacccaactacaaaactgactcgtttgttgtgtttgtgctttcatgtcttcaaggcatcaacacaggcaaacaataatttgacacgaagttcagaagttgaatgcacgtggagccaacaacaaccaaatgaaagcaatgtatacctcggtgaagtttttgaaacgtgtgtgtgaacaaaataaaagccccaacaacgaaaacttctggtagttatgcttaagcctcagataccggaggcattcaaatgaaaattcaaaagtcaaatggccatggagccaaaacaattcatatatatgtgcacgcacggcttggatcatacttttcaaagtaatttggcacgcatgtcagcacgtagaacaccaattggatcatggagtgcaaccattccttttgagtatttttaaacacctgcgtattgtcaaccggattttccatttgtgaagtaaccaggcctcttttctaaatacttttagtttggatgattactttgtttgcagaacgaaggaacctttaaagcaaatagttttggactggttgcaaactttgtaatcttttagtgtttttcttgtaaccttgtacgtattttctctctataatgaaattacactactaggcaaagccctgatagttttctcagtcaaaaagaaataagtggaaagatcggaaaaggaatactaaccgaaaaagagtatagtaatagaagagcggatatatatgaaccatctccatggaataggcgacatgggtacatgtgggtccataagctgtggagctcacatgtcagccacttaaagtcagaggataataagttagaggatctgcttttcatgggataacaattaaaaaactactttcattttttttgaagagataaaaaaaaactactttcattttaaaaactactttcattttgatttgttagatttacttcttctttttagaaaatctcacactaaattagaaggtgcaacaaactacactgctaccctcattagttacgtcccaaccatctttctgatgcaagcatcaattttttcatgagcagtactagtatggctatatctattatctatgaatagattaaaaatgctttgaaatgtgagaacgatattttttctaaaaaataatgaatgctagaatgataaataaactggtacgaagaggatacaacattttcgtgtattaatgtttgtttttttctacaattgcatactccctccgtctgttccgtccatttcatattataggttttgactttatctaggtcatactatcaagtttatagataaaattagtaatatctacaacaccaaattagtttcattaaatttagtattaaatatattttaataatatgtttcttttgtattaaaattatagtatatttttctacgaacttaaaaaaatttaactagaagaaaaaaatgacttataatataaaacaaatagagtaaaacacgtgacatttaactatttgtcacttttaagatgtggcaattaagaacttgccactcgctgtgtatgacatgtgagtcctcacgtgtctataatatgttagtccggtggtaaatcctttatcacaacttgtaagagtagcaagtagttaattattccatagaagacggacacaccacacctaaaactgtgaggtggtacttgatactccgtgaacaattcgtgaacatatcgatttaaaatgtacaggagtggagtaaaatgtaagtttggcttgtttggcgcagctccgctcctatttttggtggagttctctctcacaaaataaactatagatgtggagctgggtttaggcaactccacaactacactcaggacccaactcttgaatctaaattttggagttggagctcttggcttactcctcactgactcactcctccgtttaagagcaaggctaatagtatagccagttgctgactaatagtccattgcttaagccgactactagtataatagattgtctgttggctgactacaccatataatcaaatagttaattataaccagtacatatcaatgtatatgatcaagagtgaattgcatccttgtagccatttgtgccagagcatatttagagaccatatcaaccaaaatatctgtagtacaaaaattgcaaggcactattactacatgacattaactcaaatattcccaaaaataaaacttaaataccatagattaatcgataataatctattagcgggcatgagagattagcgaggggaagagggaaagcggataataggggtggatttgtgtcaatcttaccggatttttgaggccggcaaaatagtgagatgtgattttttggggcggatttgtgttaatcttaccggatttttgaggccggcaaaatagtaagatgtgatttttttggggtggatttgtgtcgggaggggaagagatcttcgcgcgcgggaagggaagagatggcgcgcatgggagaagagatggcgcgtgggcacatctacatcacgcaggaggggcggagatcgagcgagcacggctgggcattggggcagagggaagggcattttgctcggtggggtggggaaggggatcggctacggtgtgggggtccacaaatcgtgtttttttattgctgagttgggctgcaatctagcagtagcgcatgggaaagagagctatcgccgggtgatagatttgtcgttcgttctcctctctcatcaattctctcctctccacatagaaatatgatgatgtggcataattttaaagttcgtctagtcagcttttttacctgctctaaaccctgccatggccaaagcctaccgagacggtgcacggctgcacacccttcaagatacgtgcactcactcgctccgattagaataccggaaacggatacccccgttaattgccgcaaacaagcacggctcgtgtcgcgttcatgcgcgcgcgcacggagacgaagcggcggaggccccagctagcgcatacctcaatcacggggaggccacgccacggcggcaaagttgccgacgacgcggtggttggagagagagacacactttggccgtttgccgccactcgccacggatccccgtttattttactcgccgaatcatcgccacgcaggcaaagagtagtaagttcatcattgggctaatcaaccacgaatcatggctcagcggaatctagcgagcaaagcagtgtcatatccttccctttctgctgcatttctttattttttcccgccccgatgggattaatattagctgctggtgtaaggtacggatgcctccgtttcttgtcgacgattgtcgattgcatctgttcctgcagtttctgcgacggtggcagccactgctaacagagggtgttcagggtgtcacatcggttattatatagggtatcatatacgttaataaactgtgagacgaatttattaagtctaattaatttattattagcacatatttactgtatcaccacatttgtcaaatcaagtagtaattaggtgtaaaaaaatcatctcacaaattattcacaatatgtgtaattagctattttttaattttatatttaatattttatgcatgtgttttagggtgacttctaaataggcccatagcatgatggattcctcctgcgatgagatggcagcacagtattagtagtactagtaccacacaccgcgcaatgccccgtgtgtgacgaggtgctgtgcccatgtcggtggcagtaatagtagcggtatgccggtacgaagtacgaactggccagctgggttctcacaattgttttgctcttttgctgaaacacagacatagtgcacggagggtagaattgagttcactccattagtgtctgcaggctacatgatcccaagaaatggccgtgccaagcctacaaatcgattcatcccgagtccccgaccatgtgactacgggagatgggctgcaggtgccggtgacgaatgagctcgtggcggcgcagggaacaggagcaggacaagatcttcctggacgcgtaaacaatggagcacttggagagaggggatcatgctacaagtactagcgagaagagatgccgcgtccaccgtctggcgaagatcgcgtctggattgctgccactggcagcatcacaaacccattatttttgctgccgtactacgtgcaggcaggcagcacggcgggcgatctcatctcgtgaggttggcgcaccgggtcgatcacccaccggcacaaattaaaccgactcgatccgcctcgtggcacggcaactaatcgaccgggtcgttccgttacctgttctagttgtaccagcccgcgaccgcgacggcgacggcgccccacgaccacgagcagttgggatcctctccaaaattccaagcttccaacgtcttggcccaatccaatccccagccacaggtcgcggtcaccgccaagctcaccacacgtactacgtcgcgccatccgcttcctccgcccgcacggcgcaagcgtgctacgccgctacgcgctgcgtacgcgtcgcagaggccgaacgcgatgtggaggagggcatttaactcgcggcgcacgggtttgtgtcctcgccgccgtggccgtgggcgtcggcggatattgagtgcggttcgaggcgagcgagaggaggcgtagcctcgaagcgagggcgaggcgaacgaccgaacgaactgtgtagtacgtgacgcgcggggcggcacgggtgggaggcaataaacggtgtgccggctgtacaccagtaggatcgcacaggatcatcgcgtcgtgca

SEQ ID NO: 59515 - DNA, 23557 bp, Oryza sativa
cggatgaagaaatgaccaactatataagagatgtatattttgtgaacaatcttacaaatcactttgtcggatgaagaaatgaccaaaatagaagttatagatcttgatgagttatacaactttgttattgatgactttttcagctgaaatcatttactgaaataataccggtaagaacacaataacatgatagagcatgattttagaaacatttaggaaaaagaatcatccaatttggagttcatatgagtgagatacattagtttcaaagttttcaaaaaaaattttgcaagcggctacttaagacgcccgtatggaaaaatcgatttttccatgcgggcacttaagtgagccgtatgcaaaaatgaggtcgtttttccatgcgggcgtcttaagcagccgtctgcgaaaaaggcgctcgatttttgcaaacgccactagttgtggtccgtttgcaaaaaatcatggggctcgtacagaaaaatcacttttgtagtagtgtgatcggttggccttgtatttctaaagccttgcctctattatcgagcttgtgacattgagtcaatctgcataatctgcgtacggtccttatagtccttacaccttttatcacagggtcccaaagtaagaaatagtatagaaatatgtcggaagtaatcagggcatttaacttttttccacttttaaggtgtgatcattaagaatttgccacccacaatctatgacatgtgggctctcatgtgcctatgacatatgggtctagcgacaaatctttaattaccgcttgtaaaagtggcaaatagttaaatatttggcatgaataaccaccagatgcaataatccctgagcttaatgaggcccggattcggttgtatgaatggaagggagagggaggggtagccatggtggttgagaaaggatcggagataattgggagaaagtgtgcctaattaattgtgtattattattgtaaacttgaaagatagctttttaaagtttttttataaaatagttttttaaaaaattgaccgtatgaattatatttacaaatatttatatttaaaaacccgccgtatgaattatgttcgaaatacaatgttcaaatgttttattacccttgaactgcattaattttttcaatagcaaccgacatgtggaccatctctgtactactttgtagcttctagcccttcccgagcgtctagcagaaaaataaacacgggaacttttaactccgttaggtgcgaacgaatttccacttctggccaatggaacatagcagaatatgagcacgtgcaccatggaggttaccgtgttcttacgcgctacacacggtaagtttaaagttaccgtgtgctaaacctagcacccggtattttttcctgggttaccgagttcatagtggtacactcggtaagttaccgtgtgtttacgggaaacacacggtaacactctgcagcacacgggagcttcacattctctagtagtgaaatcgatccaattttgtcggcacgtgtaaatggtgcatgtgcacgtatagcaaactgcaaacatggttgaattgctaatcttatatcttgtcaattaggtaagtatggacaaaaatctgtttgccagtggactgaaaatctatttttcaaattcacttctatttttcagtgcaaaatttatatttccagaccttcccttattttcttttcatcctatatcaatgaaagtaatatattttttctgtccgggggaaatttgatctcttaatcattcggcacttaatcttcttgcacagaccgtacaataattttttttgggttttgtggtatcacaaattaacaatataagtgatttactccatccaaattttgctgtttagtttggataaaaaaaacacgaattcctgttctccatggtttgttgatgttaaatgttcactcttctaagggtgatttttctacatgtgtatcgaacgatcgttattgtcccttgaaagggtaaatatatttggatcattcatgcatttatgtattcaggaccaatattattttcttaagatcatagatttagactgtatacatgggaaatggtagcgactattgaataaaaatgtgtcttggttccagtaactggataagattaacattaaaggtaacttgtctaagcaaccaatggccaaataactcatgaactcaccctttcttttcagaatccttctttgtgaataaatataactgtctcattatggtagtgcccgagttgtgtagttactgataaaaaacatccaaactgaatttggatgctgcatttaggatgtcatcggtatttcatttttttattctctcactgatttggtttcatttcatttgggtagatgttgtgttaaatttgttccaaataaatcacaaacacagactccatccggatcgtcctgctcaccgctctctccaaggtgagtactggaaaccttctctcttgtggcaatttcatttagttatgtatttcattcagctgatgaattatcctttgaccatggccattataaatgaaatataagctggattgcactatgtacatgatataacttatatgcttggacaaccatgtttctgatttatattttagggggggaccatgtttctgaaatttatcatctggaaaaaaatcccttacattgcttactgtacactaggacctttcacaaaaatactaatgtattttccaacctttataatgatttcctacaaaaatacctattgtatactgtatactaaaatttctgagtttaacattgcagtcttccgaattgatacaagactcagagatgatacactaagtgcggcaaaggtgagtcatgtgtggcaaatatatatatatatatatatatatatatatatatatatatatatatatatatatatatatatatatagtttttgctggcagatataactctcaccattgatcaccattgagcaaaacaccacattcataagtttaacagctatttatctaaatttaatttttcaaaaaaaagttttgtttaatggctgaaactgcacagtgctactatgatctttgaaccaaataaattgtctgagtttcctaccaacaaattgatttgttcacggatttaggtggtcacgggccataataaatcattgagaataggccatataacattcagttatgtcatcacacacattctgattttgacaaaattaggcaacatagaaatcaatgtatgcaagtatccagatacctaacaccattggctgcttattgtttcgaggggttcactgcttatattttattgagcttagctatattgtatttctttaaactgcataaccatctcattgcatagcccatatctttatagcaccgtaacaataacaactacatctctacaagattactactgtgataagaaatgaaggattggcggtacataaaatgcctcaagttgcctggaacaagcaaccatttgtagatccaaacaatattgtcgttgttattgcatacagcttgtttatataacatatatatctttcagcctcaaggtggagaagtttgatctctacataaagaaatagcaatcggtgttttctgcactcaaatatgtaaataagctatagtgtgtcagatattacaatggtgttcagtatagagcacacgtgcagacaacatttttgcagtgggcttatctatgaatatttttttattcatcttttgcatggttagcatgtgctgtatgtttcattcaattcgatctagatttgtaggtacgtccaaagggggcatgtgcatgtatagtaaacatgagttgggttactaataactaaacagatgtagtgtatgtatggagaaaaatatgtttgtcagtggaccgagaattgcatttggagatataaccaataaccaaacaacaggtgtaatgaaatgggaagttcattgtatatattactattgatcccttggaaaattaagatcatagaaaaatatttttttgctaacattaaattttagaagttattaaagacaaatagtattgcaccgtagcgtttagcatgggcatattagttccttcttaattgtaaactgagcgagcagcagcggcttcgccttatgccgtagcctcgtgcaggatgaaccacagctgagaccctgtccgttatatttcctctaagggcatgtgctacattagcacaatctgtctctgggatcatcgggagattaatccattttattacaagacgaatacccttcagacaggcatgagcttcggcctcctccgcaaacctacaatgtctaatcagcttctaggaaaaacataacataaaataaattaatgattaacatatattattaaagatcatataaaaaatatggtttataatttgggacggagggaggagtactacgtagagagctattggttatttatctgtacgatgacgacgtgaaaccagagcacagactttttatatttaaaaaagaaaagaaaaacagagcagggcgatggcccaatcctacacggcccattttctcggcatgaggcccagacacccagtggttatggagcccagccctgcgactacgagagtccgagtcaaccagtcagtcaacccaaccatacattttttcggagaaaatttggccatgttattttcaacttattaccggattatttgctccactcttaattaaaaacacgtttctataaaaaaaagattttctctgtggtatttgtttagaccacttattttagatatttgttaaatttatttattaaaatatttaatttagtcctatatatatataatcaaatcatttaatgatctaaattaaacagagctacgttattttttaataatggaatagagtatcccgacctttactcagaagagctacagctaattattactctctccattttaaattgatatgcatatttcataggtacaccaagaccaagaaaaactaataactctctcatactatatttactctagcaacaaactcaatgcatgcaccatccccactattttctagccaatagcaaatcaagatattgcatgtgggttataaatacttgtgtgcatagatgcatataccaatgtccatttactccaatgcacaaataacaaatagacttaataaatgaacacaaatatgtagatcatttaggaataacctaaaaaaaaaactatatatagatcaatttggaatgaagggagtataatcttgcactctaaacaaatctacgtcatactcataccgtcgtaattggctggccgtggcagcgacatcacaggctcacagcagtggatacctagtgcacacgattgaaacggccactggggaagtttaattaccagtccacagctcgccctgaagatcgagttaaacgcgaagttggtatatacatactccttccgttttgaaaaagacaacgttttgaaaaagacaaaatctagggtgagtttgtttccaactttttcttcaaactttcaacttttccatcacatcaaaattttcctacacacataaactttcaattttttcttcaaacttttaattttaatcaaactttcaattttagtatggaactaaacatagccctagattagtgttcgttcagattcaattttagaagcttttttagacggatgacgtgtagtaaagcctcaaatcaactttcagaacaccagacaatataaattgctgcaatggtttgaaacccgaaatcaatttttttttagaacttaaacccgggatcaattcaatctcgttccaattaataaactgtactacattttccgtcaaattaggcgggagatattttgctctccgcatatgaagtagacgagatggtcatcgcctggcacggcacgagcgtcgccacttggcagagaggatatcattcaatatggctctctcgtccacgttaaccaatgatgccaatcagtttctctttagagcaagttcaatagtatagccaactactaactccaattcatctatagccaatctaatagctcattcatataatagttatatactacactattaatatctagtcccacctgtcatagacacaccgcgtcttagagtccgtgctacagctggctacaaatctgtagcccgctgctcttctctctcctgatttatcttcttaaaatatgtttacagctggcttataggctgttattgtacctgctattagagtttagaagaacaaaatgctgacaaatcctggtcatttcttgaccgtatgaattctagaaaaataagattagtactcccttagagcaggtactatagcaggctattagctagctgtaaacatattttaatgagataaaagatgagagagaaaagcagcgggctacagatctgtagccagctgcagcgcgaactccaagacacaatgtatgtatgacaggtgggatcatatattaatagtatattaagcaactattctatgaattggctattagattgactatagatgaattggagctagtagtgggctatattattaaacttgctcttaccgacctttgaatcgatttcagtgacgtctcgctcgatctcgtcagctttccatggcccaattttctcgacggatatatccacatcagcgtgcatacaagtgtgtcaaagctcgtgccagtctccaacacacggaagcttccggctgctggtcccggtatcttgcacttgggtccaaacgagacaacatcacacaaggaaaaataaaatcgcatcttccaatcgcctcacactgcagcggcgcgcgtggtgatctgtccatttctcatttgtcgccgccactggaaaatcagaggagacgaagacttccagcaaccatgtcaagctgactcccaagcttatatgccgcgccggcttgcacgccctctgctccacgagacgcgacgcgacgcgacgcgcgcgcgcactggggagagtgtctttcttgctgcaatggctgagaagaagggggtgggttcacttcttcccgggctcgccgtcgtcctcgttggcttcgtggtcggcggcgccgggagcgacgaccggttcgtctacgccggcttcaccggcgcgccgctcgcgttggacgggacggcggccatcacggcgagcgggctgctcgagctgaccaacggcacggcgcagctcaaggcgcacgcggtgcacccggcggcgctgcgcttccacggcggcggcggcggcggcggcgcggtgcgctccttctcgacgtcgttcgtgttcgggatcatcccgccttactccgacctgagcggccatggcatcgtcttcttcgtcgggaagaacaacttcaccgccgcgctgccgagccagtacctgggcctcctcaacagcaccaacaacggcaacaccaccaaccacatcttcggcgtcgagctcgacaccatcgtcagctccgagttccaggatcctaacgacaaccacgtcggcatcgacatcaacagcctcaagtccgtcgccgtgaacaccgccggctactacgacgacaagaccggcgccttccacgacctgtccctgatcagcggcaaggccatgcaggtctgggtggactacgacggcgccaccacgcagatcagcgtgttcatggctcctctcaagatgtccaagcctacgaggccactggtgtctgccgtgtacaacctctcacaggtgctcgtcgatccggtgtacgtcggcttctcgtcggcgacgggcacggtgaggtcacgccactacgttcttggctggagcttcgccatggacgggcctgctcctgccattgacatcgccatgctgcccaagctgccgttctatggcaccaaggcacggtccaaggtattggatatcgttctgcccatagcaaccgcggtgttcgtcctcggtgtggttgtagtggtggttttgcttgtcaggaggagattgaagtatgctgagctgcgagaagactgggaggttgaatttgggccgcaccgattcacatacaaggacttgttccgagcgacggaagggttcaaggccaagatgttgctgggtataggaggatttgggagggtgtacaagggagttctaccgaaatccaatatggaggttgcgataaagaaagtgtcccatgaatcgaggcaaggcataaaggagttcattgcagaggtggtgagtattgggcgtcttcggcatcggaacctcgtgcaattattaggttattgccggcgaaaaggtgaacttattttggtttatgactacatgccaaacggtagtcttgataaatacctatatgatgataagaacaagcctactctggattggactcaaaggttccgcatcataaaaggggtagcatctggcctactgtatattcatgaggattgggagcaagttgtcattcattgagatatcaaagcaagtaacgttcttcttgatagtgagatgaatggacggttagccgactttggtctagcaagattatatgatcatggtgctgatcctcaatcaacacatgtggttggcacaatgggatatctagccccagaattagcacgatcaggaaaggcatcccctctaaccgatgtttttgcattggtgcctttctcctcgaagttacatgtggacgaagacctgttgagcaagccatgcaagacaaccaactcatgttggtcgattgggtgcttgagcattggcagaaaggatcacttacaaaggtaattgatgcaaggctccatggcaactacaacattgatgaggcaatcctagtgttgaagttagggttgttgtgttcacatccattgcccggtgcaaggcctagcatgcgacaggttgtgcagtatcttgaaggtgacatgcccttccctgagctaacgccaacacatctaagctttagcatgctagctcttatgcaaaatgaaggctttgactcttttgtcatgtcaacatcgcttccatcagagacgatgatgaccattggcacgatgagtggcctctctggaggaagatagtacagtagcacctacttgttagtttttttatcctacgaaaagttttatttccttggtgtaaatgtttgtaatatttagagtaaattacaattcattgtttaccttttgaacaatctcaaagatagtgcatggtagtgctaatgcttacaaaagcatatcctctgccttacaatagaggaacacagtaaatatatctagtaatgcaaacggttgtaatgattcaatgtagaataatgtagcaagttgtattgtgatgacgtagtgtagcagaaataggtgtgctcaaaatctttttggattgaaccgtggacctgtagcgatggatttcaacatttgatatctccgtgttcaaattcggtatgacaactgaaaagagctaagtgctttgcaattggtacaagttcactttaggtcccttaatttttcgtcgagtttgaaattcatccctaaaaccgcaacactagatatgttgcgtccctcaacttgcaaaactagtgcaaataagatcccaaggcgatttcaactaatatggcgcctatgtggctgatgtcacgcctaccatgggacccacatgtcagtgagtgtccggttaaaaataaaaaaatgcaatgcagaccacatcatcacccatatctttcccctcttatctcccttcttcctctctcgccagctcccccgccgctcaacccgatccgactcgatcgccgatcgaccaaccgccaccaccaaaccctctcacctcctccttcgggattccagcctccgcctctccggtgtccgaacccacccaccctgccacccgatggcgagatttcaccatcgccaacccatacctagttacaaggctcgtcgtcatggaggcattttctttgactgattagttcgaaccgagtgaatcgactagcgagtggtggactagtggacctggtggttaccacgctcaaagcaaggggcaccggagccaccttgaccctgtggataggtcatctcctacccggccaaactggtgactagtgagtttcgcatccgtgaagtattggtctctctgtgaggagaaactgcctacttttgtttagttatttttttgtttgggtatacttagatcatcatgtcgatgttccgattttagtttgatttgtcagtcgatcggctctagtagtaggtctgatgcctggatgcttagcgttgctcgtttggtggtggggagtacctattggatgagttgatcgacatcgctgctaacagccttgatgtggaggtagtagtttaactaatgacgtcctagctctccgcacgggacacctgcgggaacacaacgtttttgtgtgacctggtcatgcttgctcatttcccagttccttagcccctggatgtgcgggtcgccggcatccactcccctctcggcgcctgtagcagccgtcatcctagcaaaggcagggaaagggagagagagagagagagatagagaggaggaagggatagaagaggcgaaagaaaggggatgatgatgtgggtcccgatgcaatttttcaactggacattcactgacatgtgggtcccacagttgtttcttttttttagggtaaagagagattttattaatggctgaacatagggttacattcttgattcagaagatcaaggatttctgcaggagcacttaacttccactccgcatcaattcctgaccttaacgccatttgagctaaagcgtgagctatcctatttgaatctctctttatgttgtgcacctgcacctgcaccaaacattgcattgctgctcttacttctgaaattattccaccccattctgctctggaagcgcttgttgtatttaggtcagctaccacattaccattgtctaattctataatcattggcatatgcacccactcagtagctatccgaaccccttccaagcaagcccatgtaggcgcccactcagtaatcattgtcctacagttgtttctgactttaagtgccatgtcaatgcccacgtaggcgccatgttagttgaaatcgtcgttcaaatcgtcttgtgatcttatttgcattggttttaggagttaagagatgcgtcatatctggtattacggttatagatgaattttggactcgacgataagttgagagaccaatagtgaagttgtttcctttgcaattcgctaagggccatcccgagctgtttaatctgtattagttgtggtttgggcccaagtggcctaggtgccatatgcactacaggccagactaaatcacaccttaacatggaatgacccgctacattccatgtaaaatggcccgctatattttagtagactattcctatggggtggccttgcgggccagtaaaatggcgccccatttgcatttctattgtaccctgagaaaaaattaagttatatcatcacaaatcagtggattaaagtcacatcataaccactgtccactgattgatttttctcagattgatgtgaatcagaaataaaccactcgcttatttcaggtttaagtcttccttctaaacagtgcgtgcggcaaatccattggttctgtgtggaatttacccaaacaacgcgtcatatgtataatgcacaaaccgtatttactgattaattccttccacacttgaggaaaaccaaaacgtcacaacaaaacttcaatcttcaatcacaatactactacattgcatagtaaagaagcttttggtacacggctaatgttgttagcctgtaaagcgtgtcgttggagacgtggcagtggaagccgacgggaacgacatcgccacgaagtcgtcgtcgtcgtcatcgtcgtggcacaggaacgccggagtggccacgtccatgtgccccggcgacagttggtccaggacgtcgccgccgccgccgtcgagccactgcaccacgcgccgcatgcctgggcgcgccgcgggcagccggtgcgtgcacagcagcgcgagcttcagcatcgcctcggcctcgccggcggcgaagccgccgccgagcctcgcgtccaccgcgccggcgatctccccggaccgccacgagcgcagcacccagtccacaagcacgagccgctcgccgccggcggccgcgcgcggctgcacggggcgccgcccgcacacgacctccagcacgaacgcgccgaacgcgaacacgtcgctgcttgtggtggcctggccggtgcgcgtcagctccgggtcgaggtaacccatggtgccgacgatggtggtggtgctcggctcggcgccatggtcgtacaacctcgctacgccgaagtcgccgagccgcccgttcatgttagaatcgagtagcacattgctcgccttggtgtcacggtgaatcaccacctactcccactcctcgtgaaggtagagcaaaccggatgcggcgcctttgattatgttgatcctctgtgcccaatttaggataggtttaccttcaccgtacaaatacttgtccagactaccatttatcatgtaatcgtacaccaatagaagctctcctttacgccgacagtagccaagtaattgcacaatattacggtgtctaagccgacctaggctcacaatctcggcgatgaattctctcatcccctgcttagaatcatgacaaattttcttaatcgcgacatcaatacccgaccccggcataactcccttgtacaccttcccgaatcctccaacgccaagaaccatgtcatcatgaaatcctttagtcgccttgtgtaagtccttataagcaaaacgatgcggtccaaactcgacctcccaatcttccaccagctcaacataaattgccctcctctgcctcctgaacaataagaacataacaatagcggctaccactgtcactgataggctaacaggtaaccaaattttcacgggcatgtgcttggttgacgcagctgtggccatgacaggagggaggcttggcaacttggcgtagtccaggtcttgggctatgccggacaggctaaagctccagccaagaacgtagtgagacgtgtcgtcggagcccgtcgacgacgagaatccgacgtacatttggtcggagaacgccgcggagaggttcgccggcttcacggacagcagtggcctcgccggcttcggcttggtgagctggtgcagcgtgacgtcgaggcgcgcgtcgccggcgtcgtactccacccacacctgcatggcgcggcggctggtggctcaggttcctgaacgagccgccgggcgtgtagtaccccgccgtgctcgcggcgacggagtccagcccgttcacgtcgacgccgacgtggttgtcgtcgatgtcgcggaactccggcgtgtacatcgtgtcgagctccacggcgaggacgcggccgctcgccgggtcgccgttggtggcgcggttgaagaggcccaggtactcggccgcggcggcgccggagaagtcccgcgtcgaggagacggcgaacgcgatgccgtgcccggcgaggtcggtgaacgacgacatgatgctgaacacgaacgtcgacgtgaaggaccggacgccgccgccgccgccgctcccgttgcggaagccgagcggccgagcgtagaacgcgtggcccttctcgccgctgccgccggttagccgcaggaggccgtcgggcgtgacggaggcggcaccgtcaagcactagctcgccgtcgccggcgccggcgaacccgttgtaggcgaactcgtcgacggcgccattggcgaccgcgagatcgagcagcaggaggagcaaaagcgttgcaacatgcatggctgcgacgacgagaacgagacgtgagacgatcgatcgagcgaggcgtttcgcgcgcttttgtgaagcgttttggcgcgctagcgtggttgaccggttgtggaaatcgcatggcgacgcgtggactgaactcacactctccgtcagagaacgagctggtatgttcagaaccaagtgaccacagtgcagcgttcgagcaaagtgtacggtagcacagcacgtttgattttggtgtacaagagagtgcttgacggggtaaacggatcggactaatttggattacgacgagccgacaaaatcattccctgaattatggtatcgtcgtccacaagtctcctctcagactcaataactcaaataattgcacgagaagtggtttctggttggcagttatcgcatcatgaaacttcactattgagcatctcctgcagagtatctaaactaaactctcaaacagtttttagagcgaaggaacaatttttagtgtgaagggataaaaatcgagatccaacaggatccctattaaaaccccaaaattggaaggcacccaaatcctctccctagcccccaatcctggggctctacaccaacacccatcttttttttttttggtgcgggtgaaaaatcctagcgtacgcttctcccgttgtactcgcaccctcactacgccgccccgcccttctcctttcccgttgtactcgcaccctcactacgtcacccccgcacttctccttttccgttgtacttgcaccctcactacgccgccccgcccttctcctttcttgcgccgacggttgtcgtctaaccatcttaccatttatgtttatagaatatgttatttttaaaattatataatgcttgtgaacttgcatatgtgtgtgattgtggaaattgaattttattgtgcattttgcaatgttgaaaattttgaatttcaatttgaattgtggtcttcaaaattgtaaatttgaatatgattgaattctatgtgttttaaatatttctgtttgaattattttggtgctaaactaggtataaatatagtgtatacaaaatagaagagaatgagaaatgtggcctgagaaatgggggttgttgctgaagtacaagtcaacttttggatcctcggacagcctccattagatcttttaagggctttacaatttacaatataagttattgctggagatgcttggcagcatcatagtttctcccaccttcgtcggaaagtagattccgccaaatgcatggtttatttgatttgccattataccaaaatgttgcagtgctaaaatctaggtaattttaagtactgctatttttttaaaccggtgtatattatcggcacatcttaatagcaaattaaacaataacaaaatactctttaaagtgctaacaattcaacacggcacattttggattcaaacgagaatgcttgcatgggcataatcacttaacgtgtatttggtctggtgacaagatgagatgggttaggctcatccctctttttttttttttttaaggatatgttttcatcagtacacgtttggtagataactttctctttaaagaaatgagagaatgtggcccaatgagagagagtggattagattagttatgtcgatttttaagtacaaaactgaacccgatctagagagtattcccttttagggatcaatgtatcccacctatccccgaatcaaatacactgaagaataagttcacccttattgatcatcccattatgtccctttcaacttaaaaatatgtttatagttggaattagggtagtatgatttaaaggtgaaaaaaatgtattcaacgtagctttgaaaaggtaaagaaaagtgtattcggacttgttcttgtcaaacactttatattagtcaattgccgttgcattgtattttgaaaacagttatactcctaccttaggaattactactaggagttaggtcctaacttcaataactcctatggagattttagcgcacacaaaaagagaaaactcattaacatatgattaattaactattaactattataaacttgaagatcaaatttatttaatttttcttaagaaaacattttttatatattaaaaaattcgtatattttaaatatttaaaaatcgtgctaacagaaaacgagtacaggttagagtttgaagttgaagaaaaaaacaatgacagtggttgaaatttcctacttcctctgtcctaaaatattgctacatgacccacaaattcgttgttttacgatggtagcaacattttgggaccgatgtagtatctgtgatttcaactcaacggcccaacaattgaagcccacaaaccgcaaagcccacgaagaccaccagcaaaaataaagaagaaaccggaggtcagtttcctatctaatctcgatctctccacccgtttcccccaaaaccagcggcgccaccacccaccttcccccatggcatcggcggcggcgagatccggcctccgctcgctggcggcgcgcgccaaggcgaccgccgcccccgcggcgaggcgccgcatgtcctcctccgcccacgacgacgcccgtgagtcgtcccacctcccgtctcctcttccccgttttgtgtggttttctcgttgacccatgattggcttctgattcgcgtttcgatctccctatccccctccccctcgcagatgagacggccaagtgggagaagatcacctacgccgggatcgtcacctgcaccctgctggcggcgtacaacctctccaagggccacccccacttcgacgagccgccggtcagatctcgtccttgatttatccgggattctggattagctattgtatgaatctgattcgtggaatctgtgattgtttcaggcgtacccctatctgcacatccgtaacaaggagttcccatggggtaagtttgttcagctatggcttaaccctatctatttgagtacttgttgcgatgttctattgagatttatcgcgattaatattctgactgaagtcaaatggctggtgtatgtacttgtatgcggattgtgatagttgcatgttacggtatttcattttgccgaaatacccattcctttagttctggtcgtttataatcttggtgattgttcatcgttttctgatgaaactaccgatttagttgactagtttgactgtgataactcgccgaatatcatttacgattggcatagatatgtctgcaaggattttttttttgtctgcgcaagaatattataatttcatgtttggagattcgatcacatttcctaagatacttagggcaacaccaatgtctgaggaacacttcaatgcctagtctgcaaacattgggactttcaccagatacttaccgcacattgagatggaatttgatcgtacattgtgcttgcaatattgcatccagttcttggtgtacattttgctacacaaacttatagttgtactatacctaatcactctagaaacctttgagatctgggatggtaattttaagttgtattccatttttctgcatgacgactttcagaactcatttctgggattcgaaattcatataattagcatgggtgttgtaatcttctttttttggtacaaatgtttaagagttgcatgcaacatatgtcatgaacaacaatggtagttatgacaatatgaccttaaattcaatcagattttagactagtcttatgccttccacctatgattatcgtacagcagagtatagaatagtttgttatttttgtataggaagctatacaaagctcaaagttgcatgtaacagatgccatgaacatcccagtgaattagggcatgataaacctgaaatccacattggaactatatattggtagaatacttgagcattactatcgagtgagtacttccgtttcgtattctgtatttgtttcgagttactgtgttgctttcaaattctcacaccatacaactcttccatgcaggacccgatggcctatttgagaacaagcaccattaagtactgaacagcgcaccatcagaagcccagtgaatgcttaagaaaaattctctggttgttccagtgattcttgttttcagtgaaacctatttttcttgcaacaaagaaataagaatgacaaaactcttgtgttgataatcaggatttaactgtgttgttagttgttacctgttttcttcattcacagcagtgatcatatgcatgtgttctgtttcagaaaatgctgtcatcatcacaacaagctttgttattataatcttcctacgccatttctgtgctcttgctctttatgggatgaaacctgttccgaaaattgatgcttatttatgcttatgaattttcacggttcagtcgctgtcaaagctggatgtacttctttgcttgatcaacagattgcatagttgggaaatgttgagaaattgttaccggaagctattgctacaggaaaataaaaaagaagttactggaaaataacatgagcatcgcttaaaaagattgcctagatggatacacggctttatagtaacaagcagggtaacatgataaacagattatatcagcttgaaagatgcagcgagttgtcctgaagatcaaaccggacgaaataatctcatgctgtcaccggagagcattccgtctgccattttcagtcttcttccatgtcgttcgtaatcgtgggctccaagcctccaagtgcctcaatattgccagttgcttttctgtgattgtatcgcaatgacccggtcacaggaggattcaagcttacaccagaatcatttaccgatgtgttaatcactgcagttctgttcatatcatctgcaacgccattcaccagtggaccagcagctatggagtcagaagagttcgtgtgaggaccaaagctgatgacatccatttcatctgcctgaaggtgacggagatctccgccgtcgtcgtcttcgtcgccgggaaggccatcgtcggcaatgtaaccgtcgccgtcgtcgtcttcttcttcttcttcttcaccggtctcgacgtttccctcacccgcttgatcaccatcgcccacctgatcagacgtgacgccccgttccatttcggcctcggtggcaacattgctccggccaccgatgctccgacgaacgccatcaccatcagacgcgtcgccggcgaagacaatgaagcccttcctgcccagccggcgccgcgtcacctcaccgtccatggcagcgccgccgccctccacggccactgcacgtcgccggttgcgtgtgagctggtacaccagccagacactgacggcgactagcaggacgacctggaggatgtgctttggcctaagaagcttctttgatctgtggcatctgctggatggctgcctcagcatagtgaatcagtctcagtttgtgtgtgtggtggtagacttgttagtgttcagctccagattcctcctggagcaatcagaaaagttttaaggtaagcaaatagtctgaactttctgatggttaactatgttcaaaggaattacatgatctatagctaccagttatgcgccacaaatcacaaatgtttattcagaattggaaatgcagttgccttgttcatgagtttcagttcagcggagcatatgggtggctgatgaacagcagtgtaattcagaaccattatagcctaagaaaacaactgcttgtaacaagatccttatcagatagatagaacagtgtgtttaccttgcaaaatgaagctgtgaaagcactgaaaggaaaaaaataaatcttttatctcctcctggaactgtagatgcaacttgcaaggaagaagctagagtagcagtagaagagaccgtcgtatcttcttcctcttgctcgctacaaacactgctgcatctgcaagccccgatgaatttctgacgacgctttcacgccccaatgaattactccactctactccaccactgcatctctggttattttctcagcggcaagtgccacagtatcatgaccgagcacacagggtttgcacgacaccatgaacgccaagcgagaagcaagcaagtgagtacgagagtacgagagtacgagagacatactgcctccctctcaaaataagtgcagacataaagattcgtgtttagcgctttaatcacccgtcttatttgaaaaatttataaataatattaaaaaaattagtcacaaataaagtactattcatattttatcatctaataacaatgaaaatactaatcataatctttttttaaataagacgaacggtcaaatgttgaacataaatagtgctaaaactgtacttattttggaagggagagagtatatgtcgcatgagcaaacaataaagcacagaagtcacacagcgtgaaagcaacagtagcaaagttcagtaccaacagtagatgggcgcagagagaaaaggagttcagaatctgatcaggatagcaacggatcgggccgaacgaatcatcaaatctcgaaaagctgactgcgcagagctcgtagtgatggtgttcttggttcggtcaaatcgtcaaggcagcggcttgtactactgtatgcctgtgatgtggtggtgcaggcgtgcagcactagggccatgtggctgcatcctgcaacagtgcaactgctactccaatatgccaatactccgttagtacgttgtatacatagaaaatggctgtttggttcttaactaacattgccataactcactttagacaatgttaggcaagtgtggtttggggcttgccacactttttgtggcctataaattgtaagccaccctttgacaaaattaggcaaagaattgagtctatgacatataggataaaatagtactccctccgtcctaaaataagtgcagttttgcactattcacgttcaacgtttcatcgtttgtcttatttgaaaattttttatgattagtatttttattgctatcagatgataaaacatgaatagtactttatgtgtgactaaatatttttaattttttcacaaattttttaaataagacggacggttaaacgttgggcacggatatccacagctgcacttattttgggacggaggtagtaagaaagtgttgcttgccataactatggcactgaaccaaacacaaagctaaagaggtgtggcaagttgaagtattaaaccaaacagcacctttaaacctcattattttgtgcctccaatatgccattgccaatactccggtagtagtaactgaagaactgaacaagaatacccccatagaaaatgtggccatggagcttcagctcggcccatagaacatgggtttgtatagcaggataggggcccaacaagattaggcactaaaacttattatggtaagccacaagagaataaaaaaaaaatgagaatctctcttcttccattactccgggcctgttcaccttgatgtcatttttaaccttaccaaatttttggtaaagttgcaaaataatggctacatttaacttgctgctaaattttagtaattatataagaaatcctgtcaaaattttaacaagttgccaaaattttggcaaatataagtgccaaaatttggtaaggttttttttggcatcaaagtgaacaggccctccatcctctctccacctaataaaaggctaatttacaaaaaaaaaattatgggtaaagatgcccatatctattatctattcataacttatactccatttatcttaaatataagatattttagatggatatgatatattctaggaaaacaaatctggacaaagcagccaagtcgctacagcacgtgctttccgtttctccagctgatcagtgagaagtactggtagtagagcgacacgccggtagcgtttcctccgcggatcgatcgatgcagccaacgcactcggcgcttgcagctctccagtctccaccgttatgcctttctgcctgcgtgtgttgccacttggcgctttgccagcaaacacatgcgatctgtatgaccgtagaacccacacaaccacagcaagagatatatattttctttgttttcgtaactgcccaatgctcacatcaaatcctcgtcgatcgtcaacgcgataaggatatatacacggcatatacaccgtgatgcttgttgagtactacctccgtcccaaaatatagctatttctaccacagtactttatcctaaaatgaagctatttttctacctaccttctcctctcaaccaatcacaactattctttttcacctactttctcttttcaactaatcacacacctttttcaatcattctcacctactttcttaatacccgtgccaatctcaaaaatacttacattttaggacggaggaagtacttgagttttttctgtcctttttaaagcaagttcttgtttttttggaagaagctatcccgtacaaacgaagaaagagattgaacgagtaaacatctctgacttagtctacacataaccagaatatccgagttacaacactcgcagttcgaattaaccatcctacccacacatcaattccagttggatgtaattacaaatgaagagagagagaggagggggagggagagagtaaccatcctcaactatggagttaagtgcttggctcgaggtgctcatcgtgcgcagttgccgccacatcattccctagttgagctcatgtggctaagcttggggagtaggagagcctcgagcttcgtgtccattttgcctcttttccacctattcaagcttgaggagacaatggttggacaagctatggtgtccatcaccattgtgaattgtcggtcgcgaagctatggccgatctagagagggaagaaataaggatagctcaaactccatcattctctctaaatagagcttaagccggttgctgcctctagcgctctccctgtggagaactcgagctccgtcactggtgtcaccacctgcctccttcaagagggtagctcggtcaccgtgagagaaatagagagagccagagaggtgaggcatatgacatgtcgatcctatgttattcttatgttgattggattgctaaatccattgaaagcagtggtcggattatttttctggtttgaaaagttgagcgtgttggatttcaagtttttttttagtttggaggtaatttagaccatcacaaaagttataattaggactattccaaacataagtagactactacttgtacttactaacactaactcccagctaataattttgtgtagtgctgaacatttttcgtgaacgcgtaaaagtattgtacggtatagtactaatccaagtattatatagtgccaaaacaatatcaacctatcgaatggacgcacagcacgtaagcatacacaaacatgctctacggttccgtacagcactactagtagcattaacaacgcgtaggtagtacgtacataacacgtacggcatacatcaattacaagttacagcacactaggaccgacctatatactgtacagttgtacagcccgtgatatatataggctagattactactagaaaaagcattttttccaacgtgggagtcttattttcacaggcggacatgacccttagagctaaatgaccgcctacaaaaatataaatcgaagtgaaatttgatgtccacctacgaaaatcaaggtgaaattgattttcacaggcgccgcttaaatggtccgcctgcgaaaatagacttgaatataaatagacttgggataggaggagattttttctaagtctccacaccttcaccactcacggccggtaagcttatcccttcac

SEQ ID NO: 59516 - DNA, 1740 bp, Oryza sativa
ctctcacttagacatttaatgcatttgtcttggagctagtgataaactagctcttacataagagccaacatcctaatttttcactatctctttcctccacctaagcttataataggcttatagctcactattatacttgcttttacagtcactgtttcgggataatcctttctaaccccgacgcgtcgttctaccaagcacaggataaattcatgtgagtaagaaaaagataaaatgtcggttgataaataagttcgctgtcaagatcatgaaactaaccgaaagtgagttctctccaaaaaaaaaaagaaaagaaaaggaaaaagggcaagccaaagagcacgcactggttctcttctgataggagtagatgtgtcttcgcaacagggacatattctgaaggaactctatatataagggaaataaaattagggacagcctatactagaaataataatttggatgatcagttgactatttgtgggttggtttagttatatgtatatgtagatgttagcaattgacttttaacttgagattgcacaagcatgcacaaatacccttttttttcacactgatgctagaacagtgacttgtgaagtgaaaataggcagtgtatagcaagtggtatagatgagaaaatgctcaaacgaccctagcagttgttttttccaatagctctggtttttgtggaatgaagggaacttctccaaatttggaaaatgagtacagtattatatgcaacaatgtgattgcataatgtgtttggatataggcatatagcctagcacagttacgcttaatgtagttattgatcgtaaataaaatggaatcacgtgtcctcaaaagatagaagggcttatgggtggaatataagctaggtatgtactaaaacagatgttggagaccagtaacttttatatatctatccttatactgtaaaatctagtattgaaaaatcaagtatgttgaacatatattaacgttaagcatatgtgccgttgtgtcattggtgacttaacatcatgtttatttgagagtattggtgtggatttctacctattatatgaaataaataaaatattttaagaaataacataattttaaataagaggtgtaaataatgagctaccttttcttctaggaaatatattaattaatttttagaagcgtagagcaaataaaaggaaaaggcatccttttgaaacccttttcaccatcattatgctcgtgtgtctaaggctaacatcaagcagcatacgcaaacttaaaatatcaatcaaatatgaacatattccctcatactttattgatgtataaccacacataacccttgtcaccacgggtttattgacacaaaatactatccacacgaaattattcccccctcccactcccatttcctcgcaaagaaaagatgcaaatattccaatcctcttcatccgtaaccttcacccttcagcacagattcgtggaggtaataataataataataataataataataataataataataataataataataataataataataataataacccatcataaattaggtgtagttttgattttttctggtaacgtttgaccattcatcttatttaaaaaatagtgtaaatataaaaatggataagttatacttaaaatacttttgataataaaacaaatcacagataaaataaataataatttcataaccttttaaataagatgaatgggtattatagacaa

SEQ ID NO: 59517 - DNA, 1793 bp, Oryza sativa
aatttttttgccaaaacaactaaacacggtctttgagacctgataataacccccatatggcacagcaaactgcatgcgtgctgacgtgccggtgggggcggaccggggccggggacaatttttaacccgcgggtcgatcgggtcggggccctgaacataaccggggccggggcggggatgaaagctgacccgcaggtgaccctatgaggccccaaaagtctatgtctatgttaatatggcccgttactccataggcccaaacggatgaaaggatgtacacatataaggaaacctatgccttatgatttaaaatcaatcatatgccttatcatcaatcaatcttatacatcgatacatgctcaatggtgcatatccagcgaaatcccctcgctcatccgcgtcgttgtgcgccacccgcgccgtagccaacctcccgtccactcccctcgctcgctcggctgcgtcgttgtgtggcctcctcaccacaacacgacacggcgtcggtctccctcccgctcgcctcgtcgctggtccccctcatcatcgtgttgtctcgtcgccggccgcgcgcctcgtcggcatgctgcctcgcggccgcaccgcatcgtctccgcactgccatcgttggtcgttgattcgtcgctacctagtcagtcgttggctcgtcgccgtgctgtctcgttgccattggcggatccagaaaatcgtttcgttggtgtcataacgtgtctattattaatgtcatagtatactaattatatttaaatcatggtgtcataatatatggataagcagtttcttcgttacaagttttgccccattcctccctccagggctagggccaggtgaacctgcacatgagcagggcgtgtgcgcaccagcaacttactccatccgtcccaaaaaaccaaaaaaataaacataagaaaattgtattaggattttataaaataaagaaaattttatttgttttatttgtgtgtgtgtgtgtatatatatatatatatatatatatatatatatatatatatatatatatatgtcggtgacatgggaccgggagtatcatgacttagagacttgaggcagacacgatcacccacgtggcctaaccccctcgggggggggggggggtcgggcccgagggtgatatggccgcccttctctttgtctccccgaggggtcggaccgctcccgtctcggccccgagggctagggcgccccgaccccttgtggattttgcgccgcgtgtatgggttaggtgagcgcagcggcactcacctaatcgcatttattgcggtttggacgagcgcgtcacgccgcatgtagcgcagtgcagcgcgctcgttcatccggtctgtgatcagtcacagaccggtcaaatcgtgggttaggtggcgacaggcggtctgacgcacgcctcgccccatcccgtcaggacgagagcctccaagcacttgtccctagccggagccggcgtgttagctcctggagatggcacgttggtcccggtcagatatataccaggcttcatcctaaccattacaagcaagacattgtatgaagaggggcgagcatgcagattgttaaactgacacgtggtgtacaagaatgaccgatttgagaccggtctgacaatggtcatgtcgtcagcagacagccatgttcccacgtcgcgcctgcttccggcggaagtggaggtaggtatgggccgtcccatcagaaggtcattcggatggcagccatacaaatctccgtccatcaatgaagagaagtcaattggagggaagaga

SEQ ID NO: 59518 - DNA, 2232 bp, Oryza sativa
cccttgcgcagatgcagcctccttttgcagttttgttttgctgcgggaaattcggatttgttttgttttgccttttgcagttttgttttgctacgggaaattcggatttgttttattttggaaacattccgaaaaatccggtgcgtgaaaacgtccttttgcagttttgttttgctgcgggaaattcggatttgttttgttttgccttttgcagttttgttttgctacgggaaattcggatttgttttattttggaaacattccgaaaaatccggtgcgtgaaaacggcatggagtccggataggttacgcgcgacttatccggttcggtttacgcgggcgccctgatcaggcgatctatctctatataaaccgagccgccgccttcacgcaacacacgcgaaatcaatctagggtttacctcctactctgtactgcgccgtcgctcgtagactactctatcccgctcgccgacgtgcaccggtgatcgggatagcaggtctccggaacctctgccttcgacgtcctgcaccgggagaagacggcaataaggtttttggaagcgcttcgcgcgactgctccctgttcgtccgcgacggctcgccttcctctccgctcgcgtgcttcgcgccttcgtcgacgctcgcaaccgcgagtagttcctgccgagcaaccggtctttccaccacctcggtacgtgttcgacatgttgcgcatatttgatatgttcatgttttactgcttagtttacatgtgtagatctaatgatgcgttcaatctagtttacatggcttctgcatgagtgagagagtttatcggtgtgctgcagcccatgtgttcatggttgttgatgtggtaaaaaaaaagtagtttggggtggttcaaattgcaatgcaaacaaaattaactaaagatgaggtaaactaatgatggtcaaagtgaaacttaagcaataaaagtagcccaagtagcagtacattctttatttttatcaaaataacagcacaaatagtttgaataaagtcctagataaccaaggaattgaatccaataacatttatagtcatggtgcgtttttataccatagaaacactccattccatcatcgtcactaatctttaaaaacacatccctctcaataaatgtgaatggacaatgattcaagaatcaaattcctgattccttgctaaaatgaaataaaggattaccatgttgtttcggtggcaatgcccaaataaaccgtggatcagaacaccgccaccttgtgatgatcttgacaaggaagtttttggtacaacaaccaaggtgacaattggaaatggtagaaaagcatatttctgggaatccaattgggtgggacaccagtcgctcaagtacctcgcaccagcgctatataaccactccaaagggaagcatcgaacagtctgcgatgcactaatcgacaaccagtggatcagggacataaggcacgagctgaatttggcactagttcatgaattcatcaaagtctaccagtagatttgggaaggtgaaattaccttaacagataaaaccgaagacactattctttggagatagacaaacaatggcaaatattcagcaaaatcagcatatttgggtcaattcagtggcagaatcggatcaagagcagccaacctaatctggccgacctgggcgccgtccaagtgcaagaacttcacatggctgttgctgcaaaaccggatttggacagcggatcgccgacaacgccggcaatggcccaacaattatttttgtcagctttgctacagaaatttagaaactgcacaacacctcttcaaggactgctctttcacaaaggaagtgtgggacaaggtctccttaagactaaaccacaatcacatccctacgccacacaacgacgacgagactctgctggattggtgggaaagaagagctaaccaaaccgaaaagggcaaaacaaaagggatgtgctccctttcacatgatgataaattgggagatttggtgtgaatgaaaccggcgagttttcaaaaacaaagaactcgcaatgccacacttgctgacgaagatcatggatgaaatcaacaaatggataggatgcggggcaaaagatttagcgagattagtgctgtagccttcccgtgatccttgtagctctgctttcctctctgctccctcttggctatgcgtctcctctgttttttcttttggtcctttgtttctcaccgtt

SEQ ID NO: 59519 - DNA, 718 bp, Oryza sativa
gcaggggcttacgacggcgaggaagcggcggcgcgcgcctacgacctcgccgcattgaagtactggggccacgacaccgtcctcaacttccctgtacgtggcatacgcctctccaaaaatccatggcatctttctctgaactgaatcctctgcacaagcgttcttcggaacccttcaagaaatgcacgcacagtgcagcttgtttgattctgtttggttttctgaggaagattgttgctgtttttctcatgttggaactctctgcagctgtcaacatatgacgaggaattgaaggaaatggaggggcagtccagggaagagtacatcggatcgctccggaggtaaatattcagttaaccccatgttaccactgactttcaacaaagagaagttaattcagatcattacaaactttcagaaaaatccaaatcaaaacccattgaaatatgcttctctgatcagacatagtgaaatattcatgtctgagaagctgtgttttgaagtagttcttcttgattaagatcataaacctttttcaccctgcaggaagagcagtggcttctcaagaggggtgtccaagtacagaggagttgcaaggtagttaatcagtactaatctacactgaaggttccagttttctactgaacattgctagtagaatcagttaattaacagctgttttattcaggcatcatcacaacggcaaatgggaggctcg

SEQ ID NO: 59520 - DNA, 6416 bp, Oryza sativa
attcacccatcggcagcagaacaaaggaaccttgaacttgacgtagtttagctctcagatctcctcaatgcggccgtagtatgtgtttgacccaacttgatcctggaacgcatctatatggacgccgttgttttgcactgtgcttttgtcatcttgtttgacggtgtaaaatgtgtatccatttatatcgtatccttaccatgtgtctacggtccaagatggtcccatccccaacaactgtactgtctcatttgggacatccgtggacattgtcacacgattcttgaaccatttgttgaaccgagaattatgttctctgttaatccatgcatcagatcgccccaagttctcatctcggattttcgctaagtgctcctcaaagtatgggccaacttctgccatatgctggagcacagcgtaatgagcctgcgcgtacgacgcttgatctggcctaattcttttccttccgattgtgccaacacctgacaaccttccctcatgacgagacgcaggaacttcgataggatcggcatcggacatgtaattgacatagaactcaatagcctcctcggtcgtgtaaccttcaatgatgctcccctcaggtttagctctgttacgaacatacgacttcagaactcccatgtacctttcaaacggccacatttcccttagaaaagccgggccacatagttttatttgcttcaccagatgaacagggagatgaaccattatatcaaagaaagacaatgggaaaaatatctccaggtgatagagggtattcacaatatcggtctgcaacccatctagatcttctggatctataaccttctgtccaattgcattgaagaaggagcacagacattggatcgtgtgacgcactttcggtggtagaatgcctctgatagcaactggcaagatttgtgtgattagcacatggcaattgtgagacttcattccaacaagttttagatcgtccaatttaacatacttacttatcctcgctgaatagcccaatggaactttaatatccttcaagcatgataacattgcgatcttctcatccttcgacaatgtgtggcaggctggagggaggtacactctacctgtctctgcatctcgtatgggctggagttcactacgaatattcatgtcctgtagatcaaggcgcgcgttcaacccatcctttgtcttctcgggaatattcaacatcagaccaaccaaactctcacacacattcttttctacatgcatgagatcaatgcaatgacggaaatcaagatctttccagtaaggtagccgtcaaaatatggatttttttcttccacatacccttctcctttgtcttgctacgttttcttttcttcccaaactcattgcttatgtccttgaccatattgtggacctcatctccggacaaatctttgggagcaggctgaagttctctcttaccgttaaaaattttcttctttcttctaaatgcgtgacgtagcgggagccacctccgatgacccatgtataccatctttcatgatttcttcagccaccggcttcgtgtatgttccttgcaatcggagcatgccttctttccttttatagtttgtccggaaatattaccgagtgcagggtagtcattaatggtgcagaacaatagaactcttagcttgaagttctcctgaccatatgcatcccaagtttccacaccttctttccaaagaatctccagatcgtcgataacaggttccaggaatacatcgatatcattgccgagttgcctcggaccttggattaacaagcacaacataatatatttccgtttaaagcataaccatggcgggaggttatagttcgcaataagaactggccaagtgctgtgagtactactcatgtcacagaaaggattcatgctatccgtatacagacatatcctcatgtatctagggtcagcagcaaagtctttgtgttttcgatcgatattcttccattcaatcgaatccgctgggagtctaagcataccgtcattccttctctctgtggcgttccaacgtactaactttgcttcgttggggttggcaaagattctcttgaaacgatcaatgataggtagataccacacaacctttgccgaaccacccctctttgatttctttccttcgtcagcacttttttttcgcttgtatcgagaagccttgcagacaggacaagcatccaagtccgcatattgcttgtggtacaatatgcagtcgtttggacaagcgtgaattctacggacctctaaccccagtggacacagaacctgctttgcttcgtatgtcgtctcgggcaatgtgttctcaacaggaagcatagccttcaaaattcctaaaagatctgtgaaactcttgtctgtccatccactacttgacttcagcttcattaggtccaaggtaactgacaacttagtgtgttttgctttgcatccagcgtacagaggcgtctcggaatcactgaccaacctgctgaacttcattccatctctctcattctgggctgggtcctcaacgtcacgtaacatgtcttgcagcagatcgtgatccacatcaaccatttcaccgcccaatggagaaggtataaacatgccatgctcatcttcatcttcctgattatgcgcaacacttctgtctgctgctgctccacttcctaattcttgctctccatgcttcacccaacatgtatagccctccatgaatcctcgttgtatcatatgaccatgtacgtcctctccgctatcaaacatattctcattcttgcaatctgcacatggacaacacatgtaatcactgtttcttcttttccgatcctcctccgcggcgttcataaaatttattatgccctttctgtactccgtagaatgacgtttcaaatttttcgcatacatccaacttcgatcaattgctacaaaataaaaaaaacaaattacatgcacatcttataagatcagtattgcaaaagtaagacgtgatgaatttgctcaattaatgattaatattagtcagtcggttcagccatgctggtcactgtagtccagctgccctattcctagggaaaaacacgaagaatcgctccataacgcctgccccgatcctaccatccgggacggcccagaaccagacggggatgtgcgggccgtctcatgggcgtaatctctatcgggccgccgttcgcccgaatgagatatggtcgcacaaccaaggtatatcggcctataactatggcccgtcacagataagtgtcatccgtgacgggctttagttttatgccgatataccatggttgtgcgaccatatctcaatcgggcgaaacttcggcccgattgagattacttccttgtgacggcccgcaaattccagtcttgttatgggccgtcacagatggaaggatctgtactagtgtttcttaattaatcatcgtgtaaaactttagaaataattaaatttggttagagagagaggctacatttattttttcaaaacacacagtatagacgtaagcactcatataaacgtgtgcacactcaagaggatataacaacactaacatgtctgtcacacgtcagaaggatgatacaaaaattaactggtagcatgataacttataaaaatatatgatggaaataggtagaaacttggaaattatcttcaatcttagttttttttttcaaaaaaaacttcaatcttagaattccacggaagtacttaaaaaatctgaaaaagcacacatgtaggaaatatgtaaatataaagctatcgatagctcaatcagttatatcctctgtgtgtaattctaaaatacacaaaacaaacaaaaaataatactgtttcaaattttgtaaaaaagaaaatatataaacatattcgcggacgggccacgtgtcaacaagcagctagcgaatagttttcgctagtgggtcacttgtcgtctatcaactagtttaatgctttttcgctagcgggcctcatatcatcaaatgccaaccgctagtaaagatatattttcgctggtagcccttagttagcagccaatgaagacaatttttgctcggggctgacttaagccggctgccaacgaaaacatttcttctatttagaggacatgtatgaaatgaggtggagaacatgcacacttaatatatcccctcacccgaacacatgttggcatatatgcaagtttgtcgtgggctcgtagaattattcagacccatatgctcggtgagaggacgatcgcctgagccgtcattttgctcccccaaccataatctatccttggattacaatcaagcatgacaggggtggacaaaaagggccttgtcttagcaagtaaggtgtccatgtcaagtgactgctcacatagtgaaattgcgtgagttccactgtacatatatacatgcaatgcatgcatatatgcgtgtatatggcttctcattggtgcttatgagagtaagtaaaaaggtccgagctaataagatacccacaatctgtagtagttcgcgtctcctcccaagcatgatccaactgcgaaaaagatgcttgaactgatcttgggctgatcaccatggcaagcatcatctgttgtgtcgtccgttatgcaaattgtcagatcatgtatactccaaattgattggaccgtcatgctatcctctaggtaactctagcgaatggctgctggtggaatctttttgttagaatacacacaactaaaatacatactaccaacaaagttgattttctcccttcatttatttgaacacatgcattaagcatgaatcattgacaaaataatatatatatatatatatgacagaacaaatcattggggaaaaaaagataccagctagctagctgtttaaggcatgtccagtttgttaccactttctctctttttttttccgtgaagacgtaaaataattgcacgttaatatattagaagaaagtagaatttttttttgttacacaacacaatcagccagacaaccattacctgggataagaaagaaagagaaaaacaaaaaagggctgctaaggtaaaataaaaactactactgaaacgctgaaaggtttgttgccacttttaacattaccaacttttgataagacaacaaactaaacacactttaaccattgctaccttcctaaattttagtagtttgtagaagctttatatcttaaaactctatcaaaatttgacaaaagcatcaaaacaaacaaagccaacactaccgaaatttggtaataccaaaatatacgaaaatttagcattaccaaaatatgcactgataaccctctacacaattaaagatacacctgagcatatttgtggataacaaaatttaaaccctgtgggtcgatcgtatagtcatgcacctacgacgccacgactccactatcacacaccgtaccgatgtctctaatgagaaaatacgagtaatttacttatactttaatacatatagaaatctttgctttatccggcttcatctatttaagttgtttggttaaaaatattaactgatacttacacataaggaggaaacaataattaaacaagtacataaggttgtggagtccttattctgtacaaagatgtttcactgtaactaaccatctaatgagctgaaatttgatacggccggacaatgtaccagaactagattttattgcaccaaaatacactgggatacattacaagatgcaaagcaagcgatcgctttgagttacagtaagcagtcctaagagtcaagccctgccaatcaaagaaatcaaatttcctcaaaatacgaaagaaattgaaacttcatgcaaataccggagctagctgacaaacacactgtcaattgcatgagaaaatcagtttatcaaaaaaagcaacaaatgaagcacgcatgtcgatcgacgatgagaaaccgaagcagcaaaatatatatctgatcggacaacagtaagtggggtctgtgtgaagcgatgcaaatgcaaccaatcttgactattgatatgatcttgagttttattcctagcattttgggagatccaacggtggaggcgggagcttctggtcaggacggctgccatccagcaccagccacgccattttcagtccccagctcatgtgcacctccaagtgacaatgcatgaaccacacacctgagatcgtgcaatcgtatcggcataagtatctttgatgagttataattgcaaactgattaactaaagctaaattaagttggtgcaaatgtggaatcgcaggggaatcgatgtggttcagagtacatgcctgggttgtctgcgtggaagcggatggcgacccagccgccggcgggcacgccgacggtgttgcgctcgacggggtcgtagaggttgaacttggccgggtcgttgatggggtca

SEQ ID NO: 59521 - DNA, 27466 bp, Oryza sativa
  unsure (1)..(27466): unsure at all n locations
agaaacagtataatgacaagctgactgttgcgacactccaaagacagcggttgacactcccagactctaggaactgctaattggccgctcgcggtgatcgactcgatctcgtgcacaattaacatgcgtgtatgttgcatatcgaccaatcaccaaacaaagagcattgtccaggcagccacctaatcacatactttcatctaaaaaaggttgtaagatactttcgatataggttgtaagatactttcgatataggctggtggctccttgtttaggccctatgagctgaggtggcacccatccaagaccaaggtgacgaggtgcatgggctgaccaacagctagagcgacgacattcatgtggagcttgtctgaccaagtactcgctacatgcgactgaggccctctttagtttccacacaaagattttacactatatcatattgaacgtttgaacacatgcactaagtattaaatataggctaaaaaataactaatttcacaaattgcgactaatttgcgagacgaatcttttaaacctaagttctccatgatttgacaatgtggtgctacagtaaacatttgctaatgacggattccaatttaccctaataaatttgtctcgcggtttactgacgtattctgtaattagttttttttattagtgcacgaatacttcatgcaacaccctatataatacctcatgcgacacgctaaaactttacacccctagatctaaacaccccctgatagcggcaaggacagcatcctacaaggaggttggtctgcatgctctgtgcgagggaagctagcagttggtcgggactcaggactctcatggcactcgcagtgcaaacaccacagcgcgggtcctagcccaaaaagttagcctaaagactctttcccacaatgcaagtatcctattttgtatggcttaattggatgaaggtattgtggaagaaaaccagcccacagtgcgtgttaccccaagcgtgtggacatggggagcggaacgaaataaattcctcacctacccttctagcaactcgtcttctcctagtccatcgccctttgcctcatcccagccaccgcacccgccgctcctcctccccgtccacacgcatggaggattcagtcgccactcaccgctggcgcaggctcttggggctagagcctccgtccaaaaaaaactaatttaagtgaagatgtgagccatcccaatacaacgaatctaaacaaaaggttcagattcgttgtgctagaataggtcacattcgcacctagattgagtttttttggaaggaaggagtacctctaacgtactccctccgtcccataaaaaaatcaatttagtactggatactagaaaatcaccggcgcactcaatttatagcctgtatatattatttttgtgttattaattagcgcattttcataaaaaaaaagtatagaaatcagtttagtttccttgaaactcatgcaaaaattatagttgaatggaattttttgagttccagtttaacataatcgatcatattgtagagaaattcatcaaactttctctgttttttccgtctatactattaattcttcttttgtttgtctaaaattacaattaaatttctattaattattcttttgtttgtctaaaattataattaattgtttgctaatgataaaatagggtcttggtttttttaaataaagtgttctagaattttgttttgttaggagtcacaatgatttgttgggattaagtcatagactttgtataggtatttatattgacggctaattagtggtaggtgatatatatgttgaccatgagttatatatggtgattccattaattttaagagaaagtctattttactcccttaactatttcaccaaagcacttaacctcctaaacatttttttttgctcattttacatcccaaattattgaaaacggttcactttactcctctaatgctatttctttctcttttttaatttctctatgtaagtcatattttgcatgcatttacaacatacatctcaacatttctttttattttttttttctcacggtttatgtaggttgaaagcacttaagactaatttaaacatcaaaatttaaagttcaagcaaacatccataacaaactttttaaaaaatgaactttgataatgatcccatgtatggttcagtttaaaatacaacttatataaagagtaataaaattgagaaatgccactatggagtaaagtgaactgagccataaattagatttttttttaatagtgtccattgaattagttcaaagaaataaaatatttttttattttaagatatgcagttcagtatttcaaaaatactcatagatatatgtatgaatatgagtagttgtatatgcattcaataattttttgtaaatgtactatagaatactaatgactattgaacgtgtacatgtagagcaagtgggctgacataggcatttgctccttcccctgattttgagaaaatcccctatgtacccatgaaagttcacctaatcccttctatacccctgaattttactcaatcccttacatacccctgaattttagtttggatcccttccatgccctttccgctagttgaccgttagttgactgttaaattcttttgaaaaaatccattttgccctttgctatgaagaaacataataaattaatgaagtatattgttggaatgtaaaaatttattagatgagactattatatttatgagtatgtgatgcaccatattatttgtgacaaatttacttttacatatgatataaaaagttaatacttatttattagttattaaaagttcttttatgtagcatatgtgttttcatagtaatacaacatatttatttattactatcagaacacatatgctaaaaaaacttttaataactaataaataagtattattttttatatcatatctaaaagtatatttgtcgcaaataatatggtgcataactatctcataaacataatagtctcatataacaaatttctatgattcaacaatatactctattaatttatatgcttctttataccaaagggcaaactggacttttttataagaatttaacggtcaactaacggtcaactaatggtcaactagcggaaagggcatggaagggatccaaactaaaattcagggatatgtaagggattgagcaaaattcagaggtacagaagggattaggtgaactttcaagagtacacaggggattttctccctgattttccatagcgttgggcggctagctaatgggcttcttatgcatgaggtgctttgggcccagatgaacgcgtactacgcgattgatcgagaagaacagcagccgcgctggagagaatcatctatacgtcgttggttcatgccacgtgtcagaaaaatacacgccgccatctccaccaatcagctggcaggaagacccgccagctttagatataaaaatatgatatatcatattactacaaatcttgatatacatctcttaagattcactgtattgtgagtgcaagcaccacagcccgggtcctagcccaaaaagttggcgcaaagacactcatccccacagtgcaagtaccatattttgtgtggcttaattagatgaagttactatggaaggaaacccagcccacagtgcgcgttaccccaggcgcgtggacacggggagctagagatggcaatgggggcctgttcaccgtttccccgcggtgaattcacctattaggtgacggggatggttaatatctactcaccaaggggaataaaatggttaaaaacctctcaccatcggggatgactggggcnnnnacannnaaccattcaccgnccccgccccccacggtgacccgactatactgtacaagggaggaattctagactttttagatgtattggcccataatattgaagcccatttaacagatacatatataaacacacatatataatctaaccctaagtcaacaggtcaaactccaaattttccacccatccagatccagatccacaccagccacccgaccgagtcacacgcgccgccggtcgccagtccacctggagccgcgcgcgccgccgttcgccagccacctccggcgccgtttgccagctaccacgcgcaccgccactcactgccttctcgccgggagactgaagctgccgtcgccggccgccttcgtcgatgcgccgccgggccacgtggcgcctgaagctgtcttcaccaggagcggccggcaggctccgtcgatgcgccaccagcctgtagcctcttcaacgggagccgtcgtcgccgtgccgccgggagtcgccgtcgccgcgccaccgggaactgccgtcgccgctgccatctgccgaccatggcttcggccttcggccacctcccccctaaagctacaacagcgacgatgcaagttgagcatactacaatctgtgactgtgaatatattgtttacccggggacgggttcaccatggggaaaaattcaccgcgtggtgatcggggctagagaaattatagccccatcgtggttgacgggggcggggacggtgaaatattttcaccgcggtgacggggacgcgggcatgacccccgacggtgaattcaccgttgccatctctacagggagcagaacgaaaaaatttcctcacctacccttccagctactcgtcttctcccagtccatcgcccttcgcctcatcccaatccgccacacctcctccctgtccacacagatagaggattcagtcgccactcgccgctcctcctttccgtccacacgcatgaaggattcagtcgccactcgtcccaagaaaaaaaacctaatttaagtgaagatgtgacccgtcccaatacaacgaatctaaacaaaaggtccaaattcgttatactaaagtatgtcacatccacatctagattgagtccttatttttttaagggaggcgtatacctctaacgtattccctgtcccataaaataatcaaccagtactagatgtgacatatcatattactatgaatcttgatatacatctgtccagattcattgaattgtattagaatgtgtcatatccatctagtttttttttaaaggatggagggactatgaatcacatactcctatgtaacatgaccaatcatctcatttcaaggctcataagagtccacgatgatataaaggaaaaaaaagtatgtggaatcttgataaactttttaaatgtttctgcagttcaaaaaaaggaaaaactttgataagtttctataactgattgttctttctacacagatgtgagttgtgagcctttaaaaattgaattgctaactgtgagcttacagtagcaacatattttctgtcgaaaatggagatggctttgtacagcccaccaaggagagatggtagggttggtaaatggtgactctcctgtaccttggtaattcaaacgaactgcaaaaaaaagaaaatgtgtttcctatttgcctttaggaagagtgacaacattaaatttagacgcatcaggtctcctcgcccacttcagcacatcgctagctgtttctgcaacgtaggaaaagtaaaattacatgcatctccaatgccacaaattcttccgaggaaatatttctttatctaaaagaattccaaataaataaaaaagcatagacatgagtaaaagaattccctatgaaaatagaaccgtgggtgatgtacacttgttatctaaacttgatgattacacattctgtatgcagcatggaaacgttcatttaaaaatatggtgtcacagattcatacctgaatgctacaaattaggttgggtagcatccaactttgtcgtatgcgcaaagttcatggttaaagtttccaatccaatcatatgctcatccagtttcttcccttgaatgcttgaaacaccactactggcattagcacaatcagaattcccgcaggcagatttcattgtagtatcacaaatgctcatttcatcagatgaaaaatccagatgattttgaacagttttcaggacagccaatctttttgaccttagtcgatatggaggggaaacatcaagactcccttgctcatccataggacccaaggacaaaagtgctgcagttttgaatgactgtgggctatctgtagtacactttcctatgggagtgtggaagtcatcactgcttaatctgccaatcttcaaatcattatcttcagcaggcgtcggtttatctctttttcttcttcttagtattgagggagtaccatggaatttttcagcagcacttctcaatatggattcaacactaagctgatctgatccttttccatgagtgggtggagtagtatagccattgggtgagtgcattacgttcctagagtgttccggtacataatttgctgtaaacactggggattgggcaggagcaatgtcttccatcttaggtatctgataacaaagagaaccaacagagtgagcctcactctgcaaggatgatccgccgccattaatggctgcttcaccttctctcttagcttgtcttgaacagcccattttatctgatatctgattaattttaagtcccttgtcaccaagaaaattgattccctgaaccttcccacaaacaaaattgttcccagtacccttgtcatgaacagaatccattctcattccctgtgttgctagatcaaaagcagaatcatcagctgcagaagcctcacatgaagttactggctgaccaagtgagaggtaatctgcacagcccttaaagtctttcaaattggatgcccgttgatgagaggtagggtcagaatgaactactcctaagcggtctcttgaacagataattggctctttgtttaagtcaaaatggttgtcagcaggtggccgctttggtaactgtttcaaaccatcaccaacaactggtggatgaactggcagaatatctctggtattgtagtcatctattttttttcttaatgaactgttccaatggttttttatagaattgtctgtcctggagataagaacaaacaagcatcagtgtaagctgaatatttagaagcctaactgttcgattagtaaagaaaggtcaattgctgtatgaacttaagacatgaaaatagcatagaatgcagaagcacatttacaggaaacaatatgtacgtaaaaaaacaaagtactttcaatttcaacagcaatagccctagtgcacatcatctgtttggaacagcaaagcagcaaaagtcacaaaatcccatcaccagattacatttatatatatgtcacaaataactcatttattcaacaatttaatttattaatacacaagccagacgttacaactgctaagacaagagcaagcacaaagaatccataaaacgttgccacgagcagtgccgttagtgcatttctgtgtctaatttacatgagtaaacaaaaacactttacataataatgctgcggattagtaccttccaggaagaagtttagcaatttctgcccatttattcccatacatacaatgagcacgggcaagcacacgctcctcttcaacagtccaagcttctttccttatttgtgggtccaaatgattatgccacctaaattatatgggtacatcagaagtgaacactgattcatacggtatgtactttattatggcaaatttataaataaacaagaaatatgtaagaaaccttactacaattttataatcccgatatgttattagttctgaactaatattgaaaatttagctggatggccaactgaccatttaaactgtcctattttaggaagcatggatatgtcgattaaaatttaacatgtagagaactctgttattactaaggctaggcaaaattactcatgtaaaaaatgtcatcctgcttaaattttagtaaggcacaagaatgttcaaattccaaggacaccaacagttgatggtgtatggtcttagtgtcccttcacttcttacctcatgtagaccgtctagcccatagggtaaactaaacatatagtgctgtttcacatatattaaacacagaaggcatcaaagggcaaattcacaatcaagcagaacaggtgtattgtgtgagattgccaagagatttgccaactgaaagcatgaagttgtacagaagtgctgtaccaaatgtggaaccagaagttgtatagtgactaggagctggaagtatattgtcggtcatgtctagcctcagtataggcattgtggtggtcaaggattagtttgtgtaaaaacaattcttggtaggacgccaaaacttggggcgttcctgcttacaaaataaaaaccaccagcctccaaagtggtgattcagaagtaccattatatctgggcctaaattagatgataacctcaataggtgtcatccagtttcaataaccccaaaagtatgatcaaagaatctgactagttttttttcacaatttacctcatcaaggaaaatcaaaaattgctaactagtctacaaaatgtgaatgcgacatttcacttgtagtagttgattgcaatttacaacatgcatggtaatgttctcaaaacaaatacctctctcggcattgtttaccaattcgaccatttagtgaccttgctataacagaccatttttttggtccatgcttctttaccatattgatgatgacatcatcttcctgcaaaagaattcaatgaacaagcagaatatacagatttgaatttatggaaaaataaataagatatttgacaaacctcttgggtccatggaccttttataagttcaggatcaagaactttctgccatctatgcagacattgtacttctgtcctatcagagaaagattcggctgcacacatacacagtaaataaacaaatactgtacagttttcacaaaagaacatgaaactgacactaagttgctaaatttcattgttatgaattactgcccagtagtttcttaaaagtgcaaatgccataaccccgccccataaacataattcacatgttttttttttcaaatagatcaaataatttgatgtgctggtacttgacaaatatgttttgaatttttttttaattgctaaaattaacattatgcaattaactgatagaagtatagaaaccacttataagttattcaaataatttacgcaaggaaaagatgagaaccacactggtgggctttgaacattattagactatatcattgccgcactggtctagctccaggcacaaagaattgtaaaaaccattgaaatagtatttgtgtgtgtcattggagggtatttgtacgataactctaacttatgggtgcaaaataaatgaaaatttgatgctggaggcaaattggacaaaaaaacaggtggctcatatattttatgtatttgttttccctctttgaaactgttaattgaatattatgcgcaggatgcagacaagaaaagagaagcaaacctatcttcttccagtttttgccattataaatatcaactgccttccgcaatttttcatcctgcacccaagtgacaagaactaggtaaacaaacattcattttgaaatggatgccgtccaacccaaaggaaaagatccacacataacaatatagaaaggtaatggtaagtttcatatgcaaaaggtaaacggagtgcaagataacactgcagatagagggaacagtgaacaggtaggaaatatagtagaaaatagctaacctcttctggtgtccagccacccttagctctccttaccgggccactttttcgcctaatatgtaagattccatcagcaccacaaatataagataaaaaaaactatcaatagctcatgtaattatggaaaacttgactaggatccagtacagtacataaaatacaggctgtccgattgaaagacacaagccaggttagaggaagatgacaaaatcagtaaattctagcaatccagatttctcatgtgccctcaggcaaggatgtggaaatgccgcccgtttcagaaaaggcgattaacatcaagaaacaaaagatctagctgattttcctgatcccattttaggcaggatatgtgtaatcatacatgttagaaatccaattaattaaaagaagtaaaaaaaaattaccaatccatctggaaaagaccaagtgcttctggttactgcccaatgctcatccccccagaaaccactagctggcaagttacttgggaaaaacaaactagctggctagtttcccctttttccccagtaccagtttcatttttttttcttaagcctcaagaatgattactgtactttactgttattaaacctgtagcttcttacagcttactgatacagtcactcccttttagggaattaatatgataagtactgccagcttaaaaaatgttttgtgagtaaaaaatagacagtcaaaggaaataagcatagccataaaaaataacacagctctgttactacttactaccatcagactgtaaagcccctattagaccgtgttactacttactacatgatccaacactcgtatgggatacttttccacgggatatgattgccgtctaaagcccttcatcacactaatttcttcccccaccacatcgctcgctcgctcactcactctggttttttaagcagaacagcaagctggagagaaaggaagtggatggagcagtgagcggaagctaagcagtggataggtcgctgtgtaagggaacaggcaatccacaagggcactccatgtgcgttggaggcttgagaagcaaaatgtgatgccctggtcaaagataagcacagacacgtagatcatgctgccaattgccttgggcatggcagtttgccaatagtttcgagcaagccccaattcagcttcatggtctacatgcttgaaacatggctggttttgcatttctttcattagcaatttgcactggcaatttttagttggaatctgcaaaactttgaaaaatctctggaaacatgagacttgctgaaacacttttgaaactcaattaagcacttattagacttatggaaacactctgggacttgcttacttgctggaatttcttacgaaggttgtcaaacctgtcaacatgttattaaacttgggtttgaaacttggcgtttcattttttaaaactatctaaacatggtgttttagtttttgaagctcccagaaactgcaaggaagtatttgaatgcttggaacatgtcgaactttcctatcctgttgcatcggcgtcttttttttttttgcagcaagtagcatccttataaaaattcataaaataactcaaatggaatatctcatggatgaacctttgtctcctacatagtcatcttgatgggtcaactcatattccagtacatgaaaaatccaataatatagcattacgcatcattcagaaactgcaaatcagctattacaggctccaaaagacatgactcaactataaaatcggtataactatttatctaaaaatggcatagtttcatggcattagtggagatttcctgaaacattataaataacacaacaacttataaaaaactgatttctgcattcagaagcatcagcttcttttttaaaaaaaaaaactatccacatactgaatatatgtccaatccaaaagcaaatgtcgaaataaaaaatggcattttagataaacagggtgcctgaaatatgatgcactaactaataacacaccgcagatatgctaaacagtatagtggatacttgcggtttaaatgatcaaaacacacacctgaaaacaaacagacgataaactttactcattttagcaatcactgcaaagcgacttcaccgtgcctcaaccaagaaagcatgccaatttccaaaacaacagaactagatacaattacccagtgaactagagtactaaaagaacaaagcaagcaaaacccttcccaccattgaagtgttaaaagtgtgatggaacaaaaattcattcaacgaagactacagctgtaaagaccagcagcaacggcaagatacatgttaaaaggtcaaccaacagtcctgtccaaacagccgtcatgctgcacaaggaccacgtcaccaatcagaaataaatccaaaggccacagatttctcaagatcgccaaagctgctgcgatcgcaatccaacccagcccagcccagccgcatctgcgaacgagacgaagcataaaaaccccatctttcccaggcaaagcacaagcagcgacccccccgtccggagttccggaccatagccccaagcaagcgggggcatccgaacgaggcaaacaaacaaccacccactactacccaacagccaacagcacagcgacggtaagttgagccgcggcgcgggggcggggggatcactacctgcgaccgaagatggaatccgccgcggtgggcgacgccagcgcggcggcgtgcgcgctcccctccgagaccgaagggctcgacgccaccggattccgctcctcctcctcctcctccaccttcaccgccggcatcgcgcccattgatctaccgcctcatcaacacctccgccgcctaaacaaacaatcaaaaaaaaaacaaaacaaaattcccatcagaaacactcccccaacttaaacgcacctcgcggaagaagggaatcaagcgccgccgcttaccaaagccgccgccgcccagatcggggggaagcggaggatcgaatcgaggaagcgggtggggtgggggaaggagagatggggtggcacgaaaccctaggcagggcaaagggagcgagctcctctcctcctcctgcgcgcgcggctgcccgtctgggggtggtgttgcggcgcggcggcttcgattgtgtgttggggaaggaggaggaggaggggtttcaaaaaacctcgcccgttgaaggaaaggaagggaaaaggaggcgaggagttagcagacggggggaataatttactcccggtcctggatctttttcagataggggctccaggttactggtaatttcttgctaggtgagttgttggtagccatagtatctttattttctcctttcctaaaatatactcctaacaaatctggataaagatctgtctaaattcgttgtattatgatatgtatcattcaatcctatatcgttattttttgggaggggtatagtagtatataatattagtattacttcatccgtttcatattacaagtcactttgatttttttctattcaaatatttttatgtttgatcgagtttatattaaaatataaaaacattttcaacacaaaataaatattttattaaaatatatttaatgttagatttaatgatattgatttagtgttgtatatgttgctagaattttctatttcctccgtttcacaatgtaaggttttctaacattgtctatattcatatagatgctaatgaatcgagttcatataatgtctagattcattaacatatatatgaatgtgggcaatactagaaagttttacaatacgaaacggagggagtataaaattgatcaaacttgaagaaatttgaataaaaaaagataaaatgatttataatatgaaatggagagagtagttaatattaagtttgagtaataaagctgtagttttcttacaactccgtactaacaaaaatctcaagcgattgattgatcattgattccatttgaaatataaatagttgagattcaatcacaatattatacatcagattttgtaaaaggttatataaaatatagtatgtatatcttttattatttattaagttagattagactagttaggcgtgtaaactacaatagtgcattatgttatcagcattgcatatcaattaattgttttcttaaaaaatagtataacataagctaagatgcttatttttctcacgggaaaagtaattttataccctggaatatgagttgcattacgtttgcttcatgcaatcgtctgacgtcactagtggagaaatcgtttttaggcccggttcataacccctctataatcccggtttgaaaaccgggactacgaatctgggactaaagatccctatctttagtcttggttcaaatacccgggactaaagatcgatctttagtcccggttggtggactaaagatgggagtgggcaatagttttttttcatttacttactatttaatctctaatttattttctcccaaattaggtgggatgcgtaccatcccaaatacacaaatcaatcatatacactacagattatacatcccaaatcaaataaacatcccaaatatacaaattatacacaaatcatgtacatctcagatccatacaataagattccaaaaaaaattatacatctcaatctatacaatgaaccacagattcttcatatcattctacacatggatcacaaattctttgaaaaaaaaagaaaaaaaaacgaagcaaagccgccggtcggctgagccggctgccgcctcccctcctccccggccgccgcgcggccctccgcgccgccaccgccgccactgcgacgccgctgcgccggccgccgccacgcggccctccgccggcctggccgcccaccccctcctgctgcgcacactggatcgagttgggaagggataagaagaaaaggagataaggaggaagggaagagataagactagagatggagggagagaggagtgggtgtggatgagaaaagagtggacgagaaaagatgataagtaatagagataatatactgcgttttgatctttaatcccggttcgtaacaccaaccgcgactaaagatcctggaggggcctgacaacacctgacagcatgtgaaccgggactaaagatgacaccaaccgggactaaagatcacgtagtcccgttctacttataaaccgggactaaaaaccatctttagtcccagtttttactgcatccgagactattgtggtttttggtcgaccgggcaaagatggtttttcactagtgctttttaagaagaactacgctctaggtgtcaaagcttactagtacagttatattccttgtccaattgtatcaatcccaatgtttcttttggtcaaccgacattggaaggttgtgttctttcccccccctcctttcccaacttatcttccatatttttcacgcgcacacttcacaaaccactgaacggtgtattttttgcaaaaaaaaaagtaggaaagttgctttaaaaatcatattaattcaattttcaatttttaactaatatttaattaatcatacataaataaaccatcccctttttcgtgcttcttccttccaaaatgcatctgaagaattgcacccgctgcaccgaggagggttcacaaaaccgatggaatttcgcgaaaatcgaacggatttcatgaaactactaggtctcggtttatgaaaactggtcggtattagccagtttctgtacggcattgatcaaaagtcattggtttttactagtttttgggtcggatttcggtaaatcgatgaggtgcggtttttacttcgaaatcgaaaagttaaaccctgtcaaggatactaaggccctgtttctttcagcttgggattattataatctagattattgagtcaaattactataagctagattgttataatctatagtagaataagcggttagttgtttctttcctagattattagagcctagattattgggtttgcaagtctaaagagggagtagggtggcatggtgggtaatttttcacccaataatctggaaaaagctcacctaaatgagattatcatattataataagccgggctccaaattataataagctacttcaataagttgtctgtttctttcagcttactcccaataatctggattataataatcccaagctgaaagaaacatggcctaataaacacagaagaccaacactctcatctttagcataacacatactccctccgtctaaaaaaaccaaatcctggctatgtatctggacatgtgttatgtccaaattcatagtaatgagttttttttttccatagaaggagtaagtcataacagcatcagatcagaggggttgaaggaccaagcggaaattatccacaactacaagggggcgaatggaaagacgctggccagccagcgtgcgatccggggacggaaggaactgaacaaacggaaaggaaagcgacaggcggcgaattcacggcgcggtgacggcgccgtcggacccgagcccgcgtgttcggtgcgatgcgatgcggcccccgctaaaaccagcagttaccgttgcgggtccgagcacgaggctttggtggttccagtttgaccgtttgaacccctcgcccgggttgcatggaccgtccgatccttccgtgggccgctcggcgccgttcgatgatcgctgccgcgtgcggtcgcgggcggtgggcctcgcgatcgttcatggacaacgtctacgtgtggcgtgacgcgcgtcgttgactcgataggaaaagaagagatgcatggtgacatactgacatactccctccgaaaaaaaaaaaaaaagaaagaaagagataaatcctgatttccatgcccaacgattaaccgtccgtcttatttaaaaaaaatatgaaaaaaattaaaaagacaagtcacgtataaaatattaatcatgttttatcatctaacaacaatgaaaatacgaattataaaaaaatttcatataagacggatagttaaagttgaacacggaaaaccagactttatcttttttttacggagggagtatataggtcattaatgtattttgtttttgtttgttaggggcactgacgtcatcgatcccttccagaagctttgtgaaattgctaaaacgcaattggcgtagatttatctctattatttacatggtgttgactgagttaagctattcaacgggaaacagtgttgacgccgtcacaatttgtcctccaaggatctgtcagtcccatcggatggcctaataagccaaagaaaaagctaaattttaaattttcaagcttaattttaatattgattttgacatattttcaacgtagtttcttttttaacattggcttttaagtcacaaagaacacatttataaaagttttacccataaattcatttttatttcctaataagccgttttggcttattagtaaataagccaaacgatggggacctgtatttttcaggttgttcgaggaagtcaggagcatatgtttccaaaattaaattccaaattttaaattttggttgtagagggatcatattttaatttgctgaaaataaaagattaagtccgagcaggagtaacccattaatacataattaattcaaacttgaaaaaaagatgtgttttatgttttaaagtaaattatacatgaaaagttttcatacgaaacgtgctaataaaaatcaaggtaaaatatgtatctcaaacacgacacatgtactcttgaatctgtgagccggctataaacagaattgaattgtctctcagactacatcaaacacgatatatgtactcttgaatctgtgagcctaagcagaattgaattgtctctcgaactacataaagtcaaaatcaattggcattgaaaagctcacaagtggctagatggttaactagaacatagttgtttctccggtgtacggaattacgatcactgatcagaacaacatttgatcactgttgcatgctggctgcagaatctctcacaaaccgcaaatctcgttttctggtggggctgcaaaaatagcaaaagcccttggcgcgctgaaactgctgatctcctgggccgtatgggcccacataagctgggccaaacctctcggcccgagaaggacgcgcccataccgccctacgtgcgccgccggctgccgccgtgccacggcggcgccacggcaccggcgacggcgatgtgcatgtgcccgtgtggcacggcgagcgcgccgccggtctccccgtgcagccggccgctcacctggcgcccgccgtgtccgaggcgccgcgtggcgtcgggtggcctggccgtgtccgcggtgacatggtcaccaggcgaccactggagcgcgtcgtggccgccatttctcctcttttgcgcccgtggctcggctcggctcggctcggcgccccgtcggcctcctcggtttaacttagctcggtggcaataaatggcggcgccaccgcttgattcacgcagggcggcgtgtcagacggccatggcggcgtcaaggtgagatcactcctctcgttggaaccgggcttcgttttatgctgcagcccatgtgttcgactgaattcccctgagaggtctcgagctctgttgctccgtttgatctgcagattggaggtttgcatacttacacctgcaccttacacgtctagatctagtatttgacagttgataattatcatctcttgcttgtttttggctgatctcgttcgtgtacgtgggttgacttctgcctgcttgctttccatcgttaatttctgcaagtgcaatttgcaattccatatgtttgatgtgctagttgtgcatacggcatactgatagtctttttcatcggcccgaacgatttctataccagttctgggcaacgatttttgtgtccatatttttagtggaattctgctccaaaatggcatccagtaggttggacgcttgtagggttgggtttgtccctaaatgctaacatggggcagcttgtcccccctgaattcagccaaataacatgcttttgtatagaaagagacagctcttaaccttctaacccaaaattagttttatttttcacttggttgcttctgcaagcaatctcagcaggtgtccgttgtgtttttctgattttccttaggaaaggttgagaattgaaagttgaaatgcggctgcacaaataataagcatggagagcctcatgtgaaacatgtaacatggttatccatcaatggcttgaaattttggagagaatttatctttctagaaatggaccatcttgttgtttttattcttctatagcttcctaagagaatataatcagtactagatttgtgttgagtgtgactttcctcttgcacttcatttttgctttagtcgtatacttgtatgcagttacataatgtgtttaatcagatgctttcaaatatcataaaatcttctacctattcagagtgttctgtttcatttcgcagttctagcacacattttgttcacacgggacagaattggtggttttaaagtttgttttccatctaaaatttccgtactccagtattggtttcctccccttttatgctgcatctccccagggagcttacatgatttctataatcttgaatccttagcttttgtcggtcttaattctgacagttttcttccattatatagacttggtagctctgattgtgacgtcctctatggtacccactgttgatctgagcatagttgttggcctttcaaatcatgatctttcaggtatattgatgtcactaagctacacagaactgaggattgatatagactatggcatctttatgttgcaaatggctgttgcactggaaaaatcactttctacctgtacattttagctgtacttagcttaatatgaaccaccagatggtagttaggtcgccttgctttagcacttcagtgtgatccaaacctacagagagaaaaaaaaaaggtagcttccaaagcaaatgagcttcaagttggaattagcaataagtactaaatatgggaaatgaatggtcataagctctgcaccgaaatgacgaaaactacatgctaatccactgatgaaaaggagtcttaatatatattaagaacagtcctgaatacataccaaaaaaaaaaggtttgatatatttgggcttccagtacaatatcgagtttcagtgagctgtagttgtgccaagctagctattagttgttgtgctgtcgatgttgtaatacttcttcaatgaattctcctctaagcatgccatacctttaacttcgaagtgtaggaaggggcatctgcggccgacagctctttgtttgtcaagatcctcacttgatcagtctccgacaggtcacaggcctggcttcaggggattcactttcatagctgctgtgactttgcaacgcaaacgaagcttcaaggtaacggctcacctgatctgattaagattgctgctgctgctgcttcacaaaggggaatcgcaagaccttgctgtttcctctcaggatcagctgctaacaggtatgttcataactctgttttgcgtagctctcgtttctattcctctcactatctgccagccatggatcaaccttcttcttccttcctacttttcggtttctccaagaaattagtccacttaggaaagtagcacactaaagagctgaattagattcagattcagaaatgcgcactaccaaacaggactgcaaaccactactagtatttcagtgttctttcgctgagcctatctataatcatgtgccaccttttaagcgggcacaaggaagcatcatcttagctgggctgctgggtgtagtgcaggctgcacgaaaaaggaacaagaaaactacacgcaaggaccaaagtaggcgcgcatgcgtgcgtccgtgtacacagttataaacaaaacacacacacagacgtaattggtcctagtttttataggacactgccaacagttgcctccgcgttgtctgatcaatccaacagattacataaatgctaaagctaagctaacctcttccttaatgcccaagtgccccttcactctgagtgactgcatctttggtggtgtccatgtatggtcgtaccagcagcaacactgaaacagcaagctcagcgaggagaagaggtgaggaggtggtggtggtggtggtggggctcgtcattacagagtgcagacttttccctggggcgccgcacagcaccgctcaactcagtagcttcactccagcagcagcggcagcagaagcagaaagcgggtagccatggcagaggagaggaagaaggagaaggagaagaagaagaagcacaaggagaaggagaaggagaaggcgggcacccacggtggggaggcgcacttcaagccgagcggggaggtgaagggggtgcgggtcggcggccagttcatcgtgaagtcgttcacggtgcggcgggcgtcgccgctggagctgctccggctgctggacatcccgccggcgtacctgagcgagtgccagagcctgccgttcccgtccaccacggcgtacatgcccaccagcttcaccatcctggcgcaccaggcgtggcacacgctcacgctggggctgggcaccaagaagtccaaggtggtgctcttcgtgttcgagtccgagggcatgaaggccgccgtcgaccagctctggccgtccatgatcccgctcggcgacgtcaacaagaagctcatccgggggctcaccggcagcgagatggcccggttcaagttcaggaagggctgcctcaccatctacgtctacgccgtccgccgcctcggcgccgccggcttcatgtgcgccgacgacctcaggaggatactcgagtccgtggtggagctcaaggatttcttggatcacaccgccatgctcgccatgcccagccagaagagcatcaccttgcagtcccgggtcgcagtggctcactgatccaactctcccaagtgctcttgatcgtttcatcggtgcaggtactcctcctggcttgcaatctgcagaggagtctaattctttttttgcggttcaattggtttattccagtgtcgatgttccacttcctctgctggaagggagttgtatagatctactgagcaaaatctttcgaagatgataggttttttgtttcaaaggcatttcttccccaaggatcatacaccttggtatactgtttatccatgaaacaaaataatccatcaatgagaaccatctgtaccatgacattcttgtcgcattgtacagaagccccaacttgttaccagtactctttattattggtattgtacaggtttcccgttctctcatcatccttagttcttactccatgaatactcattacttgacacaatcacaagaaaaacctctgaattgtccttgtgtagttgtgttccttgaatactcattgcttgatacaatcacaagaaaaacctctgaatcgcaaactgcctctggtgtttctttctgagatgctgtcattagagatgggagctatccagagaggaaagtgaacagcaaagttcagaatctgagagaaagtgggtgctaatctctgtttatgtgggacgtagccatcatggagttcatagaaaagaaggacaaatgctcttcttttacctgtctggctctgcctggtccgttattcttatatatggagatgccaatggcccaatgcaaggataaatttgaccaggagttcatgctccatattgtgcattttcaccagggaaataacagcaaagccaaacccaaaaggacagatgggtgttggtcatgatcattgagcgagttaaaaaagtttgttgggcagggacactcgattcagtgtcatgatacaagtggttgagcaagcatgggccaccacccactatggcctgaatcattaacaacaaaagccatctcatctctcatcttctcccacacaacagtgccacagagggacagtgcaccccttgctgtgacctgcattcgttgtataagatctgtactccagttctgtaccccaaaagaactcaggatatctctttcagtagtttagtgccgctgttactggttgctgaatttatttgcaatgcatgtactgttatctatctctcattctcttaccgttctgtctgtaagcttcaaagcttgtattactgcatgggccaatttggtcgaaccaatcacccatcaaggctgtgtttagttcacactaaaattaaaagtttgattgaaattgtaacgatataatagaaaagttgaaaggttgtgtttagaaaagttttggtgtgatggaaaagttaaaagtttaaagaataactttggaactaaacacggcgcaggatcgtcggtatggtggcactgccatgaatcggcatgtccagctaaaagagctttattttttgcctgagctatgcccaaaaaaataaggggacacctgcattgctgcctgcctgccagcgagccaccgcctctgaatcgtgccgccgctggatggctccgccaattatgccgccggggcccaagccgacggaggagaggagaacggatggagacgtatttatgcgccctcaacctcaagtgggtggcggtgcatggtatggtggtatacaatacaacgtttcctgggctactgcctctcggtgtctcccttggatgcaaattgcaggagacctttctcgcccaatactccctccgttcacaagaccgttcacagaagttaagtatatttaacatttgagttttttcaaataagttattcctatttgtaatatttatacatttaacacttaaatgaaaagataaattaaatgtttgattagaattcaaggagtcatctaaatactcattggatacatacttgcattcactccctgattctataatattcaacaacatgatttaatttctctctagtcttgatgacaaaagtaataggtgtaacttttatagatggtgggagtacaatacaacgcgtcctgggctcctgcctcttgggcagtgtttggcaaatgtgttagagaaatgatttcccacccatctttaaatcctaaccattcattatccctcatccgtttaatcctaaccctttattcatttctcaatcccaatcccactcctcatttcccattatccaaacacaccctccatgtctcccttggatgcaaattgcaggagacctttcttgcccaaagtttcaccctgatgatttgctgttcttggtcaagcaacgagctagccaacgagctcgtggttagctttgatgcgtttgagaagtttaaaattcttaagagtaattggttgatagcccgatttctgataaccttattattttttatttctagtttattttttatgaactttatagttacagattctcgtaatctaaaaactatttaggaaactaaagattatagaagaagttactacggctaaaagccctctacatatgacctaagtaatattatctacgctgttgagggtgtatgtttgcatcgcagagagagcttacggctatacgagcctttctatcaagggaggatctatgattgagagggattagagtggatgggtacgggcattagtacatggctctattattgctcttgtcccaggctttatggatagctttttgactcgagcctttgctttcacttttcgttttaaaagattttagttggattttcaggagactcaccaacctactgatgacagatacttcacctcatgacctcaagtcctcaacccagcagcagcaggatgaaaattttcttttattttttcttaaagtaaaatatagaaatccacgtacacttacgatcaaatttatagctaattattctttcaatgttaggtgatgtatccgtcgataacgatgcgcctatgatgacttcataaatctcagcatgtcccgatccagccttttgaagatgccgatacagtgatgggtcatttaactataaaattaaattcacttaccgtctattaactttacgtcaagcctgtatgacattcctaatccgccgacgagagatggaagatagaagagacggccggcgagcctgggagaggcggcggcggcgggcttacgagagacggaggaggaggcagccttgggcatgagttggttgcatgagctcgctagtagagagaggagaggggaagaaagagagaaagagatagaggagatgaggggaagagccgcgccggcgaccgcatccccttcacacaacggcgacgaagcagaggagatagaaacgggggagcttgaccacagcgtaggcaaaggagcagaggggatggagacgagcggtggtgacggagcgaaggggatgtaaacggggagctcgaccgcgtcagagatggcaaagcggaggggattggatggacaacgacgagtctcctaggcttcgtgcaagggtgacgactgcatcccctccacacgacagcgacggagcgaaggggatgaaaacgggggagctcgaccaaggtaagggtggtggcaggcctgcaatgcgaagaagtcacggcgacgtcaagccgtcgaaggatagccgcatctagctatcacacacgccctgcgccgtccggatcttgttgtgcaggtctgtcttgaacggacgcgacgggcgcttccgcgccctgccaccatcgtcgtttcttggcgcaggtgatcgagcacgtgaaggagctaaagtgccaaacgacggcgattgctgcggtggcgacggcaaagaaaggtgcccgtgtcgccaccgtgcgtttgggggggggggagtggaaagagaagtttatgtaatatatttttcgtgtgacttatgtgtggatcccacattatttttattatctccttgctgactaggatgccacgtcaataaaaccactcatgtatattgttatgggacctattttacacggttttgaacacttgggataaagattttcggtattggggattagggatgtcacacagacttgacgtaaagtttgagggatggccaagtcaacttagacgggctgagccgatggtgatgacggcccagctaatccgaattccttcctggcccggtcatcagtaggacaggccagaaaactatccaatccagcccagatcacgcggcagcggcagcagcagcgtaccccacctccaccgggctccacgtcggccaccgcacccaccgcctcccgtgttcaaaattcgaaccgcctagccgcctccttccttaacggtcgccgtcctcctcctcctccacctccacctctacccccgccgcctcgtctcaccctctctcgctcccagtctccctcgtcgtctcctcctcctcctcctccatccgccgccgccaccggcctcgtcctctctccttcgatggcgaccgccgccgccacgcagtcgcagccggtgcgcgtcgtgctgcgggtgcgcccgcacctcccgtccgaggcgaactccgcggaggcgccgtgcgtcgggcttctcgggagccaccccggcggcgaggtcaccgtccagctcaaggaccagtacaccaggttcgcctcaccccctctcttctctgtacgacggatcacgttgaattccccccaatttcgcagctcccttgttgagcgctttcataagatttgttgcatccttagttgaggaagatcgctactactactgttctagttcgcctggaaatttggttgcgaattgttcgtcgactagtaatgtttcggatgatctgcgagggcgtcgtcttagcttttttctcatgattatattcatttggtaacaccacttccgcagccggaacgagtgctataagctggacgctttcttcggccaagagagccgtgtctgcgagatattcgatcaggaggtcagcgccgtgatcccgggaatcttcgaggggaccaacgcgacggtcttcgcctatggcgctaccggcagcggcaagacctacacgatgcaggtgcccattattttttttttcacgacggcaatgtgtttgatgaaatgccgctgcaggggagttgaacctattgctgatattgggggatccttgttgctgtgcagggcactgaggatttgccggggctcatccccttggcggtttcgaccgtgttggcgctatgtactggcacatggtgctctgttgagatctcatactatgaggtatacatggagcggtgctatgacttgctagagcccaaggcaagagagatcatggtgctggatgacaaagatggcaacttacagctaaagggcttggcctgggtaatgcgctggggcttgattattcttacttgtgtttgctgcaatgcattaggcatcatcgattgtgcactgtgcttactttcgtattttcatggttgaaggtgcctgtgcgatctctggaggaattccacgagatatactctataggagtgcagaggagaaaagttgcccacacaggcctgaacgatgtttcaagtaggagccatgctgtgctatcgatcaggattactactgatgttgttaaagggaagcttaacctcatcgacttggctggtaggactcttggaaagctggagcaggttgcatatatttaagattcacccttcctgtttaaaaccatgttgtgttggttttacattgccaggtaatgaggacaaccggagaacttgcaatgaggggatccggctacaagagagcgccaagatcaaccagtcgctgtttgcgttgtctaatgtcatatcggctctcaacaagaaagagccacggata

SEQ ID NO: 59522 - DNA, 3056 bp, Oryza sativa
ttcgtacaacttgaattttctttcatctgttttgagatttgaagctagttgagattcttccaagtttatgtaaactaatgtggttggttaaattatacaaattgcttttggtggaatggttgtgtctctgtctctcaaagcagcatgtgttgttttcctaaactagagtagcaaaaggaaacatatccatgatgggtgtaacatgattatgttgtctgatcatgtctcagaaccagtttgtttatgcagtatattatgatataatattccttctaacatattaaattcaatacctttctgtattaattttaggatagcttgatgggtggtggaaggtaagccatatataatttaaacccttttgaaaatgcaagttcgcaaagagccttgaacgcaaggaagtgaacattatgtacaaagatagaataagaaaaatgagcactaatagaagttcacaagaataaatgaacagtttgtcattatgatgtatcatttaatatgtaagtatttctccaagtgtcttaaaataatattttaaaacacccttacaatcagttgtctggataatggagtgcatctgttacttcctactgtaggaaggaattatgagacaaaaagctaacaagtatgtacttataagataaattgaacctgaaggaaacagagttcatcagttacgacagaataatgaggaacttcacacatggaccttataacttgagcatcagcatttaacaatcatgacaagtacaaagtgagtcatggtgcagatggaggacataaatgttgcaatcaagtggccacacatgacacattagaaatcaacttaatccttcgaaaccaaaatgttacatcttcgtagtcccaagtatattgtagtctacttaaagccccaagctctgaagaatggaatgcttgactttaaaggcatgcatacatttggaacagtgttttgaagataccaattttctgattctgggagatgaaggttcacttgtttcagaggcaccaaattgtagaccactgtaaagaaaaataaaacaggagaattttcagatggtatgacaatcatatactgtaggcatagacatagccatgaaattaacacataaatcatgtttgaatcagtgttcatgccctcaatattcgttcaatttcgaaacaggcaactcccaaagcattcacctactgcaactgtgcaaaaccaaaggattgagttttatacgaagtagcagttgagattttctttgttacacataccttcaaacaatgaaaactacaataatgtgagaattagatataactacgaaacttttaacatgttaaataactaatctacaggagtgttatgatttcagtctacctaccatcacagcaagccacaagaaagagatgcctttattttttaatatttgcctcttttatgtattttgtcctatgatataggggctacgggttcaataatttgttctcattgttcattggtctatatactacagtcctatcattgagctttgtaaaagataggctggactacatgaaattgagtgctacagcctactggtatgaaactgttgccaagtgtcttaacattatctccaatcctgttgattaagagaactcctgtgggtaacaaaagcaatcatcacatccaggcttgttacaaacttagacaaagtttccagtccattacctgggctgaaggagcttgtcatggaaaatggaacatttgtcagaactctcacataggctggtcctactgacatccaaaatatagaacctgagctgcacagtgaggtggtcgagtacttgagaacttccttttggtcataaagattggtcattgggatccttcaaatcctgggcctgaattggccacacaactagcccctattggcacctaggctttgttgtcccaattcaattacaagggggcacccccaaattgggcccccccccgggggcccccaaacccaaaaaccaaaagggggctgaaaccctggcacccatggtctgcggttctccatatgtttattctccctttttaaagtagaggaaattgtcctttgcctcacccgctcattgcagagaatccaaactcataatccatcagtttagttaattggtgttggactatagactatagagattctggttgcttgtgccattctccaactctgctatatagatggctttaggaagacccatactgattcagaactaatcatctttgggagaggagagatactagctacacattcagattcagagctaacatccgcagtcaccattgcttcattggaggagagatcattgggtagcaatggcagcccaccatggtagcagcaggaagacaaaggcagagcagtggctattcggtggaagatggaggagaactgtgaaggagacaaagcatcctgttgcctctgaagccaagcctccagctccaacatttcctacagccattcagaaggatggcgacatctgccttgagaagtccagagttcatcttcctggcctgggacagagggagatcatcgatatcgcgcccgggaggaagtcaatgccggaggtggagatcaacatgaaggaggtcagggagatcatcgatatcgtgcccgggaggaagtcgatgccggaggtggagatcaacatgaaggaggtcgtctctgtgcttggtgtgaaggtgatggctgcagacatgtcgccatttatgcagctgcatgctttccggtgtgctaagcggtcccatgatagcttggacaagttcagctcaaggcagctggcccatgatgtgaagaaggtgagcttatttttttttctttcaatttgtgatctttcgcttgtttgtttacttttgttttgtattctgaaagggattgcactgattccgttcattgtatacgctccttccctttgtcttttggacgggttctttgtgaaatcaaattttagaaacttatcatttatgttgtcaattatgagatgcacttctagcatcttctgtatcatgcaatgcacatagccttaatgctgaaacacgtagtaaaatcatt

SEQ ID NO: 59523 - DNA, 739 bp, Oryza sativa
taccagcagagcctgcggcgctaccatcagcgccacgtccgggcccgatcactctgcgtcgacgacctcgtcctacgccgcgtccaaacgcgtgctggattgagcaagctctcaccaatatgggagggtccgtatcgagtgatcggtgtcccccggccgggctcggtacggctggccacgggcgacggcacggagctgccaaacccgtggaacattgaacaccttcgtcgcttctacccctgaaggggggggtcgggtgtcaggttttggctcgggccaaccccgcacccccctcgggtgtgcagggttggccgggggctaccacacatgcacagtcttacttttcttatttcagcatttcaataaaagaagtttcaattttctaaaggttgtgtctgtgccgtttttccttttgaagaatcttaacttgaaataaggtcactcgtgctcaaccttgccctcgggggctcggttcggtcagctaaaatcgccaagcggggcccagaaccgagccgtgccccggggcatggtgaactccgggggggaatcggcaaaaacccacaatcgggtcacccatacccctcggtcaccacgttcccggcctggccagtctcgacatgtggatctccccaggcactagccccgacccgagccatccaagggcacgaacccttatttcaagctaagacgcaaaaggaccacggcacagatcatcctcatctcgtatgtatagcaaaat

SEQ ID NO: 59524 - DNA, 673 bp, Oryza sativa
tttttggcggtattccgacttccgaagggatcggagatcggcggtgcgaactccgaatcagaatgggagtcgaattgattcgcgaggatataaggcgcgcgcgcgtggatgacgcagcccatcaattcgacgtgcgattccagcgcgcgctctcgtctccggttaattgcttcgatcgcttcgcgtcgcggcacgtacaactatctccctcttcgtgacatttcgagcagctagccatggcggcagcggttctcccttcgctgctcccgacgccgcccgcgagcaagttgccggcgctgctcccgaccccgctgaggagccagatgctgccgctgctcccgacgccgtgcctcatcatcctccccgcctccttccgcgcgccgccggtctccgatcccaagcccggccgcgccgacgccgtcgagaggtgggacgcgcgcaagaaagccggcggttcggcagcgtcgtcgtcgtcgtctagctccggcagcgcgatcccctgccgcgccgacgcttgcgaacgctgggacgcgcacaagaacaagaaagccggcggctcggcagcctcgtcgtcgacgtcgtcgagagccagcggcggtagccccgggcgcgccgactcctgcgaacgctgggacgcgcacaagacacccggcagccctgcgtcgtcgaccgg

SEQ ID NO: 59525 - DNA, 1094 bp, Oryza sativa
gttaaattgactcgaaggtagaattcgctatggattccaaaaattatcccagccagcaaggcctagaatgtgatcatggaacaaaaaaaaagtagtcctccgcatttagagtcgatcaacagttatgaccaattgaccacttgactaccagctcagagcaacatgtgaggtaccaattttagcagcattgtagttgcaacaacatgagcaatcaacaaattacaattacttgcaactacacaagcttttatggacataaatgaacatggatatgttagcacatatgatatggcaccaaagatcttaagcacaaacctgcctctgctgctcagtcataaaagaaccagacagatcccgcaagatgctcaagatatcatcaaatgccaccttcccattgcagtcagtgtcataaaccctgaaaataactacagagaaaacatagcatatttctcagaacatctagacatccgggacagaaagcaaatggagaatttaagtacgaactgggaacccacattcaattttttgctgcaggcttgcgcggggactaaacgccgataagaacgccacgaactccttaaagttcagcccatcgagcatcctcagaagcctctgacagagacatcgcatcgattaacaaatagcattcctcaaacatctacccaatcacccaattcattcctttcctaatccctcgttctcaatacagaataagaaaaggtattgaggaacaggctagttatgtcttgtaacctgagagagagggttcacggcgaactcggggacggtcatgaattcctcggcggagacgaatccgcccccattccggtcgagctggcagaaccggtggtacagcgacacgatctcctgctgcgagacttagctcccaaaacaccccgaatcagcaggtcagatcggaggggaacagcggcagacagcatcaatcttcgttgagagttcagaatccaatcgaaagagagaaacacaagcgcgcaaactcacaggcgtggtcgcagtggtcctggacctcctcgatgtcgtatgcgtcagcatcgacgaggtgctccccatctcggcggaggagacggggatcc

SEQ ID NO: 59526 - DNA, 730 bp, Oryza sativa
attatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctcgccgccgccgctgccgctgccgccagcatcttcgtcttcctcctccgccgtcaccgcctacatcttcgtcttcctcctcgccgccgccgccgccgcagcaaccgcagcaagcaggccggcgacgacgacgtggagatggccgaggggaggaacaacaaggtcgccgacggcggcagcaccgatgactcgacgaccagcggcaaggcggacaccaaggtgtagctctggcgtctcaatcgatccatgagcgatcgagtagctcagtagcatgcaatcggctaagatttcctgcatgtgttctagtactacaagtaataatattagctagctaaaaggctaaaacacataacgtgcatgaaaggaaagtactatcctaactgaataaaacagcttttgcaggcacaagtttaacataatatgtctgctttgatctttatttggaagttgtaattaaccatgtttgtaataacgagataattaaacg

SEQ ID NO: 59527 - DNA, 3716 bp, Oryza sativa
tacagttcatcaagagcaaattaatactttaaattggacaaatgaaaaaaaaacatacatgtagattttctccaaaaattctttttttttaaaacaatcagaacaagatgagggcacgatgattcattgaatagtgtattaaaaaattgcaaggtcagtaccttagaaggcagtaataccaggaaaaaataccaccaccacacatcgagagcacctacacaaagtcaaagagaaggctagcacctgatcgaccatcactaaacgtgatcggtcaccgctagaccaataaaggaaggtatagccaggacggctcaaaaccaatccctagactgaactcaactctagccacgcctttgaaattgaggaggagagggtgagagaaaaaaaatggatccgctctccccctatggcccgtcaacgtggccaacttgcataagctaggacacagttgcaagaggataaaacaactagaaagagcttgcatcagctgccagagggaagttttggcaagggacctagatgatgtctccagcgagatgaacgatgatgagcaccaccgtcgccgtctattgaggtctcaaggaggaccaagataaggttttcacctggtagtcctaccagagtaagccatgttcttttttctaacaagagttggatgaagattaaaattttcgtggcacgtttttcaaactgctaaacggtgcgttttgtgtgaaaactttctatatgaaagttgctctaaaatgtcatattaatttatttttcaagtttgtaataattaaaactcaaccaatcatacgttaataccacctcgttttgcgtaaaaaaacttaattttcatctttatttttaagagaaaagaacctgctttaagttgcatatcttggacgatcgctacttaaaaaaagaagaattttcataggccctaccttggaggcttggactactaatatgatgctaaaagaaaacaacgtacattaatttcgcctacaatgatttacacaggcaaaatgtcttaggcaacaactcacattaatgtctaatagcataggtgtgccacaggcaaaatgtcttaggcaacaactcacattaatgtctaatagcataggtgtgccacttaaggtaatgcacgtgaaaattacacataagatggtcataaagaggcccgcctagacgaatgtgtatctgtgtatctttagacaatgctcctaattgtccgtccatgacttacacctttttattttcctcatgccactacttccactacctacacttccatcagtgatcacgactgggcttctcaaaattcgaatcacccgactcctctattgccacgccacacctcctcgcctccaactctttgcctattttccaatacatagagtgtaatgcaagtttttcgccgcaatatctccctctctctgcattctcttctatctctgccatattgggttcgagatgccaacactagtatgtcaccgttagcaaatacttttctctgtctcaaattatagagcactcctgtttctatgaaaatcaaactcgttaaattttgactaacaattacactagcaatatttatactaagtattatgcatactatatatttcaaaatattttatattatactaattttatagttattgataacataatattaaataattaataatcaaattatatcgttgaaaaccatgtaaaaaaatagatcttataatgtgatataatgtgagatagaggaagtagaatgtaaagacagagttgaacacaagaggaccgcctcgccccaacaccatcaccatcacacagaacatcgaacggggaactgacgagtatttcttcaacgggtcgcatatgctcaacttggtgtcacaattcaacaagctgaaggtgctagcaaatcatcaacacaaagttcgtttgaggcaaagacatgtgtcttttggttttcctcggttcatttccttgtggatgtaatgttcgtctgaattcacatatgaaaagagagaaaaattacaccgttggtgtaatttttagttgaagttagttcgttgttctctatgttcaggaggggtactgcccctgttgaatgatgcccaataaaatgtgattaacaactgagaagacatgaccaacagattaaccactacttttcttttagttattttgcatgatgtttgtagttcagtagattgttactgattgcttggtatagttatcaactcacaggggtacatcttcagataattcaaaaatcatacaaccatatccacaatttcatatatatgcataaacaaattctatacataaaaataaaattctattatgaattattcatccacataaatgtgtacatcgataggcaagcgcgtagcgcttattaattagtcattcatcaacacctacacacttatttatgcatacatgaataaggtgatctgaacacatagaacacaaactacacaagctaggaacacacaacaatataatctttggtaagcttcacgcgggtcgtgacgagcttacttgccatggccactgcccgcgtatgagccggctctggaccctgcatacgagccggagccggcaccagagcctccatgcgggccagcaccggagcccgcgtacgagccggcttccgagccagcgtacgaccctgcgcctccgccgttggagccggcatacgagcctgcactggaaccagcgtacgagcctgcgccggagccgccatctccaccattcgagccagcatacgagccagccctggagccggcgtatgaccccgcaccacctggccccgcgttcgagccggctcctgactcagcgctcgagccggccgatgagcctcctccacctgacctcgagctcgaacccgagcttgagccagaccacgaacctgacccagaccctgaaccggagcccgagcctgagccagagtaagacccggagcctgagccagagtaagacccggagccagagccgccgccaccaccaccaccaccaccaccaccgatgcccactccaatccccgagccgagtcccaggccaccgccggtgccgacgcccaatccgccgccaccgccaactccgaggccaccgccgaggttgacgcccaggtccttccttgcagcgcggccctcagccgcgagaacggccgccgcgaccaccgcgacgcccaacacgacgccggccttcacggaagccatatcgcgcaaacgcagacactctagccgtgcacacgcaggtgtctcaacctccggtgaccagtgctcctctgctgtactgctgtgtgtggtgtgatgaactgatggcttgatggattgatgagttcgtggtgggatttagcggtgaaatttatagggagcgcgcgcggttgtggtggtacgcatgcgtgcggtagctagcgcggctcgtcgtgtcgtaaggttttagtgggatttgcgtcggtgtcgcgaggttgtggccgcggccggcggagggcgtcgcgtagtggagcaatccggcctgtcccgcagatttgggcgcgctctcctcagcaatccgagcgacacgtacgtaaggcagaccggaccgagctgatcaacccatgtacgtaccgatcgatcaatcgtacgtcgatcattcgatccactaaacacggctagctagcttccaatcgattgaacgcacgagtgtgacgtattcgatcatgttggggcgtgtgacccaatgtaggt

SEQ ID NO: 59528 - DNA, 1752 bp, Oryza sativa
caaaatatacctaaaacatccttagaaatatagaaggctaacaattaatttatcctacaagaacttaaaaaaatgatatttttaaggcctccttgcacaacataaggatttgtatttgtttgtaagtttcaatatttttacaactataacttatcttttataatctacatacaatactttgtgctcattttttttaatgtaaatcatcatacatgtgctatacgcaatatttgcatggtactatcttttgagtaaacaattcctcgttcatatgtcacacacaaataactttaaaaaataaaacatgaaaacaaatcttaacccatatgctaaaaattctatgcaagaaggctaaaaaattcatatttttaaaaaacttctaacgggattaatcaatctacaatcttctatagtgcattttggccatgtttgagaaagtatccaatcagacgatacattgtagaaacaattaataaacttgatcaatggcatattataaagaaggcaaagttgatggtaaattattaaaccaatacaatgtcagtaatatcctacttcacttcttcttacagtttcttaggacacagtggctcgcaactggctccaaatgttggagatacataaaactttttaagagatagctaccacctactaattcttcatatccttcagcacgaaatttggatctatttgttgtcgctacgttggagtattataatgtcactatactgcaaagcacaaccatgcctacaagcaacttaggcgaagaaaacaaagagctataatctagcttaccttgttaaccacgatcaactggtcagtcgagttactaattgctatcttcccggagtatcttccatgcttagaatttaaggtgtttaggagggagtaggatggcacaatgaataacatattgcacaaaatttccaatgtttgcattttggttctccacatttcaagaatgcatgggatcggaccttcaccaaattagtcaattttatcacagattcagtgttaatcagaaaaatatatggtgaaaccacatgtagggtgaaaattttgaactttcttataaagttttcaaaagaatcacacatatgtcggaaatatgtaaatagacaaccatgcaaaattgcagcaacaaactcaacttcatcagctatataatactagaattatcttagataaatgtgataatttttttaggcgtcactacaaattagaccatcatgggtgtacgaggtacagtagtatttaataattggtgctaaccaaagaatttctttttaaaaaagagtcagttttttaggctccaccccaaatgtacaacaaatatacacacggtctccaacccaaataatcaatacttgattttttttatatataaacatcttgtattatattatgatgaagatattttctacgaaaaatctattcattttcataaaaaataaatacccttaatttatatactgttggcatatataattaaatatataattaaggaagaaagttccactgaaaccgtacatttccaaacaagtaaattgcattagcggtaaacgaatttgttaggagggtgcaatctagcgcatgtcttgaaaaacgcttgttttaatgcacaaacttgtttggtgcgtgcgaaccaaggccaaaatcacacgacaaggtttgatcttgctgatttttttatttgaatgctatgtaaacatgtatcttagaaggattcaaggatatcatgtagacaaagat

SEQ ID NO: 59529 - DNA, 5876 bp, Oryza sativa
tacacaaaagcttgggtgctctccaacacttggatgtgaaaagtgcttttctaaatggtgaaattgtcgaactcgtctttgttgaacaacctcccggttttgaagatcctaaaaatcctaaccatgtttataaactttcaaaagctctttatggtttaaaacaagctcctaaggcttggtatgaaagattgagagattctctttcatcaaaggatttcaaaattggaaaagttgacaccacccttttcacaaaaatcattggtgatgatttctttattgaaaaggattctaatatattcaaagcattcctctactattggcttgtggtacccaaaaggtgttaagtctaagtttgttggctattccaattcggattatactggtcgcaaagtggatagaaagagcacatccggtagctgccaaatgcctggctagatcccttgtgccatggtcatccaagaaacaaaacttcgtagccctctctaccgctgatgcggcatatgtcacggcgggtagtggttttgcccaatgcctttggatgaaacaaaccttgttagactatgacatatcctttaccaaaacctcactcctatgtgacaatgatagtgccataaagatagccaataacctggtccaacattctagaaccaagcatattgacattcgccatcacttcctaagagaccatgttgccaagtgtgacatagtcattagccacataagaaccgaggatcaactagccaacatctttaccaagcctcttgataaaacccgcttttgcaagttgaggaatgagttaaatgtcatagatttctctaatgtggcttgagatggtgcaccatggttgcttcttttgcattgtgtatatttgctcctatttgctcttatgctttagatttattgtcatttggttcttcattgcgaaaatagagcatatcacattacggggaggtttgcactcttgcatgtgcactacttccttttatatatgagcaaatcaactaaaagtgctagtagtgtttttaaaatgcccaagtcaacataagtcaaaacatttgcaagttaaatgtaatttgaaaactatctctgggaaaatgtttcaaaaggttccctatatgttttccaagcctcacattgcaagcaaaatgatttttgaatgaaaatgcctttttggccctcttttgaagaaactagattcttagttttggccaaaaagaaatttatccccaaattgagattgagaaggaatttgagaaaagtttcaaaacaaaattggtagagaggaggatttgaaatgtttttggtattcaaacctatttcaaaaaccaaatatttcaaaagttatttgaaaatcaaattcgcccaaaaacccctatagaccataaaaggtcacctcctagcagttatgtgagttttgttgcaaatcatcatagtcttcaaatattatggatggttagcaatatttaaactcatatattttaaaattgctccaaaaatcaaatttttattgaattttattgtgggggggttaccggcttatgcaagggctgtgcacagccggcagggggcctggcggtctgaccggtgctataagcgcggtttgaccggccaggtgcggcggtctgaccggccacatagggccggtctgaccggccggtaggtggtcccaggacttttgtcctttttcttctcccttcttcccctacccgactccatctcctcccattcagttttttccttccccaactcgaaaactctctctctctcacctcccctcaaaccctaactccttcctccaccaaatcccctcggtttgatcgcggatttctctccggttacaccgtaagtgattctcctctgcttcctctctctattccatggattgatttgtgtttttgttgagtttttgatccatggcatggaaccctaggtgaagcagttctttgatttacaccaaaagaggtagtttcttggtgtgattcatctccccaaccggtaaatcactctccctcttatgcattctctcaaatcgatctatttcaacctctagggttaagggtagtttcctcttttgttccaatcttgatgaaataggtccaaccctttgatattcatgttccaatcttgtgcaatattgctctagcaattttttagactcatttgtgtaattgtgaaattgttgtggatgcttaggccaatgtcagtagtggtctaactggagccaaccgacggtctgatcgcggccttgccgtcggtctaatcggccgatgcgcgcggtccgaccgccgcatgcacgtggtctgaccggacgttggccgttagtctgaccggcaggtgtaggcggtctgacgggactgatgccgtcagtctgaccggcctgcagtctacggtattggatgtgagcacaatttcacttcaatcaagtggcttctaaaattcttgtaatatcctttcatcctttgctctttgacagtgatgcctccccgcactcgccatggtcgtcgtgcgcccactccggatcccgtgagtgagcctgaggagtaaagcggagaggattatgctcaaagtgatgaagaggttgaggcaaatgttgaggggactagtgaggaggcaagtggagatgatgtcagtggtagtggggaggatgaggatgaagaaagtgatgatatgcacattaatccctccagtttgtggtgaacatgaggaatccagcgcagtataccatcttgaggcatcatgatcagttcttaaggcctcgggacatcccggatccccagtttcacaccgctttccagaagactgtttatgagcaggtttatgcagggaaagcatttgcagagcataagtggatttcttggagagacatcaatgagactccagagtttgagagcttgtatgatctcttcaagactgttggcattgaccggattgtgaccctcaagcaacactacaatgaagatttgatccggcagttctatgctacagtgtgggtggctggagactatagtgagatgaagtggatgtctgacaccctctagtgttctatctctcggaggcagtttcgacggctcctcaatattcgcttagattttggagatgatttgcatgaggagcacacttacaatccgctctccatagactatctctctcagttctatgaagatggagtgcggtacacacatgggaaggttgccggcttgaggactatccccagtgtggttaatagtattgtgagagctactatcctccctcgccttggcaacaatgatgacattaggggggtggcttggcacgtcatcgatgcaatcattcagggacgtcagttcgacattgtgtctctcatgatgcaagatattgctatcaccaaggggacattcactcagggaatctattatgccccttacatcatgaggttgattcaagacaagcttggggctgctgggtaaaatttgaagaagcaagcagtaaaagccccaccttcagcatggagctccccgtgctcctaggacggtgccttcttctcaccctggagctagctaaagctcagcacctcctcctcctcatgggtatgatccaaatgctttcttccatccacaatatgcttactttgaaatgcaacccaatgaatacttctacccggtacttggggctattaataccctaagtgaaagcattcaacgcttgtctaccgggcataaagcattgcatgaggatgttcgtggcttgtgcaccgatgttggagacttgaatgcttccgtgggaagattgcacactagagtgggtgcattggattctcgagtccaaatgttggagagcacccaagcttttgtatatcatcgccgccgtgatgctcctcatccttcatcttcggcacgtccttcttctcctccacaagaatgaagacatttttggtacttgatgctaaaagggggagaaaactgtccttaggtgtgctttatgtcttgtgggttgggactagtggtagtgaggttagtcacctcaaatctaataggttaagttgctttgggctatattttgtatgggtctgggctattactctatattgtgtgttctttatcgttttgttgaactctatgtcatttggtctattcgtggtcttgttagcctatgtttgtttgtgagcccttttaggatgatttgtgacttatgtgatttgaatggttaagtgatgtgaacttgtgcgatgatggatggtgtatgtgatattgatatatgtgaccatcttatgcttatggatgaatatttcttgaagttcacattgaaatattgcttatgtgtttgtgcttgttgaaatgtgaaattgaaatttgcattggctccatatttgttgtctatgattgatatgcacatgtttaggggagcttttgatttcctttgcaatatatgtccatatgttccttctttgtttatatatatttgttgtgtttgtcatcaattaccaaaaagggggagattgaagcatctaggcccccgttgttaattttggtaattaatgacaaacgctaattgtggactaactgttgctattgagatatattttaagttaggaccatgtcatgtatgcgcatggatgactatcaatggattaaaatttgatggcgcgaagcgaaaaaaagaaaacggtaaaactagtgctttagttttaaaattgatcgaggtgaagggcgatcaaatttgctagtttattttttagtttcgccgtactatcaagggggtaatgacctagcaatgagatgattttaattgccacattaggtcattatgcatttagacttgtgctcacattttatctcacacacacaatcactttgtatttcactgggttcggcctgaccaggggcggtcagaccggccgctgtctaaccacatagtggcggtctgaccggcgtgccccggccggtctgactggccacaaaacggtggtctgaccggcgcataaggccggtctgaccggcggcacatgcgcgatcagaccggccccttggaggccgggatggtgctgctcggggtggccgatacagagccgacggagccgtattcggtcagaccgagctgatggcggtctgaccgagccgaggccggtctgacccgccactcaacgtcggtctgaccggtcaggcctatggggccctctgacagagttacaatggctagttttctagccgttgcagagtagcacggtctgactgcccacatacctccggtcagaccggcagagcacagaggtgggggatttcgccctccatcagcaagggggctctcttggcacccaattcaattgcatacaccccttgcacctctctcacacccacttgagctttgtgttcatccatctagtgtgttagagggttaattagccaagagtcaagtgcattgcttccatttgtagagctagtgtggcacttgattgatcatctccacgccgggtcattgcttgttactcttggaggttgccgcctcctagatggcttgtggagaagttgcccagtgacctctccgagaagattgtggaggagggccggcgctggttgtgagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttacttgttgcatctacatttgtgcaatttacatttctagagacatactagagatcatttcaccctaggattgctaaacattgacataggagtgtga

SEQ ID NO: 59530 - DNA, 1034 bp, Oryza sativa
ccgttcaagtctctaatttttccttaagaagtcaagaacccatttttgtgctttgtttctgctgttatgtggagtttattagagtaaaagcctttttcttttccgttggtcgtgtagacgctgcagcttcggaagatccgctcttcgtggaagttgaagccagcgtttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccatactattattgttattgatattattaccttgttcaccctagaataaacaaaaccccaactagtggaccctctatttatggttccactagtatgaacttaggtagatgcttcgctgattaataggacaacattaggtggttttataattttagactttgggtatattcatatcatttggtcactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggattggagatggatgaagtcgggggtcgatggacattctccagggcaaatgaaggctacacgagctgcggcccggtagtcgagatgtcatggcagagggttggtgccctgctgctagggggctcagtcctgcctgcctgtcccgggtgtcccggccgtagggggattgggtcggtactcttgtttatggctaggatgggttgggaactatgtcacgtcttccgtccgtataccgtggtggtatgtggcacgtggttgcacgcgaggaagatgtgtcttgggggtaaagatgtacacc

SEQ ID NO: 59531 - DNA, 2122 bp, Oryza sativa
aacgccttataacctgaaactgagatgatccgtggcgttggacgctgctcttaactgcgtccatatctgggacgttctttttcacctcgtccttcccatttttttaattcctagatcctaatcaccacttatttaattattaaagggattattaattattctatgtatagaaaatgggatatcactgatatgctgagataaattatgtgtgtgtcagtgtgagatcatcgtttcatcagctgaaacggtcgacagcaaccgtgtttcaaagatgcgccgtcgattacttcttacatgtagaagtcaatcacacgctcgttcacgcattcatgttctgcaacgtacgctctgaagtctgaagcacatactagtactccgtcgtagaaatactcctattaaacattaaaattgcagttgctgcttccttgcagcaaagaacttctgccagccatatgtcctgaacgagtgaatggcagcaaacaacacattactacatttcagttgagagttgacaacacaactgctccctccgtatcataatataagctttagagttgaacacagttattaaaaaagtaggtagaaataaatgttggagggttataattggatgtgtagtgaatgtagatgggaaaaatgaatggtggaatattgtgattggttgggaagagaatgttggtggagaagttgttatattttaggacaaatcctaaggtctaaaagttgttatattttaggacagagggagtagacgactagatcttgagcgaatgatttcaagatgatcacgagcttggtctcctctgaatttctatacctatactcctttaaagaccctaataatgatgatcggtaggtctgtcaccacccattacccaacaaggtaggtggattttatccctttcctagcctcgagccatcaaacatgaaaaattttcttttgacgtggagtaaaaatgatgacaaataatatgacctcaatattttacaataaaattttattttaatttttgaggctttaaagtgtatggtggggttctctcatttaagagaaaattccttgtataccccttaaagtttgctcaatcccttctatatccctgagatttgcgtattcccttccatacctctaaattttaatttggatcccttctatacccctttcatcagttgactgttagttgaccgttatattcatatcataaagtccattttaccgtttagtatcaagaaaatataaatttatgaagtatattgatggagtgtataaatttattgtatacaactattatatttatgagtttattttgtgagatattatttaacaaaaataacttttatctcacgtaacaagatttatattataaaaaattccgtattactataacaaactatgctatatatacagtttctaatagtaaaaaaaatattttttttgttttatctaaaataaattttgtatagataaaaaatagttttgttttcctttcgcgaggcgaaactaaaatattactcttgttaaaaatatctcacaaaataaactcataaatataataattatatacaataaatttatatactccatcaatatacttcataaatttatattttcttgataccaaagagttgtcatacataaaaattatttttgttttcccttcgcaaggcgaaactaaaatatttttttggtaaatattatctcacaaaataaactgatacatataatagtcgaacacaataaatttatacaattcatcaatatacttcataaatttatattttgttgatagcaaaaggtaaaatggactttatgatagaaatttaatggtcaactaatggaaggggtatagaagggatccaaactgaaatttagggatatgaaagggaatgagcaaatcttaggggcatagaagggattgggtgaagttttaggggtacacagagaattttcttctcatttaattcctattgcaatgcatgagcattcaactagtttctttaaaagtctctagttgtggtgacatggaatctgccaaccctgtagttttacaatttgtctgctaatatattttagggaaattttgctacaggacactgcttacgtgtgattttagccttagga

SEQ ID NO: 59532 - DNA, 2832 bp, Oryza sativa
tttatatgccgcgatgaaaactgtaactcttttacatctttcgtataaaactaatatcacgtaacgtaataagaaacaccgagggatcttccggttagctacacaaggtggtgagctagacgacttggattcaaatgctcatccattataattatttgatattaggtaatttcttaatatttacgtctttacataatataatataataggtagatataatcggtaagaacaattcataatactgattaaatttcataaagctacatatacttatatgctatatgtttaacctaatacttttcataaaactacagacttaaagtatcgtatcatattagaaaaatacaaatttaacattagttttatcacaaaactacaacttttatagccttaaatatgatatggataaaaactctaaaatctatagatattttataatttcatcagtaaatctgtagttttggatatgatgccttaaatcagtaattatatgagaaatttgatacttcctccatttcatattataagactttctagcattgcccatattcatatactccctctgacggagcgtggggctcctcaccgggagaccgcgcaggcccccctttgccagttcggccgggggcgctaagtgaggttcttcaccctcgatctgtggaatgtacgcgagagagcaaacgcacaagacacgggcgatgtagacaggttcgggccgctgagaagcgtaataccctactcctgtgttctggtggatatgtgtgaggaagagttacagagagtcggggagcaagagagttcaagctctagaacccctctttttccttctcttctggttcttttttctctcgatctcctcccccagctcaagtcttctcagagttgtccccccttttctttgtgggcaaggtcctccttttatatctcaaggggataccacatgcaccacttctacctactcttcttttgggtggggacccaccctatcttgaccaaatcttgacacgcacctccgcctggaagctaaatcaacgcctgtccttgagtgatgcccagcgccgtcactcgtcagacacaggggatcaccctgtcatttcttcattaatgggcggagttttgcaatggccgctgtccgaatgaccctccgatgggatgggtcatacctgcctccactccgctggaagctgatgcaacatgagagcacggttgtctgccgatgacgtgaccggcgtcggaccagtgacagaccggtcattcttgtccaccacgtgtcagtttagcatgccacacatctgcccttcttcatacagtgacttccttgcaatggttgcgatgaagcctggcatgaatcgagccgggactgatgtgctaactccaggagttaccacgctggctccagctagggacgagtgccaagaggctctcatcattccgacgggacggggcgaggcgtgtgacagtccgcctgctgccacctaacccgcgatctgaccggtctgtgaccgatcacacactgcgaccggtcacggaccggatatgcgtgcgccgtgctgcattaaatgcggcgtggcgcgcttgtccattccgcaataaatgtggtttggtgagcgccgctgtgcccacctaactcacaaacatggcgccaataccacagggggtcgggggcaccccagccctcggggccgaagcaggagcggcccgacccctcgggaagacaaaggaggggtggccacgtctccctcaggcccgacccccccccccccgagggggttaggccacgtgggtgactgcggctgcccaagcctctagtcatgatacccccgatcccatgtcaccgacagtagcccccggcgttatgccagggcgatcgcccccctcgagggaagcgctcgggcgtgacgccactccttaggtctggtgacaggtgggaccggtctctacaggtgggcaggaacccagcggtcgcaaatcgcgcgcatcggctagggaaaaaacgaccgataataatgagtggcctcttcaagaccgctacatttctcgaaatagcgcgcgaatcgggacgagccggttcatttcgcctggagatatgatgatggcgcttcggtcggcgagcgtagttaacgcgcgcacgatatgtctcatctcgactgccacggccgcacatccgcctcgtgcgccgcaaaagggcgagtgggattagtggaggcgtgggcgcgagaaacgagggggcgagatagtgggcgcgggaaacgaggagccgggaatagcgttggcaagggtataagggcgccaaggaagagattcgtttccttcctctcgccattattccccttgccttcgccgcttgcgccctaactccttgtttcctgtgccctacccttgccgcactcactcgttctcaagttcctcctccgccggcgtcatggcacggggctccgcaccgctcgacggtagcgtgctgccgccttcccgcatcgtgagcgagaggcaggccgggctgccgcgccgattcatgccggaatctaccgccggtcgggaggtggtcgagctgggcgagggacgcccggcaccacactacccggggcggtccgtcttcttcctccctttcgcaatggcagggctggtcccgccattctcttctttcttcatggatgttctggagttttatgatctccaaatggcgcacctcacccccaacgcggtaatgacgttggccatcttcgcgcacctgtgcgagatgtttatcggggtgcgcccatctcttcggctgttccggtggttcttcaccgtacagctagtgtcgccgccgtcggtagttggtggctgctactt

SEQ ID NO: 59533 - DNA, 20188 bp, Oryza sativa
taaggtagcattgatttgttgtcatgctaattcagttatgtatttaattctatctttagctctatttaagttctagtgctgtacaagtaatttttttcaggtacttaatacagttcttgcttattttcagtagcaggtcaacaggaatattgtgtctgggactgggatctggagttaaggatgcttcacaattcaaatttcacaagtatgtgaccatctaagcatgattcaatatttcgcatcataaacacgtgatttgttgatgaatattaaatactaaaatttggcaagacgtgtgggttcttggcaataaattggttctttgtactagcaattaacaaaatcagttagtaaatattgacatcgttctgctcaccaataggttgtgcctgttaattcttccaacatgctgtggccatgaccaaagttacttcctccctaattcgatgttaggtaacaatgtgctatttacagttcatttgttttctctatcttctgtaaagtccagatgctctaggattctgaaaagaaatggttaaatgtgaactaaaatttcatactaggctctgaaatctaatctatttgtttgccaatgctttaatctatttgaaaccatagtgacatgtcttgagttttactctctatgattactacacctgttgtctagtttctaaagtgtcttctgatacatgataatggaactagaagaactaaactctgcaaaactgtcacagtagcaaccttttgttcttttcagatcgtgtgtgtgtgtgtgtgtgagagagagagagagagatagagcatgtgtgctgatgagggggtataatctgctgttgcatgtcatacaacaccataggtttttagagctagatttactaatgcaatcaacatgtactgagaaagaacccattttatgcattgagaaagattagatgaagtaaaaaacctggatgcagttgttcttgttcttctgttgcttccaagttgagatcaaaagctcccaagttgagatcaaaagaatgtacaacttgatcatttccatggcaagcaactcgagcaatgtcatctacctagataacatgccttccaggaacttcttcttctagattggcttgtgcttcattgaggtcaggtaaagcccctccatcttcctcttcttctgctaatatgtttagatctatagccattgtgatgggtaggtgtggagttggtttgtaggatgatggatgaagtgataaaaggcttgtagctgcctcgctgcttgaggattatggagggtacccttgggcggcaaagcaccatccatggagtttttgaatttgattagaccagttggattattttaagcccttatgttttggcgccatatcactcgaattaggtgtataacaccaatctgtagtgttgatactagtagtagcacccaacattaattggatgcttcaaatattccttttgtacagatgtggcagtgtacttgtcgtactcctactaagcattcaaatgattagccccaatcctataaattgagggcaaaatggtcattttcacacaacactattttttcctaactaacctagaacgtcctcctttctgggacggagggagtaatttgctacaaaacacactaagactattaaattattatttccattaggatcggagagagaatttaactaaaatgactttggtgccccggatttcttccaaccatccattcctctcacgcgtagtaaggctgtgttcgctccagcgtgttcccaaccggaacagtgcgtacggaaaacggaacggtctattagcgcatgattaattaattattagctttttttaaaaaaaaatggatcaatgtgattttttaagcaacttttgtgtagaaactttttgtaaaaaatacactgtttagcagtttgaaaagcgtcacgcgaaaaacgagagagatgttttaggaaacctgggggtaagaacacagcctgagggtgtacggtgcgaggaccggcgatgcgactgtatggtgtggcggtagcgactttgtagcgggtggctagcggtgtagcggtgaggactacatagtaggccaacacgatggcagcggccttgagggagagggtcacatgagtggactgtgacatggagcacagcagggagtgagcacgtgaggagcagcatcacgactaggtggtgcggcgggggtagcgcgctgcgtgaggagaggcggcagtgacctcacggtgggggtggctgcaacagtgatgatagcgtgactgcagcgaccttgctatgagacatgggtgcacagcgcttgtgctcacacgaacgtgagtagtggttgcatgactgcacgggcggcagcggcaaataactcggtgccggagaaaaactgaaagaagggagaagaagataagggcaaaattcatattttatgtggtttctctcgtattaattggatggataatatattttaatgcgtccgatgttttgtgacaaattaacatattatcaaacagattcacattcttgtggtgtctattagcaaataccatacttctcgagtgttctgcaataaattttgtcataaattaaccagttgtcgagactcgccttaattatcgaccgaatgccggataaatcctatttttttgtcaaatttcgatttcaataaaatctattgtttgcaatatgatttctcaaaaatcctccgaatttttcaccttttttagaggttcaaaattttcacttggaatccactttcgtctatggcgtcgaaattaaaccttgaaattccatgaatttattttatcagttttcattgaaaatgtgtgcttactaccatcggatgaaatcatgtgacgtttcggatagtgaaaatggcttacacatagtattttagctctcagaagcatcagataaacctaactagagggagtaaagggcttaccttggctccgggctgggctgcagcatcaacaccaacaaagacgccatctgatgctttgtccaaagaggatcgagatgcaaaggtccggttcaagctggcacagatggtggagctggcggcttctactgcttcaaggccgatggctagtcatccccggttgcagttggcggcgaggacgcagctggaaacttcgtcaggttctcgtttttcagttttgtagggtgtttctgaagatgaagatcatttacacttggagccggctacgaagccttggagtggtcctcttcctgcgcctcgtcgatcgccgccaagaacgattggaggtattatcaaagcagcgattcagggtaaagtttttttgtcgtttccttctacaattcagagtaatagatgttctccggtagtctcttccgttccggcgagatctcggtctcctccggcggtgagtccggttcctcgatccgattggatgcgtttccaaaactttcgggtgattcatctatttcgaattgtgaggttttggatgagtttttgccgcaattgccacataggcccagtattccttttaggcccacacctggtcttgtctctctattcgcaaaaacggggacagtgcgccagaaggttaggtttacggatcgatctgtgccgcctccttcgtacgccgctgtagttcgtcgttcaatggagagaaagaaccagcgtcctgttcatggagggggaggacaaggcagctttgctgctcgtgcaaactttcatccaggtcatggcgagggaggttttcaaggtgctcgaggccggtttggcagaaatcgctttggagctcggaattttggtggaggccggcaggggcaaggtggaagaggttggaacggcaatggtgggcaaccaaatgctggttcccatggcggaggagatggctggtttggacaggaaaaatttagaaataccgaaggtggttttggtctgcaagctaggccaatttttgggcataatcctgggctaaggtttgggcaatctccaacctttagctttggattgcagccggtcccgttgccgtttggtcagtttcctccggtgccggctggtggtggcgacgcatctctattggctgccggcagtggcttggcacaatttggaggagcggctgcacagtttggtggcgggatgattgcgggtggtgttgcgcagggatcgacagcagctcaacatggtgccgggttgacgggcgccggtgcacagactagtagcaactctggaggcaatggttctgtactggctgggattgctccttttggtgataatgtgcatcttcctggcggggtagctggtgatcggcatttgaccgctgtaggagaatctggtgcctcggctggagtggttgcagtatagacgatggttgggacttcacaaccaaccgttacgccatctactcaagagaatgcaggtagaggtttaattatgggggacaagagctctggtaaagcaaaggtggataatcagctgagtgtgcatgtaggtggcaaaggtattaacaagaatccatattgttatagatgctatactaaaggccatacgttgcaggaatgtacatctaaattttactgtgaggtttgtgaaagtgaggaccatataggatccaggtgtcctatttttaggtctaataataaaccctcagctgagttgtgtgggtatgcagtggatggtcttggtttttttcatatccctctttcagctggccagagaataaaacatgattctaaggctgccctagttaaagtaactagaggacaaatgacggtgcagaccgttgtttctgaattggagagattgattcctggaaattggaagtgggtggtggaagataatggagataacacttttcgtactatttttccttctgctgcggaactgaaacgcatggtagaatggggaatagtacatactaaggttagtgatgcagaaatgaagataattgaaaggggagttagtaatgaggtgaaatatgtgttgccaaaggtatgggttcaatgcaaaggcttaccttctgagttaagggagtttttaattatttgggcggttggttcaatgttaggtattacaaaaatggttgatatgaattttactagaagatatgacattgctcgtttacaagttctggttttagatccctctcttatccctgatgtggtggatgtggttattggggataatttgtatgagctgtgttttaaggtggagccagaaaatgggcttgatgtgcctgaacccatggacatggataatagtggtgatagagaagatggtaaaaatatggatgggagtgatgtgcaagataagggtaagggatcagatggaagtaattttaaggatggttccctactgcaaggtggtggccagtttagtggttctgtttcaggaaaaggaacgtcttctgagccatctactcaggttttgtcacctattattaaaggattctcaggttttgtcacctattattaaaggattgacagtatctgatgaggagtttgatgggcttgtggaggaatctgttggggcaggatcagttaagtctcatgaaagtctagctgttaagttagcggcagtacctgacacgattctctcccctactagacaaagcaagagaagagcaagtgatagtgatcaactcactttgcagagggctgaaaagattaaagctggggggaatttggaggttcagaatgttaaaggtaatttgcattttaatgattccttttttacatttgtcagataaagttatttcgtcctctctttctaaactgggttttatcgatgcaaacaatgatagtaattttgtgaatgctattaaggatataaggagtttggaagaagctaggttaagtgattgtattagtttgaaagacaagcataattctactgtttttcctgaaaatgaattgaccgacgatcagttggaggataattcagttttggaaaaactttgtagtgaaatcatggaggaggtaatggatacgggtggtgattatgattataatttgtatatcacctctgattctatgatatctccttcgataaaaaagagaagtgacaagaaagttaggtgtaagaaataattttacaatagtcttaatgaaaggagtttttttggaacagtgatgggttcaaggacccaaattatttctgatcttacaaaggaacaacaactagatttcattgctttatcggagactgttaagagagattttacatctagtgcccttaaaaatctttgtggcgggaaagattttttgtggcattgtaaacctcccagggggtgttctggtggtatgttattagggattaatttacaaacttttgatattggttcaattgatgagggcgatttttatattaagtttcatctttgtaacaaaattgagaagtttaaatgggctttagtcttggtgtatggacctgcacaaaatgatttaaaggaacattttctttctggattagttcatatgtgtagccatgaaaccttaccaattattgttggtggtgatttcaatattttacgaagcactatggaaaagaataatgacaattttgataatagatggccttttctttttaatgctatcatagacggtcttagcctcaaagaactctcaatgtctggaaagaattatacttgggctaataatctttcagtacctacttatgagaagttagacagagtattaatgtcgacggagtgggaacaaaaattcccactttccacgatatttgctcttaatcgagatatttctgatcatactcctctactcctgaatacaaactcatcttctgtatgtaatagtcaatataactttaaatttgagttaggttggctgttaagggatggttttgttgatatggtaaaggaaatttggttaagtgttgatgaaggaaatacttctctagagaggtggcaagcaaagattcgcagactaagacaatttttaagaggttgggctaaacaaactagtggtacctataaaaaggagaagaaagccctgttagaaaaacttgatttacttgataaaaaagctgaatcaaccttgttaactcaggaagagcttaatgctaaacattatatgaggaataggttagcttgtttgcttagagaagaggaaattaaatggtatcagcgggctaagaccaaagatattttggaaggtgactcaaatactaagtattttcatttggtagcaaatggtaagcataggaaaacaagaatttatcaattacaagatggtgaccacatcataaatggtgatgcaaacttaaaagcacatattaccacatattataaaggtctatttggtccacctgatgagtcttctttaactttggatgaaagtcttataggtgatattccccaggtgtcttctctagaaaataatcgttagttgatgaatttactgagaaagaaattaaagatgcagtttttcagatggaacataataaagctccgggtccggatggatttccggttgagttttaccaagtgttctgggacgtaattaaaacagacctggttgagttatttaaagattttcatagtggaagcttaaatctttactctcttaactttggtactattattttgctgcctaagtgcaaagaggctataaagattcaacaatataggcctatttgtttacttaatgtcagttttaaaatttttactaaagttgctacaaatagaatcactggggtagctcagaaagtaattagtcccacacagacagcttttatacctgggaggaatattatggagggggttgtcattcttcatgaaactattcatgagttgcatcggaaaaaaaatgagtggtgtcatttttaagattgattttgagaaagcttatgataaagttaaatggtcttttgttcaacaatccttgagaatgaagggcttttcccaaaaatggtgtgattggattgcttcttttatctaaggtggtcatgttggcattaaagtgaatgatcaggtgggatcaaattttcaaacttacaagggtttaaggcaaggggatccattatctccaattctttttaatatagttgttgatatgttaactatattaattaagagagcaaaagatgatggtcagagatctctggcttggtcccacatttagtggacgatggtttatctattttacaatatgctgatgatactattatttttctagagcatgatttagagaaatcaaaaaatatgaagctgttattaactgcgtttgaaaaactttctggccttaagataaattttcataagagtgaattattttgctttggtcaagcaaaggagtgtcatgagcaatattcaaatatttttggatgtaagctaggtgattttactgttagatatctcggcattccaatgcattttagaaatcttagtaataaagattggataacaattgaagaaagaattgaaaaaaaactcagtagttggaagggtaaacatatgtctgttggtgggagattggttttgattaattctgttttgtcaagtctagctatgtttatgatatcgttttttgagattcctaaaggggttcttcaaaaaattgattattatagatcccgtttcttttggcaaggggatgaacataaaaaaaagtatagattgacaagatgggatattatttgtcaaccaaaagatcagggtggacttggagttcacaatttagaaatacaaaaccaatgtcttttaagtaaatggttatttaaattaataaatgagcaaggtgtgtggcaagatttactgaaacaaaaatatcttactggtaaatcaattactcaggttgagaggaaacaaggggattcccatttttggtcaggtctgatgaaggttaagaattcctttttaaatatgggttcctggattattaataatggtgaacaagtaagattctgggaggataagtggctagggaactattctttgaaggaaaagtacccctcgttgttttctatagttagaaggaaaaatgcctcaattgctaatgttatgggttctgttccgcttaatgtttcttttagaagagctttagttggtcagaatctaattagatggcataatttgtgtgcttccattgtgcatattaacttaacatacgaggatgacatttttagatggaattttcatcaaaatggccaattttctgttcgatctatgtacttagctttaattaataatggttacatagaaagaaataaaattatttggaaacttaaaatgcctcttaagattaagatttttatgtggtatctccttaaagggattgttttaactaaagataatttggctagaaggaattggaatggtagtttgagatgttgcttttgtatgaaaaatgaatcaattcaccatctattctttcagtgccatttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaaacttgagacgacaattatgcatctatttgccaacttcgggtggaggttctctattagaattcagtagttaggggatctttttcttttgttggtgtctattagtttgcttagctttgtttctgctatcgtgaactttctgtgtgagttccataataattggctgtaactcttagagtaaaggccggaatgttacattccattatctaaaaaaaactagagggagtaactgggaagatcaacagcataccgtacgcttaattactctacacgcatgtaacccagctggtatatagcttttccacatttccagttactcgattggaatgcaatgcttttgagtaaaggccggatattatatttcattatctaaaaaaaatttaattatgtctattcttaagctatgattgagcttgtcttacgggaatattttttcccatgaatagctaaatgattttatgataactatttatgtacgagtacaaataaaataaattaactattataagattttaaaaatagattaaaaaacaatattactaagtcgtatatatttttatgcgaaaatcacatcgtttaattaggagtcggaaaacacatgccatagtttttataattccatcattatatacagagatgcaaaattatatgaatcaaatggtcaatttttcgtctacggctattaaaaacctcgaacgaaagtcaaatcaagaaagaatggggatttatcattggttagaggatggggtgtcgattgaccgtgatggctgtccacaacagattgtcgtatatgtgcatgcttgcatactcgggcgtacggtacgggtaagctaaggctgcgtggaatcacgctgtacacacatacgtagtatagagtaggatttggatggccattttcatgaacaagtagagagatatagatagatgtggcgaccattaattcattccttctgtggctttagcagtgtgcacggatcgcccttataagtgacactactttaaaaaatatatttttcatagcaccactcttttatttttttttcctcaagtttaataaacacacgcttgtaaagataattaagagggattccgatcaccaactgccagtgaaaattagttttcgttggttgtcgcttaagatatctgcttgcaaaaatagaggtatttttacaaacggttcctttaagcgacaaatttcgctagtagcggctaaggagtaccaactgaaaaaaaaagcaaaaaaaaaataagttctctatattaaaatttccactgatcttatatccccttctctcactcagactctccctcctagctcctccccccacctctccccttccctcccccacccctggctctcctcctctcggcaaccacggcaggctagcaacggctgacgcggagcacctgatgcagacttggcacctgacgtggggctgcattggctttcgatctccggcgaaggggtaagtcctacgttcggccggccctaccaattgtatcgactacattggtattgttcaaagctacatcgcttcgacctcttggatcgctctggtttggttggtatacttgcatacatatttatcatatatcttagttaatctagtttagcatcttaatttacttttgtatcagctgagattcgttttagggtttatgctgtatcggctaaattatcttgctaaattatattagctaagatatcaccaccctaaaaattagtcaaaatagactttatacttctttgcatactttgcgatgcatcatccatcgccaaagttgggcagagcaaggcgatcagtgtgtgttgggtcgtctcctatatatacagctaggcaggtgattgacaaatagctaatccttgttacatcgagaaagccagtccaattaagggggaaaaacacgaatattagagaaggatgtaatatcaaataaataaaatggatgaggcttcgaaaccaggctagctagcccaccatcttattaattaagctagccggaagacccctgcgtgtttctcaattaaggagagaaaaatgctacttcttcagttaactgtttttcctactctcttgcaaatttagtttataagccaactatttttctttttctctgttttctccgtgatcagagaatcattcaatcattcattttcgatgtgcatgttccattgttcctagatcttgatccacggatgaatgatccatactgttactgatcagtagggctttctgcatgtgtcgcgccctttcgaaccgtcgaaccgtccaattaatgtgctccaaggctgacaaatggtgtcttttgccgagctgcatagtctcgactggacacatatatattcatcagtatgttacatacatcattggattagtggtttcgggaatgtttttgcaaatacacatttcgccaaattctgatctgacgatccagcagcgcagatagatccacggatgcttccacaaaatattccattcctgcagtatatccagatctcaacaaaacgcaggtcgatcatcagtgtccactgaacaaaagcacatgccatgcatatacttgcttcatcgtaggcttagcagctcgctacagtgttgaccctacaatttttagaatcatgggttttcgcagcaacgttaattaagggcttcttggcagtagcagaggtagcaccgccgttgagtagaggtgataatagcattgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacaagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcttccgtcgccgccgaccggtgtcatcgcctatacggttggtcggtcacaccaccgttcatgggcgtccatgtcttcaccgaccggctggccttcgccgccgccgactggtgtttccgcctgcacggctggcctattatgccgccgccgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatcctcaccgttggctcaccttcgctgccgtcgactggtgtttccgcctacacggctggcctattatgccgccgctgttgggcgtctacgacttcaccgccggcctgcctccgtcgccgccgactggtgtttccgcctacacctcggtacccattatgccgccgctgttgggcgtctacgacttcaccgccggcctgcctccgtcgccgtcgagtggtgcctccgcctacacggctggcctattatgccgccgctgttgggcgtctacatcctcaccgttggctcaccttcgctaccgtcgactggtgtttccgcctacacggctggcctattatgccgccgctgttgggcgtctacgacttcaccgccggcctgcctccgtcgccgccgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctatgacttcaccgccggcccgcctccgtcgccgccgagtggtgcctccgcctacacggctggcctattatgccgccgctgttgggtgtctacgacttcaccgccggcctgcctccgtcgccgccgagtggtgcctccgcctacacggctggcctattatgccgccgctgttgggcgtctacatcctcaccgttggctcaccttcgctgccgtcgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgccttcgtcgccgccgactggtgtcctcgcctgcacggctggcctatcatgccgccgttgttgggcgtccacgtcttcgccgaccggctggccttcgccgctgccgactggtgtttttgcctatacggttgacggacttcgccgctgttaatgggcttcatcatctacaccactggcttggttccactggcgccgactggtgtttttgtcaccattgatggactgcttcgttcccacattggctacttctgccatcaccaaggggaatattacaaagctaagtcgtcatttattttattctttatatgatatttttccttttcctctgcctcactacaccaattggtcttccattgagtagtgagtcgggggctacagatgttatatcatattttttataatattcatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgaagaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctctaggaatggatcagtcagaacatcaccaccggccgcctcgtccgccgccgactggtgttctcgcctgcacggttggcctattatgccgccgctgttgggcgcctacgtcttcaccgaccggctcgcctttgccgccgccgactggtgtcctcgcctgcacggctggcctattatgccgccgttgttgggcgcctacgtcttcaccgaccggctcgcctacttcgccgccgactggtgtccacgcctgcacggctggcctattatgccgccgctgttgggcgcctacgtcttcaccgaccggctcgccttcgtcgccgccgactggtgtccacgcctgcacggctggcctattatgccgccgctgttgggcgcctacgtcttcaccgaccggctcgcctttgccgccgccgactggtgtcctcgcctgcacggctggcctttatgccgccgttgttgggcgtctacgtcttcaccgaccggcttgccttcgccgctgccgattggtgcttccgcctgcacagctggcctattatgccgccgctgttgggcgcctacgtcttcaccgaccggctcgccttcgccgccgccgactggtgtttccgcctgcacggctggggcgcgtcttcaccgaccggcttgccttcgccgctaccgattggtgcttccgcctgcacggcagacttattatgctgccgttgttgggcgtctacgtcttcaccgaccggccgccgcatccgcagctgactggtgtcaccgcctgcacggctggcctgttataacgccaactgatgctaccttcttcacggctggctacatcgctgtcactactaataggcatcagtatcttcaacacaagctgcctacgtttgccatggctgccgactggtttcttcacttccatggctgcatgattctgccagtgttgattggccttatcttcttcaccgccggtcgtctcgtctgctgctgactagtgctctcacctctacgtctggtttatacagttaccactactgatggacatcatcgtcttccgttgccgactggttatgccgccgccgactagtgcttttatcttcacaactgcgcgtcttcgctaccagtttgcttctgttgccgccgactcgtgttcacttcatcacggcgatgcaactttgtcatcatggtggagcaacttcatctttattatcttcggcactggcaaactctattgctgctacttcgcaagttttactacttcaccaaccacgacgtctttgtgagcctcgacatctcggcatgcgatgccatgttattttactacaacaagaggctctccaatattcaggatttctacttatatcttcaatcaagcaatgactactcgacgacaagaagctataattctcgactctatgttcagttgtttcccaactaaccaaagagtcgggggctacacaaatataaggctcaaaatttgacaaattttatgtcaagctgaagaaatcaattcatcagccaatgagtcaactccaggagtcattatcttcatctttgcttcggaacagacattctacttcaaatatttcggtttgaacgagttggacaacaacatcaactctcctccaagtgaagcatctacaacagctataacattaatttgatggattattgtcactgacatcatcaccagcacctttgcttcatcgcccctgacatctccgctgttgctaatggatgattatgttttcgccgacttattatttcaccttcacggttgacctactatgcaaatgctgatgagcgtctttgtcattatcattggttgctacactgctattggctggatcaccgacatcgtcttcttcatcatgtcggttgcgtttgtcgccgccgactattttcttcatcttcatgattggtggatttcgtcatcgcctttgatgcgtgtctacatcttcaccgtcggcttgctttcgtcaccaccgaccggtatcctcgccttcatggatggcttattatgttgccactaatgggcatcttcatcttcttcaccaactgcatcgtctgtcaccgactgattatttcgctgccatggctacacaactttatcgctgggcgctttcatcttcattgctggctgacctgactgttgccgactggtttcttcgcctccatggttatgcaacttcattacctttgattggtgtcactgtttttactaccactgacatcttccgttacttctgatgagcaatttcgtcttcatgttggtcatttcatctccatgccgactgcgtcagctattgccaatatacaattttgactatgacagaaggacaagctatatgctcaggggctcatcaactcaagcgtgaggattatatctccaatttggacttgttccggatacatcccacatggattcaaagtcatgagtctattttctatgctcaaagactggaccaattattattccccgtaagggctatcaaccgaatacttgcgccagtcgggattcaattattatatttattttagagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatatttttaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatagtcatggtgctgtttgggtttttaagcaattgattggatacaatatcattgctttttgccacgtaagtgtgcatttttattgaccaatattatggcttaggctgattatatattgtgatcatttttcaggcggttggtaaatcctttatgagtttatttactcggattttataccacatatgccatatatttccaggtgtggtggaaccatgtgtcttctagggacttaagcacatctgttaaagcagtgtgcgcatggcgtatgcccaatactttggaaatttctttattcacaacatacaagcttccttatagctattttgctatgtgaattttcaatgatgtagccaactttaggttacactcatcatattttacaaagcagtcggtatatcacttggatcatattattcagggattcacaccgcatatgctacatattaatattaagtcgcttggttgactacaattatcgaaaccactcggtgcatctagtcgatgcacctgactttattttttcagccctccacagtcttctgatttagaaaaagtactcgggagatcatggcgaagatgattgaagcactcggctttggagtaatctagttcgagagaagattatctttctgactgtgaaggtctcaggggctactgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacaagcattttcggttaaataatttttattggcatctattgctgtcagtagtgaagacagcaacggtagagcctggccgcctgggcaatcgtccgacctacccggaagccggctccatcagttcttgggaatgcaggaaatttaaaaaactattttagcataatttatttcaaatatttcaaatttcctccaatcttaaagaggtctctaaatgtgtttataaaacttagggcatgtatctggttttctttgtttatacaaaactattaaaaaatattttcggttattggcaagaaccagttaatatattttggcaagggaaactcaagaaaaatcacaccaagccatttccacttattagatagagtttttaattagggattcattctaggttaacttaaacaatttcgtttggtgatttattaaatgcattaaggctaggaaagggaaacttcatggtgtgatagttaccgaatagaagcaggccacggttagctcatttaaatcaacacacatacaagatggaccaaaaacatggggagacaatgatttttttttccgaaattcagattacagggatctactctcattgagcagctccagaga

SEQ ID NO: 59534 - DNA, 5817 bp, Oryza sativa
ggcctcctcgtctcggtccggtggcgagggctgcgcggggacagccggatctggccacataagcccagatccggcgcctctctagcggctccgcgctttctagcgtgaggccagtgcggaccgacggtagtggagtccgggtggcaccgacgagctccaccggtctagcgtggtggctaagcaagtcgtcaacggtgtacaggtggttgtgtgcatagaacaggtacctttggtgtgtaggtggcatttggtggcttccattgcggttgctttgtttggatgagactccgaggtgaaatccttgcccggcttgccaatgctagcaatgacaacgctctcgggcgtcgttcaccttcttgaaggcgttgctactggagccctccttatctccacatcaaggggtttctccgggtgaaaacctagattcgtatgatcgggtgatgtcgccgttcggtcggcatgtccttcttgaaggcatcgttttaggagttttttccttgatggacagatatacttagtttttagttttagcttgttgttttcgccggttttccacaaattaaccatgtcgttgtaaggtttttgggttcggtttcccttataaactagatcaattctcttcttctataatgaattgctggaactccctgcctgctccctcaaaaaaaaatcacatgtaagtgtgcggcatcatcacccactagcaataattatctagagtattttaaatatcacacaaacatgatatgtcatttacaattttgttgtattttaagaactcaatatgcaagcattgtcaaatcattatctacattatttaaacatatacatataccatttatataatatatataacatgcatttatctatatatatcccacaacaaagtgcggggtatcaactagttctttaaaaatttatggctttgccactagcataagggagaccaaaggagtcgcgatgacataatacacatgagagccagaagccgcagcaacagcacagtgatggcaatggtggcggcgcccccttcattcggctagagcatcccattgtcgacctcatttccttccgtgcttcctccacctaccacctccccgttacccgtgttcctcctctttcggagagagagtgtcagccgcggcgcctctccttcgccacaagttgggacatcaccacgccttgatcctcctctgagccttattgaaaataccagatctttccccattggcccgatctaccgattagcgtcatgtgcatgggggcggctcggccgacaagccttgataggggggaggaggaggaggaaggagggcggtggtggggacaggaggaggacatcgagtggcagatggaatgaaggtgttgcgtggatgagtaggcaaccggctaaggatatgattggacggtttttttttattttgagaatgccctcatatcgttatgattacaacattgtccttataaatcgaattttctgttgttcacattacatttcacgcacaaattagagttatcttgtaaacattacgacaaagtgcaagtggtgggagcattgctttgctatttcattgtatcacgcgcatatatgaaaaaaaatgcaaagctctctatggcacgcatgcacgctggggctatccacatctagtcaactaaaccggacactaggcatggcgcaagcatccatgaacagtcccgatgattgagaaacctaacatcgtcggttaacctgcccaatcgaggagcttctgtgcagaataaaaatacgagtcacctattccgaggaggcaaaatttttttttgaaaaaccgagaaaatcgagatggttgccgatgttatcagctgatgatttatggttggagtcgaaagtctaaacatatgtagtttttttttatgacttcaacattacctgttcttatgtgtgaggactagtgggatgttatcctattttactaaccattgatgtgtttgtgtactactagttttctaactcatgttccatttgtaacgtgaatgttgtcttgttcttcataaaactcttgttgtaacaacatttgaaatacacgcactcatttcaacaaaaaaaattatattatgaggttgttgaatatgtctaagactaaaccaaacaaacataaaagcaaatcttacaatatatagtgcaaaccacatagacagtgcatacctgaaaactactacaatatccaaaattaacgtctgagatttatccacttcaacatgaataaaacttttactcctagattactgcattttggatcttaccttagttttcaagtttgcactacatatatggtttatactacatattttctataaatatttagagcctatttggtagggcttcaactccaactcagaaacaaatggtttcagctccaccaaaatgggagtgaagttggttagagtgatatgaaaaaatgaactataaaggtgaagcgggttttgggttgctcaacagctccacttcagaatttgctcctggagttagattgagaagtttgaaccttgccaaataggcctttatcttacgcctttctcaaaataatggcatatctcagtcaacaaaccataagttaagagaaaactgactggatgaatcaatccgtgcgtaaaacccattgttatgtaggctaatgggttagcgttcgcagcccgtgaacgcttttcgacaacccaacagcatattagcctcctccccatatcttcctctctctctatcttatcttctttctctcgctctcaacagctttgtccatccgtaaacacgacgacgcgagaagtcttggacgagcagcctccctccagcaagcttcaccaccaagtcaataattgtctccaccatcacccccaccgtgaaaccgctcggtctcactggcaccgaaaggcatcaacatgctagcgtgtcccagtgtccctgccccgtcagcctcctccctccatttctcctcacttgtcccatgccaccaatattggcccactgtcacctcctaaccccgtggcaccgacgacgccactgccacctcaccacccacccacaaccctcctagaccatccctccccacttccctccacagcgccaccctccttcccaaccccatccccgaaccttaaccctaaccctaacttggccttttttttaagggaatgctagtcgactagttctattgatcggagaacatagttacttcactaaccaaagtgcttagaataaaccctaacctggcccttatcattgtgcgttggagcacgttttccagatacctaattcgccatatctttcctatagaaggaacatccaggattccggggaaaacgtccataaaactaatcggacggccaggataatctgttacatcgctaaccaaagtgcttagaataaaccctaacctggcccttatcattatgcgtcggagcgcgtttgtcagatacctaattcgccatgtctctcctttagaaggaacatccagaattacagggaagacgtccataactaatcggacggccaggataatctccacatctctcaaccgcggcagagcaaagctaccctaatgggcttttgggcccagccgaggaagcggcccaatcaacacacacgcacgcccccaaacccccacccttctaccttcttccacctccacctcctcctcctcctcctttgcccttttccacttcctcctcccccactcccccccctcctccacacaagcacggagacctcccgcctcggcggaggaggagcagcagccgccgcaggcgctcgcggtcggggtcggggaggagggagaatctcgcgctgtctcccgattcattccggggggttgtgtggttttgagttcttggaccgggaaaagggggcgttcttggattgatcagtggaggaggtgggaggaggggggttggggagagagaggagaggaggcggcggggatggggagctgcggcgcgggagcggcggacagcgagtggcccgacggcgtgacggggcgggacgcggaggtcggggcgctcgtgtgggtgcgccgccgcaacggatcctggtggcccggccagatcctcagcgccgacgagctcccggagaactgcgtcgtcccgccgcgctcctccggcacgcccatcaagctcctcggccgccccgacggcagcatgtccgtacacacacacctcctccctccttcgtcgtcctccaatcccctgtctctttttcttctgattgctttgcttctgttcctttctctttgttaagagttcctgcatgcttagatgatccatgctgtagtctgttcttggtcttatggccatttagacctacctctgtttcgtgtcccactctgaatttgggcaaagaacactgtgatgtggttcttgatttgggaagaactggaagatagtgtattgtgcttgtcctgggtggctttctgaatttttagtatatgccttaagctcagcaaggctgctagtgccatgggatgtttggtgtgtttgcagttagcggtagttgttgttatctacggtggtgtagtgtattctagactataatcgtcaatggattttattttatttttgctcagcccctgtttttctgcatgatgagatatgggaattgggcgaggtaatggacatatcgattagtgtgacacgattatagcttttatcagtatacaccaaagacaacttgtgtcatgcttctcttgaaaattaggaggtaaattttcgattgaattcttgtgctctcttgatggtatttttatatcttacagatatggtatgaagtctgtgaatcttcccctgattttttctttttttcctgaagcttgctttggacttaagagcgaagattcatttatatggggaatcaatgtttttaggttgtatgatgaatcgatgactttaggttgtatggatgtcatcacttctagtaggtttagatggattttcttctaactgttcagcatgtccataaactaatgctattatgtgccttttctgaatgtgttacttcagaagagatgttttatttctattcactatatttaactatagttttgtttagcatgaattgtgtatgtgatgtattttctgtaccctaaatctgactattgtttttttaatcttacccactatttttaattaactttgcaacagtgactggtataatcttgagaagtctaagcgtgtgaagccatttcgatgtggagagtatgaggaatgtatagaaaaagcaaaggctcaagctcgccagcataagagggcctacaatgaaggaaagtatgtccgcagggaagatgctatcatgcatgctcttgaacttgaaagggctcgctttccaaatgaagatgatactgatgaacatgatactagtggcctattatttgaatcccaaaacagctattgtgcaaagtccaaaaacataaatgagctcaataaaaaatcgtctcgcactgcaagggatctgtatgatattgaagaggagtcagctaaaggtttgtctcaggccttaacattatataaacagccacagaatgtgtcctcttcaagcactaggtatgcttcatcatcaaggaagaaacataaggcatcaaatgattttgaggatgacacagttcaaggatcccaacgtatgagagaccttacggagattggatcaaagaaacacagttcatacgtcctaaatgggcaccgggatctaccacttcttgagagtgcaagctttggttatagcttgtctggtaccaatgggataaaaggtgatccgcagttcattcggcaacaaaaggaagcgttcaatattggcca

SEQ ID NO: 59535 - DNA, 7343 bp, Oryza sativa
atttttggtaaaatttattagttgttggcacgctatgtacacggaaatattgtgtgcatataatatattcttcagcaaagcacgttggtttcatttagcctctaaacagtttgtaaatctgccaccgccaaattacaatgctatgtgcagagagaagcaaagggatcaaccacctatatctggtatcaggcccatcatcaaggagggttgatttattttgttggcattatgtattgtggttgatgccattgccatgtcagacacatcattagcatcaacaatgacatttatgcaatgtttgacttagtcagccaaccgaactataagatgggaatgatggtgttcgtgacgaaaatatcaatgcaattgctctctaaccaacaatgcctcttttaaattacgagactcgtcatatgcattcggtatataatggagtactctctccattcacaattgaagtataagcttttctaacgatatgcatttttcaatctggccaaaaattggttcggccttgtttttgagaaaattcgacagaataatttgatcgtggttgatttggttcaatcttctgttttacgggaaaaaaacaaatcacaacaaaatatcaagatagcgtcaattgtagcagttctaacttccaactcaacacaagaataagatagctacttgaacttcttttccaattccaattaattctgtcattttgactaaacgaggatgatagatgaattaattcaggttagtagatgagctcttgatcggtaagttcgtttgtttttccatctcgcacatttggagaaaatattttggttcttctcgttaaaagaggagtatatgggtgtagaagagtggttgaggaagataggaatacatggaatgcttatatttatagacaaggggagtaccatatcatatgatatggtaatatgtataatgctgtcaaaactgatcagcaaacgatactcactctgttcataaatattagcattccaaatgtttaaattttgtaaataaatataggcattatagatggttgcctttgccatcaatcacctccactacccttctgctcccatctgtttcttgattaactattccactcttatttgtttcttgattaactagtaacatactcctacattgtaatgggtcatgcttatataattaaagatcggttgggagaatgattgagaataaaacattggatctggtggttacttttcacatacaaacgcgttgcgtgcagtgggaaaataagatgaaatgaggataactctgcttttaagataatagagatcaaggatgttaaaatctttacttcccattcttaataacaaatgtttatatttgtgggtggtgggactatatttttcgctctatatttttctgtgtgatgccagtgcaaacgttggccttcttcacgttccattcaccgcctgtgcatctggctcgacaagacgatgatgcacgcagcagaagagatggatgaccctggtcaaaaagcaacgcacgattagccgctggtaagtacattacggcgactagtacaccaacggtcaagcggccctctcctctatgttgcatcctctacttattcatccatcctaaaatataacttagaactagaactaggatatatcactacgaagttggttagacggatatatctaatccgattctaagttattatattttagaatagagataatatttcatagagattagcgagtaagcaacggagtcaatgcctcacaagccacaacacggcaaaatattgttgttgccgaggagatgctgagtatggttcgtgtaaaaactttgttcgatttgtaatttgtggattatatatactgaaatgaaaaaaaaaatctcaacttgagatttttctttgatacttttcaaccaaaagaattttcttacaagcagtggcggatctaggaagagatagtaggggggtctgaataaacttgataaagcttacagccccccctcccatctacaaatagcagaaaattttagcggggtttttgtggggctcccaaagttggctcgagaccccaccgcccctatgtcggatccgcccctgcttgcaagcgcatttcagatgaaatttgtgacattctagtttgagattgcctattgttccactaaaaccattgtgagataatgtgtcatacccaagactcctttgaaatatagaaattttacatgattttcacatggaacaattcgatttctccaaaattaatgtgaaattcctacgtttcaaagaaggccaagattcaaaatgatggaaatatttcacggagctgcaaataggagtaatagccacatattccctccaaaaaaaattaatttctactatccccgtcctaaaatataatcatttttagcatagtgccaaattaaatatttctaactttgactattaatagcaaaataataaaaaagattaatcatgtaaaattgatattactaaatttatcattaaacaaactatcacaatatgcagctctttttatttaaaacattttatttttatagatatcgttggtcaaagtagcatattaaatatcatgtcgagatccaaaagtgcttatattttaggacggaggcagtagttacaaacctgaacatggaattgaatttttacggagggtgtacactgtttccagccaaaatgccaagtactccttcaccgacatacttaccgtataccccctccgtttgtctagtatttgcatgtggacccgtcccctagcctcctaccgttgtttatttctcttccttccttccacaagtgtactatactcctacatagccccagaatcagagcaggcaggacaggggccttcttttgacttttctggctatcatattcacatgccatcatcagaacccatgtactccagtagagctaaacagaatgctaaaagccctttaaatggttatcaagagggcttaagtactgttgtgtaggggctagccttgctagtactaagatctacttcctccgtccaaaaaaaacacaaaccctgagtttccatgtccaactttaactatccattttatatgaaatttttttataatttgtatttttattgttgttagatgacaaaacatgattaatattttatgcgtgacttgtctttttatttttttcataatttttaaataaaacggacggccaaacattaggcatgaaaaccagggtttgtctttttttttagttttttttttgagactgagggagtactagatagagagagagagagagaggaggtaaatgtaatggtaggagaggtggtagtagtagtaggagtattttcaaggcaatgaatgagccaacaaccccattcaaaagaggggccagctctctgccaggctaggagggacttggccctggggcccaaatcattaccagctggggccccaccccacagatctgaccaccacaaaagagagaaaaatagccataaataaggaaaaagaatcttgagagaggatgagagagagagagagaggaggcacaaagaggaaaaggtcttgtttctctcactcccaagcacattgggagatgtgacagacaagtgtcactcccagctaccaccacactcccagaaccaaatctagttccaaaaatgaaaaaaaaacagatgctggttataactgataacacaacacaatcagcagctgtgctactaatgctcaccccaggtgcagagattggcatcaccatcatcattatcatcatcatcacaaccacaaaggagagcaaggcaaaaaattccaaaagaggaagataaaaagaatgttggattgttttattcatggaaatggtagcattatgtatcagcaccacaaaccagcagcagaagcagcaaaatgacaccaatctttcttttaacaccaacccctaaacccatcctgcaccaattaacaagctctcttgattcgctaaaatgacagctagcctctcctgtactaacctcctccaacctccaaaatttttttgataccaccatttctccagggaagcaatccttcaattggatttctgatgtttttgctatatggtatttacatgtaatgaaaatctcaaccatcatccctctctaactccctctccccctccctcctctcctctatgataatatgctactaatctaaacaacattacaaacttgcccttcttgagaaggagggttggctggttctattggactataaggtaaagcaaaatgtatcaaatacaagaggtgaaagagcccagaaggtgaaagaattgaatggggtcggcatatgaacggtaaaaaaggagtaacaacagatggggaatggaatggggggcaaggggggaaaattggggaggctcttccacatataccaattttagctcattatgctcatgctcgtcagggaaattattgtgcagctgatgaaatgaggtgggactggtggaggctgacaacatcatctcaagttttgacagtaaaaggctataggggggaaaggggagcactatgcatcaatgaaatcgggaaatcggggttttcggtaccagctgcttctcaagaactagatacggcatagtgccttactgagtagcgcagaacatgcaagcttgggcagatcatttccttcaccttcaccccatctttgtatatcttgaatgttgggactatccgcacgttctccgccttcgcgaccatagggctatcttcaacatttacctgttgttttgcacacacaatgcagatttgttagtgtcatttataagcacttgttggatgtatttgattggagacatgtcaagtgtctcacctttaggaaattcagcgaggggcattcgctgcaaagggagttcaccgaaggtgtaattagtgtgcactgctgattcatgattgacatgaagtaaacaacagacacccctgaagatatagcaaattgttcaatagtcagtcaattgcaaaataggcaagtctggtatgataaacctagtaaaacacatgtttcaagaatataaagaaggcagtatttcggattgttcaggatgctaccagagcagcaccaatgagttaatttcagggtatgagatcaagggaaaaaaaagaactagtagagaataacacacctggtgatcctatggcagcacggagttgttctacactggttaccatctcaacctctcctccaaatttcatattcgatacatcctcaccacgagttgtcttcaatgcaacttgagcatggaacagtgcttctgcaacctctgtatcagcaggaagctctttatgaagcacctcatagtcccgcacacaatcagcccaacgctcgagctaaataatagttaacaaggtcaacataatgtacatagagtggaaacaatatccaattactcaattccactatcaaaaataaacatttaatgcatatgattgctgcttaccttggcataggatgaagctcgccttaaaagcgcctttgtgtaattaggttgtattcttaatgcttcgttacagtcatcaacagccttttcccaccgctctagcttcccccagcatgctgctcgattgcaatagagcactggatttgagggctcatatttgagcccttcactatatgctatagatgcatcagaaaacttggcagctttatagagctcatttccttgggctcgagcctttgcaactaatttgacattatttagaatcattccaacttccgcatttccaggatcaataaatctagcattatcagctgcctccacagcagcatcaaacctgtagaatacagaataacaaattcatgctaatctattttaaccgcaatgtggaaaattgagcattattctagggttagagaatcacaccttcccaatgccatgtcgacttgggctcggacaatagagacatatgactcagctagcatgcctgacgggttggctcccatccgatacagcaacacgctgtccaatttcagcaaacttgcaagagtcgagtcagcctcctccaacttgtggagacggagaagtgcttctgaccttatcgcaagaagctgcacagaagagcaaactcagtgtgaattgctacaaaccaacaattccttgcaaccttatgcttgacattaccagccgagaggagtcagctccagcagcaatggcagcatcagcttccctcagcgcgctcttccaatccccgactttcctggcatctatgcttcttccctgatgcatctccacctcctgcagcttctcccactccgaaggatcagattgatggagatgcccagcctgcgttaagtgcctcctcgccttgctaatcatccccaacctgagacaatgcaaggtccaatcggtttaatctacaattctagcaaaaattacatcacaccggttgttccaactgtaaaatcagacatcttgcgagtcagaacaaaactaggacaaaattttcagctttgtgtggcctacatccaatgcacctaaagaaagcttacaaaatacagctaagcaaacgctcccctttcatcagcaatgtgtgatggggaaccactttaacagcacatttacttcatggccaacacaagcttgtagctttcgacaaccacaaatcaaaccaatcaattgttgcgtaagcaaaaagatggaattcttaatcatcctatcatcaagcgtaaaaaaaataaaaaagaaattaaccaacagtgacgatcaagcatgccgcacaaagcagcagcaatcctaaatcgaaatcagattagcttaaggaaaaaggaaagacgctagatttatgttgctctcgctcgcgggaaaaaagagcttagcatccacatccaagaaagcaacagcaccatgcacgaagaagtcggaggaaatcggaagcaagaaagaagcaatgcgggaggaggaggagagctcaccggaggcagaggccggcgaggcggctgtgggcgcggccgttggccggatcgaggcggactgcctcctcgcagtcgcggagcgcgtcggcgaggcggccgaggccggcgagcgcggcggcgcggttcccgcggcacgcggcgctctcggggcagagggccacggcgcggtcgtagtgccgcagcgcctcggcgtgcttgcccttcttgtaccactcgttgcccaggcgggtcacatcctggaggctcccgctgctcgccgacgacgccgccgggaaggtcgccggagatctcggagcgtgtccaagaaacgacgaggagtcaatgctgctcctcgcgggggccatgccgccgccgccgcgcatgatgctcccgtggccgtagttgccggtgccggatccgagcacgtccgggcgggagcg

SEQ ID NO: 59536 - DNA, 6100 bp, Oryza sativa
tgatcggggaatcgcatgattagggttcagggtttaagcgccgtacgggagttcttggggttcgatgtttctatccagtttttgcatcgaaaatttttgggggattttttggtgctattgtggcggcgtgcaggtccagtcctgtctggcggatcaagcgcccggcatcaccggtggcgtgcttgatccgccggcggcgaagcacgccaccggcactgttgcggacaggaggccgccgcttcacaaggacaagccaaccggtggcgccaagaaaccccacacctccagcggcggcggcaggatgtgcgggagcgtcaactcctgcattgggtaccggcaccaagtgagctgccaccgcgccgacgccaaattcaccacgcccgccgtgcctttcggcgacatcctcctcacctgccggctggcttgccaaggaggagagaagtgagagagagagagaggaggaagggggaagaggggaaagagagaatgtgatgacgtggcatcctgacatgtgggacccacataaggtcccacgctgattcagccgccacgtcagataaaacctgggtcaaacccactgagggatctaaagtgaacgttttgtaagatgagacacgttatatatctggttctgcggttggaggactattttgtatctcaatgacaagttgagggaccatcggtgtactttttcctacaaattacaatcgtctagatgcaggcccaagtataatgatgtgcagagagagcactaagttcctcggaccttgaggtttctgcaggctgcagcccagcctcgccctggcctagcgatgttagcacggcccaagtggtgcccttggctgcagcagatcggagcaaacatatacagaaacttaaggaaagagctgcatagcttagaaaatagaatggacattagcgggaagaatcgaacccatgttttgtttagtatatacttcctccgttcctccgtttcacaatgtaagtcattctagcattttccacatttatattaatgttaatgaatctagatagatatatatgttgtctagattcattaacatcaatataaatatgagaaatgctagaatgacttacattgtaaaacggagagagtacgagttacatatactacttataatactagttataatgtactttacatttgactcaaatttttaaaagttgtatagatacaccctaaatatttggtgatttatttgcccgaaagtgaatatcatctccttccatgcatgcatctactttcatggatgcaatgttctgtctaacgtaaaatctaaagcgagaggcctctcgtttcagttgtatcgcgcgacgcgcctacctgagtgaggatatatgatatatatgatatggtttaattactgatgattgggtaaagaatattaaggatcttcatataacatggtctgttagtagaaactcatttactagtatgatctttattttagataacattaataaatcaccatataggaacttctttcggtactgttatatgatccctgtctagaaactctatatatgacatgaacaacaagaaaacgctgtttagataattaatcatatggtaaatttagccagaaatgcattggttaagtgcagcaagaaaatggtgttgggactgcgcaaaaaacacttttagtgtgcaaactacaattcaccaaccggcaaacatatttcacacaatcaacccttcatcttggcatgaactttgaggatagtttcaactggcaaatcagtagcggaataacaataaacacatgcacacaagacacagtgatttacgtggaaaaacctcctcggtgtgaggagtaaaaaaccacgggaccaacggtccactccaagcttccactataatcaacaataggtacaaatgtagtcttctctataatatctaaagacacatcacaacagctacaacatcaagttacatggcattatcaacatctcaaccatcaaagctaacaagaggtatatcaactaacaagtagagaaatagcagattctgtccttttcggttctcagctgagatctccaaaccacagttgcacgaaacttggcagaaatgatggtctatgattcccttccaagctgtcaaaaaacagcctaatcggacaccgtttgaccccctaaaccgacactttattaactattgcacaatctgtaatttagtgactcgagctgacaaaccaccactcaaatccgacgctctactcaactaatcctcatccaaactgaccagattgaagtgctcaaagtgagaaacaaactcaccaagtttggtgccaatccaaccacgtttgagcctccaatcgttgacttgatgaagatcgggtaagagcccccaagctgaacaagttgcacttcttctccactctcctctccctctctcttgtgtttgctggttgtttcttcacctcaaagactgctgctcgctctccctccaatggaggctagggtttttcttcccattcctaaaggatgaggtaatctcaaccgttgatcaacacttggatcaatggctcacatttgttggactttttgggctgcaaatgggctgagaacaaaaggtccatgtggagggaatttagccaacaaatggtatggtaccataaattttatagattatgattacatgaataactgattccattaattcagtaaatggatagagctggattggacagggagggaggatggctgaaaatgaatcggaaacgaatggaaactagctctaccatatccgttttcatatttttacggaatcaaaattaaaatcaaaaaccacggatataaaagtggaatcgaatataggtacaaaacgaatacgaaacggaacaaatgaataacaaatatttgatacaaataaaacccctcaaattaagcttccccatcaacgaggagatacacactggcactgccaagttctagtaacgatgcggcttcgatacgtaatgagacctgtgtccagccatagtattttccgcatcgtcgctactaaaaacgatttttctttcatgcggttgaaaaggggtttttacgtgcggatctcctatccgtccgcatcgaagggtctgcaaaattccggtgctagtcaattaagaacaagaaaactgatcaaaacgagccttaccgtccagataatgtacacatgcatgtatatagtactcgatccgtgtcgtcaatcatatcctatatgaatgctgctaatcatgcattattagttattgcgaaaaatccacgagataatatctggatgacctacgcaaattaactaacaaactgactcctgtcgtgatcgtgatcgatcgaggggatgatcagtaggccagccacaaactggtcgatattccggccggatcatcaaagatccgatcttacctcgaatgcttgatgatgcatggtcggtttaattattagcttgatgctgaaatgcacagtactgtagaaaaacactttggtaccgattgaaaaacctacatataggtaccggatttcacagtcaacaccaactcaatgacactgatgactctagattattaatgtcaattttacaaccggcaccattgacacgcacaagaggcaaaaaaaaaagaagaagaagaagaaggcttaatgcattggctcgatataattcgaaccaatgcgttgagttgctctccacagccccaaattacaattgaacaaaaacaaactcctgctcatgctataacttatgtacaggctgaatcacaaattcaataaaaaaaatgaactgctatcacaactaaatcacaaatccaaaaagatgaacttctcgctattgaagagttggggcggcaatgacgaggaaagaaaaaaggaacacaacgaggtatccgaatctgacgatcgtcgagcttgagacggcgccgtcacatcaccctagccctagggaggagggggggagggggggcgtgcctacttgctgtacacggcgaggtacccagatcttaacgatggccctacaacagcaccctcgccgatggtagcatatgcttctccttccccttctcctcttcctcccacccctcaccttccacttcccgcacggtgagcgacgcaaacgccgtggcactgtgcccacgatccgcataggggctgtcaggagtcatggcggacacgcacaccacaatgtccactcgcaagtttaggtttgagtcatgagagaaagagcatgcgtgaagggaggagaaggtgagatcgacatggctcaacagttcactgctggagaaagggactttagtcccggtttgcaaccgtttttagtgcaactaggaagcacaatccgcccatctttagtcccggttgaaataactgagactaaagatacataccaaggcaaaaaaaaaaaaaaggtgtgcaaccaggacgcacaagtcgcccatctttagtcccggttaaaataatcgggactaaagatgcataccacataaaaaaaatgtgtaggatgtgggattcaaactcaatactctcactttagccctcacgcgcattaccatcccacctaatacacacatctaacttgaatagagatgctttatttttaaactaaccctaaagatatctttagtccagattggtgtcaccaaccgggactaaaaattggtgttaccaactgggactaaaaagttagtataaccaattggtaacaccaagctggactaaagatctttggaggcctgacatggcctgacagctattgaatcatggctaaaaatgatctttagtcctagtttttattcgaaccgggacaaatatgatttttgccatctgagtaaagatcagttctccagtagtggtttgtggtgccggtttattaataaaaaaaaagacacttctaaagttatgatgatatgcatgtgtctgcttttccaaagaaaaacggcacatataatatgtaatattataggtgccggtttttattaagcacaacgtttatatttcttccaaaacaacattccgcgagcgtgctgctctctggtggaaaagccaattccagaatttccagcacctatagtatcattattttttttcgtttgtgtaagtagtggcgcatgcgcagaccgtctactcaccattgattttcttttcccctcaccgcgtggcctccgcgtctgttggaatcattccatgtcaatgtctcatggtacgtacggtacgaataattaatcgtactatacgtggctaatgttaattgcgtgagctcgtgcgcaagcatgctagctctacaacaacgactgtgttgaccgattagggactcgatcatgcatgtctgactctggtcgactttgtttttcttaaaaatgtagtgtatataattacggctcgattattccggtgtcatgagggcatgccgcactttggttctaggcgactccatataaatatataatcctccgccttaattaattaatgtccacaaattaaaagagaggaaaaaaaggtctgggatgatatggtccaagcaatgtacaaaaggtactcgatccctccaaaatatcaactatttctctcaagtttttcatgggaattaagaagagagataaaaacattatatcgccatttattaattgttcctattgaagagaagagggtgaggacagcagagataaggggtgttttaaatatttcactagggatcgtaacgatatcgttcttgtagaactaatatagtaataattttatcaacggttaccgttttaaaatatttgtattccaagtttctattagttagtgtcttattaaagttgttactaaatagttaaaaattccccaactattttcattcgtttccataaaaataataaaaaaatgatactgtttcagatctttttccttcctactacaaacactgtttgttactctagaagccgctatagcctatcagctcatgcctccccgagctctgaaacgacgtcccttgagagaagggagactggctagctagcttgcctgtctgtcttgccacatgctttgcttgctgcatagatgaattcagggtatgatcgataccgatagatctctggaagcctatcatgcatgccatgcaccagca

SEQ ID NO: 59537 - DNA, 12933 bp, Oryza sativa
atcatgcatgccatgcaccagcagatttgatccgaagttccgaacaaatttagccccacccgacacgaactgatcgaatgaatgattacacatcctacgttacgtaccgtgctagctcgtgatcagattactgtcgaccatgcgtggacacatatatatatatatatatatatatatatatatatatattcgtctaaaaatataaacacttttagcataataccaagtcaaatattcgtaactttgactattaatagcaaaaaaaaattaaaaagatcaatcatgtaaaattgatattactagatttatcattaaataaactatcataatatataactctttttatttaaaacattttacttttatatatatcgttggtcaaagtaacatctcgaagactatgtcgaagtctaaaaatacttactccctccgtttcacaatgtaagtcattctagtatttcccacatttatattaatgttaatgaatttagatagatatatatgtctagattcattaacatcaatataaatatagaaaatgctaaaatgacttatattgtgaatcggaggagatatattttaggacggagggagtactgtatacatgcatgcagctaataagctacaggactagctagctggctaacacaagtatacaaccactttgcattggtgtgcacggatcgactaattaattccttaatcagaaaagaacaaatcgttaataattaacgatggcctaatatcaagcaaaatgacagatgacacttagggtctttttggaggagtttctaacagcaggagattcttctagaagctattaccgctagaaactcagtccagaattttacttagattatgaaaaatagtagttgtagaattcagaaaataaattaaaagctcttctccagattgttaccagctgttttttaaatctttaaacttcctaaacatagccttagttgcctggcaggcaggcatgcatatatgtctggtagagatcgatcggatcggctaacgggattatgttcttgacgctgaaatgcgaccacccatatatacatacacacacaacacacatgcatgcatatgcaagaatgcatgccgcgcgtattgcttctttaaattctttctgctcacaccgttaatttggtagcgaattcgaatctcacgtggtgaatttcaaaaaaaaaaaaaggaacttcaaaaaaagagaatctcacgtggtgcccatgcatgcttctataagtttgtttttcgccaagcctaaaccattcacacatatatatgtgctcgtggctgtgctgtctgcctgtgtctatcttggaaatctttttatttgttccctgttgatggttggtgctcacacttgaaaaaattattgaaatgagaaattattatatatggcatatataatatatacaaactatgatatgaaccagagagtagcataatatatatgtgttggaccaaactcatcacttaacataatcacatcagctgaactgctttgcaatggctgtacactattttataacttagttatgacatgtactccctccgttccaaaataagtactccctccgtactcttaaagaaaatcgtttaggacagcgacacagtctccaaaacacaactttgacttcttgtttctataaaaatatttattgaaaagtgatatatgtatacttttatgaaagtatttttcaagacaaatctattcatataatttttacatttttaaactcaacaacttaaaagttattcatgatttatattcccaaggtttgacttaaacattgttctaaacgacttcttttataagtacggaggggtatagttttatattgttcttatccgacatttgaccgtttatcttatttactttttttataattagtatttttgttgttattagatgataaaatatgaataatactttatgtgtgattattatttttaatttcttcacaaatttttcaaataagacggacggtcaaacgatatgtatacccacggctgcactaattttaggacggaggtagtattaattagttaatcaagtcgtactagggaccacacattaattatgtgaccgttgatatcccatactctagttcaagttgtgtgtaagcaacaaacagagagaagctgaacactacaataactagctgcctgcatcaattattgggtcaagatattagacgactcgcactttgggtacggcgtggtcgtacagacaaatgtatttttgatgatctgatgttggatgctctggcaaagtggggcaacttacaaaaggaacaaaataatggcaggctacagtacttagatatatagagtacaaactagttatttaatatacaattcacatattatcgtctgtataatctttcaggagatatatatatatatataaatgcacatcttattctatgttttgccattaacaaatatcaactatagaaaaatatcatcatacaaacaaatttatctaagaaataccatcgccatcagttaaccctatccattttttctaaatacccaaagtgccctcacataacaaaccaaatcacaaacttgggccgatggacagtggccttgtggttgcagttggttccgtagccagcagcgtccttggccatctcaaggcagagggaacgaaggagctattgggctagagatcacattgccgacttcccgtgtagatgggcggcaacagagctcatcagaacctggtgaagcttcggaaggaggagaagggcccttcctaggatagcgactactctcctaggttatgcagtgacacaactacaaaagttgtggcatagattcgatagttgaaatcttgcagctgcgacatcgaggtctcacggtgatggtggatctagcaccatcagcggtggtatcgcagcagtgtaaatgaacaagacagcgaagtggagagagagaaggaaatgtcattgctactgtgccactgccatgttcaagcaggccaaggggcagaggacctgagtggcatcgctcatgctcgacggctgcaggcgggctccatcgatgtcatggtgagctttatccccaagcattgcactccagcacttcgccttgcagccaaagccatagcacgccggccccatcatctctaggccaccgttgttgtggatcggtcggcaacctcctctccgccacaccaaccatgtcatccctaggccattggcattgcctggtgaaagtgtatctagtctccgaagcgagttttggtgggctattgacaaaatggttaaggaaccaatgatttatcaagaagtgtgaagataattagtcctagggtgtttactcttacatggagtcaccctgtaaatagaatgcaaagcgtcgtgaggactcgaagtgttatttatttatttattttgtatcttttggtcttgagtttagaaaagtcgtactaccagaggataccaaatggtttcttgcatctatatcaaagttcccgaagttcaatccttctagatgagagatacagttgtgtcaacggattgtgtgggccagaagttcctagtggtttgggccggaacttccgagcccctatttttcagccaatgcctaagtgctaacaagttcttggcacttatggctagaactttggggcatatttcaagttcaattatgtgagtaacagctacattacataagggagtgggtatataatctcaccttcctctctagtgcaactttggccattccacttttgtttttctgtctcctagcttcttgtagggtttcttgagctctcaaggtgatttgagagtgcttgcatggatggtggtgaggatttatgtttctgagcgagctaggagaacttgagaacttggggatcatcatcggtcaactgctttgtgcttattgctcttggagactgacctcctagatgattaggaataatccgcgagcttcctcaaggtgtggattgcttcctcaaggtgtggattttctgtggcaagtttttgagggtggacctcatcttcaaaaggaaaagaggtaactttgaatgaatttcgaggtggttgctaggaagttatctttgtagagcaagcttcaccggtggttggaactcgttgttaaagctatgatcttggtggtcgcttaaaatcgagggaaacctaggtggttgcttggaggctaaatacttcttcctagttgtttgtcaagtgaggcaaggagttaattgagacctagctctctggagctgctcaatgagagtagatccctgtaatctgaatttcggaaaaaaaaatcattgtctccccatgtttttggtccatcttgtatgtgtgttgatttaaatgagctaaccgtggcctgcttctattcggtaactatcacaccatgaagtttccctttcctagccttaatgcatttaataaatcaccaaacgaaattgtttaagttaacctagaatgaatccctaattaaaaactctatctaataagtggaaatggcttggtgtgatttttcttgagtttcccttgccaaaatatattaactggttcttgccaataaccgaaaatattttttaatagttttgtataaacaaagaaaaccagatacatgccctaagttttataaacacatttagagacctctttaagattggaggaaatttgaaatatttgaaataaattatgctaaaatagttttttaaatttcctgcattcccaagaactgatggagccggcttccgggtaggtcggacgattgcccaggcggccaggctctaccgttgctgtcttcactactgacagcaatagatgccaataaaaattatttaaccgaaaatgcttgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacagtagcccctgagaccttcacagtcagaaagataatcttctctcgaactagattactccaaagccgagtgcttcaatcatcttcgccatgatctcccgagtactttttctaaatcagaagactgtggagggctgaaaaaataaagtcaggtgcatcgactagatgcaccgagtggtttcgataattgtagtcaaccaagcgacttaatattaatatgtagcatatgcggtgtgaatccctgaataatatgatccaagtgatataccgactgctttgtaaaatatgatgagtgtaacctaaagttggctacatcattgaaaattcacatagcaaaatagctataaggaagcttgtatgttgtgaataaagaaatttccaaagtattgggcatacgccatgcgcacactgctttaacagatgtgcttaagtccctagaagacacatggttccaccacacctggaaatatatggcatatgtggtataaaatccgagtaaataaactcataaaggatttaccaaccgcctgaaaaatgatcacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttgagtaactgcggtataaaaggattttaaggtattgggcacttgatcacgcgcactttggcctaagcaaaaagtgcctaagtccctaaaagaacgtgacaggccacacctaaaaatatgggctgcagacatattaggcctaggccaaaaaatatgccttcgacaccctttaaaggatgacgcatgtaacatgctcccgagtaataaatcttccgggtaatatagaccaagtgtagctcatatgaatagcttctgatctgaatgattatcccttatgggatactctaaaataaatataataattgaatcccgactggcgcaagtattcggttgatagcccttacggggaataataattggtccagtctttgagcatagaaaatagactcatgactttgaatccatgtgggatgtatccggaacaagtccaaattggagatataatcctcacgcttgagttgatgagcccctgagcatatagcttgtccttctgtcatagtcaaaattgtatattggcaatagctgacgcagtcggcatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagccagcaatgaagatgaaagcgcccagcgataaagttgtgtagccatggcagcgaaataatcagtcggtgacagacgatgcagttggtgaagaagatgaagatgcccattagtggcaacataataagccatccatgaaggcgaggataccggtcggtggtgacgaaagcaagccgacggtgaagatgtagacacgcatcaaaggcgatgacgaaatccaccaatcatgaagatgaagaaaatagtcggcggcgacaaacgcaaccgacatgatgaagaagacgatgtcggtgatccagccaatagcagtgtagcaaccaatgataatgacaaagacgctcatcagcatttgcatagtaggtcaaccgtgaaggtgaaataataagtcggcgaaaacataatcatccattagcaacagcggagatgtcaggggcgatgaagcaaaggtgctggtgatgatgtcagtgacaataatccatcaaattaatgttatagctgttgtagatgcttcacttggaggagagttgatgttgttgtccaactcgttcaaaccgaaatatttgaagtagaatgtctgttccgaagcaaagatgaagataatgactcctggagttgactcattggctgatgaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatataagtagaaatcctgaatattggagagcctcttgttgtagtaaaataacatggcatcgcatgccgagatgtcgaggctcacaaagacgtcgtggttggtgaagtagtaaaacttgcgaagtagcagcaatagagtttgccagtgccgaagataataaagatgaagttgctccaccatgatgacaaagttgcatcgccgtgatgaagtgaacacgagtcggcggcaacagaagcaaactggtagcgaagacgcgcagttgtgaagataaaagcactagtcggcggcggcataaccagtcggcaacggaagacgatgatgtccatcagtagtggtaactgtataaaccagacgtagaggtgagagcactagtcagcagcagacgagacgaccggcggtgaagaagataaggccaatcaacactggcagaatcatgcagccatggaagtgaagaaaccagtcggcagccatggcaaacgtaggcagcttgtgttgaagatactgatgcctattagtagtgacagcgatgtagccagccgtgaagaaggtagcatcagttggcgttataacaggccagccgtgcaggcggtgacaccagtcagctgcggatgcggcggccggtcggtgaagacgtagacgcccaacaacggcagcataataagtctgccgtgcaggcggaagcaccaatcggtagcggcgaaggcaagccggtcggtgaagacgcgccccagccgtgcaggcggaaacaccagtcggcggcggcgaaggcgagccggtcggtgaagacgtaggcgcccaacagcggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcggcaaaggcgagccggtcggtgaagacgtaggcgcccaacagcggcggcataataggccagccgtgcaggcgtggacaccagtcggcggcgacgaaggcgagccggtcggtgaagacgtaggcgcccaacagcggcggcataataggccagccgtgcaggcgtggacaccagtcggcggcgaagtaggcgagccggtcggtgaagacgtaggcgcccaacaacggcggcataataggccagccgtgcaggcgaggacaccagtcggcggcggcaaaggcgagccggtcggtgaagacgtaggcgcccaacagcggcggcataataggccaaccgtgcaggcgagaacaccagtcggcggcggacgaggcggccggtggtgatgttctgactgatccattcctagagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactcattacgtttaaacgctctgcccaactagtcatagccaccaagcactgggagtcggcctaagcacttcccaaacatgcatatgagtgacatgagttcttcattaatggaacaaagtttcacggatcggagtttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagatgaatattataaaaaatatgatataacatctgtagcccccgactcactactcaatggaagaccaattggtgtagtgaggcagaggaaaaggaaaaatatcatataaagaataaaataaatgacgacttagctttgtaatattccccttggtgatggcagaagtagccaatgtgggaacgaagcagtccatcaatggtgacaaaaacaccagtcggcgccagtggaaccaagccagtggtgtagatgatgaagcccattaacagcggcgaagtccgtcaaccgtataggcaaaaacaccagtcggcagcggcgaaggccagccggtcggcgaagacgtggacgcccaacaacggcggcatgataggccagccgtgcaggcgaggacaccagtcggcggcgacgaaggcaagccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcgacggcagcgaaggtgagccaacggtgaggatgtagacgcccaacagcggcggcataataggccagccgtgtaggcggaggcaccactcggcggcgacggaggcaggccggcggtgaagtcgtagacacccaacagcggcggcataataggccagccgtgtaggcggaggcaccactcggcggcgacggaggcgggccggcggtgaagtcatagacgcccaacagcggcggcataataggccagccgtgtaggcggaggcaccactcggcggcgacggaggcaggccggcggtgaagtcgtagacgcccaacagcggcggcataataggccagccgtgtaggcggaaacaccagtcggcggcgacggaggcaggccggcggtgaagtcgtagacgcccaacagcggcggcataataggccagccgtgtaggcggaaacaccagtcgacggcagcgaaggtgagccaacggtgaggatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcggggacaccagtcggcggcgacggaggcaggccggcggtgtagatgacgatgcccatcaacggtggtgtgaccaaccgaccgtataggcgaggacaccagtcggcggcgacggaggcaggccggcggtgtagatgacgatgcccatcaacggtggtgtgaccaaccgaccgtataggcgaggacaccagtcggcggcgacggaggcaggccggtggtgaagtcgtagacgcccaacggcggcggcataataggccagccgtgcaggcggaaacaccagtcggcggcggcgaaggccagccggtcggtgaagacatggacgcccatgaacggtggtgtgaccgaccaaccgtataggcgatgacaccggtcggcggcgacggaagcaggccggcggtgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgcttgttgataggaaactcgacgcaacccctacctggcgcgccaactgtcgaaacatgaattcggcaataataaaacggggtagcgcacgagacctaaaagtggatggatgtggagacaaaggatttagacaggttcaggccctctcgatgagaggtaataccctactcctgtttggggatttgaatccgccgggtgtagtatagatctgacgatcaggttgtctcatgccccctagagggcctcctgcccaccttatatagggtggggggcaggattacaagatagaaaccttaaccaacacggtatcggcttcctaaatctactttacaatattatcaaatcaggactttaggccgctccataatataaaaggaaacgtaatacccaagtcatgatctgttacatattccatacatatatgttatcccctattactagtcggataaccatgccgtgtgggtatggggtacccataatctccacaatgctattatcacctctactcaacggcggtgctacctctgctactgccaagaagcccttaattaacgttgctgcgaaaacccatgattctaaaaattgtagggtcaacactgtagcgagctgctaagcctacgatgaagcaagtatatgcatggcatgtgcttttgttcagtggacactgatgatcgacctgcgttttgttgagatctggatatactgcaggaatggaatattttgtggaagcatccgtggatctatctgcgctgctggatcgtcagatcagaatttggcgaaatgtgtatttgcaaaaacattcccgaaaccactaatccaatgatgtatgtaacatactgatgaatatatatgtgtccagtcgagactatgcagctcggcaaaagacaccatttgtcagccttggagcacattaattggacggttcgacggttcgaaagggcgcgacacatgcagaaagccctactgatcagtaacagtatggatcattcatccgtggatcaagatctaggaacaatggaacatgcacatcgaaaatgaatgattgaatgattctctgatcacggagaaaacagagaaaaagaaaaatagttggcttataaactaaatttgcaagagagtaggaaaaacagttaactgaagaagtagcatttttctctccttaattgagaaacacgcaggggtcttccggctagcttaattaataagatggtgggctagctagcctggtttcgaagcctcatccattttatttatttgatattacatccttctctaatattcgtgtttttcccccttaattggactggctttctcgatgtaacaaggattagctatttgtcaatcacctgcctagctgtatatataggagacgacccaacacacactgatcgccttgctctgcccaactttggcgatggatgatgcatcgcaaagtatgcaaagaagtataaagtctattttgactaatttttagggtggtgatatcttagctaatataatttagcaagataatttagccgatacagcataaaccctaaaacgaatctcagctgatacaaaagtaaattaagatgctaaactagattaactaagatatatgataaatatgtatgcaagtataccaacca

SEQ ID NO: 59538 - DNA, 3676 bp, Oryza sativa
  unsure (1)..(3676): unsure at all n locations
tatatgattggtactccctccatccaaagaaaaaaaaagccaaccatgtgtcctcttctatttactacgaatctagacaaagggctgtctagattcattgtattagtagggatctcctcctaggttggttttttttgaacggagggagtaactctctatttatatctcttccttattaacttttgtttcttttcttatctacttgtatgtcttaatttggccggtatttttttcaaagatttaagtacataatcagtcctcttgacctagttactatgtactagaaagattatagtgtaagatttaaaattaatagtataagttttcaaaattataccatacatatttgaaataacaatatatatataaggtacaaattatacaatgtgaacacatgttgcaaaattttgatcccgacccttttgtgaaacatataatttggcatgtgaatatatatgtagaaaaacaattacgatgcacaatgagcggatgagctggtcggggcacgcgtcggggtcctgcctctgcaccgagaggagcacgccgatcatggtccgccggctcgccgccggctgcgcacggtcgccgccctgctcctgctccatctccttcctctcgtcgttgatcagcccctgcaggaacctcgttcggctcttgcgcagccggcacaggcggcggcccaccccttccacgttcacccaccggagcgccgccggcaggaagtcccacaccgtcgacgcgccggtcagcgccatcgtctccttcaccatcttcctgaaccacctcgcctccttgctcaccttgccgtcgtcgtcgctacacaaggcttacaaataagtgacaggtagaataagatagccatggtgaccatggtgatcatggcgatcgccgatcgatctttagcttactcgccgtagtacgtcttgtcgcagatcatggccatcatggtgttcatgagcagctcgaacagccgcgacttgagcttcactcgtacgcgcgccggcccggcgacgccatggcggaccgccgcgcggtgaaggtggcgcgccatggcgcgcgccttccggacatggacgtcggcgaagtgctgcacccgtcgcgcggacaggatctcggtgacggcgacgcggcggacgtggcgccagtagggcccgtagctggcggtgcccatggtggaccagtcgtacgacaggatccttgccgacggcagccgcgggcggtcagcgaacgcgacgtcgtgcgcgccgaggcactcctccgcggcgggcgccgaggacacgacggcgacgcggcggggcccgaggcggaggccgaacacggcgcccccgtggcgcgcgcgaggcgcgccagggtgcggtggagcggctttcttgagaggtgcaggtggccgacgagcgggaggcccgcgggctccggcggcggcggcggcacgttcccggcgcgacgctgcgtcccgcttcgtcgtactcgggcggtctccataagcgcgatcagcagaaggaggaagagggcaatgaggagggcgtccatggcggcgaggtgaactcgacgagcatgtcagtgacagtgtacatatatatgcttccgccactggtgtatatcgctttgctgaaatgcaggcttctggaaatctcaagtataatcaagtggtactagcaagttggatcaccaaactactaattcgtcaaacataacacgggacgcccaattgcccaattgcaattgtgcaagtgccaaagcgtgtgtcttggttttctcgaaaatgctatacgttcaaccgacgcgtacgaccagcgtacggctacgtcggccaagcgtacggctacgtcattggccgtctgccgtccgtaacttctgcaacgatcgctaattcaattgggtttacaccgtgtatttcgccgttgagtcgtacgctggtcgtacacgtccgtcggatgtatagcagagttgttgttttcttcgctaatcaaaaggtgtcgtgcacaatgtgtgccataacaaattttttttgttttattacttagttaattacagggcagcttgcattgtgattcagtactctctccaatcacaaatgcaacacgttttttgcatgataaaatctttgaaactttcatttattattcctactccctccatttcatattattaattgtttggcttttttcctagttaagtttgacaaagtttatagaacaatttagcaatatttaaaataccgagctagtttcaaaaaatttatcattgaatatattttgataatatatttgttttgtgttgaaaatacttatatatttttctatagacttggttaaacttgactaggaaaaaagtcaaatgacttataatatgaaacaaagagagtacatgtttttgaaagtttgttctctgttcttatgttcttatgagtagtccaccacaagagtgttcttatttatggcttttgagacgaagagatggacttactttcattcttgtttgtaacaaaaacaatcctatcatttgtgaagcaataccttatcatgccagttggatcaacgatcacaacacatttcgatattgcgctataactaacaaagcctaagaaagaagatgcatcactgaagcacgaggttgatagaaggcctccaaaggcaccttcttgggcatggtaaggccagatccttcagtcatgtccaccagctcctctccaactctttcccactcaaagcactgaatcattgtcccaaggccaaggcctaccatttgcatgcccaagttctctgcagggcatttgcgtctccccatgccaaatgggattgccatctttccttcacttcgcccatcctcaaatctgtagaaacataaatgtacgtaattacactttatataacatggacattcatgcaatagtataaaatttttggaagaatccatatgtagtacctttctgggatgaagcttgttggttcatcccatatatgaggatccctgtgaatatcaaatgtgttcacaagaagcattgtcccccgtggaatatggaaaccagcaacagtgcaatcagaggatgattcatgagggacaagaagtggcgccggtgggtataggcgaagcgtctccatgatgatgcatcgaaggtattgtagcttcgggaggtcatctgcctctagtaatcgtactggctgcccgatgaatgcatcgatttcatcacgagcttttctcatcacatcgggattgtttagtagcagagacattgcccactcaattgtatcggttgaggtacccgttccggcttcaagcgaactcttgagaaaataaaaaaaggggaaagtataattatatgtaaacaaaacatggattgtgggttcacataaatctcattcctaagtagggttcacaatttccccgcaaaaaaaaagtagggttcacaattttggttcaaaatttgtgaattttagtttgtgtctacacgtgggttgtgggtcccaatatgatgttcttcgggccaaagaaagtattgtcaaatatagcaaaaaagacctattcaaagtcaggaaaaaagatgtgttcaaaattcaaaatgttttctttaaaatttctgagagttttcctaaataacaataattgtttgtgtgatgcatggggatcctctagagtcgncgtgcaggaatgagggcataagctactcaatggcgcg

SEQ ID NO: 59539 - DNA, 12430 bp, Oryza sativa
aaacgctctgctgcttgcctgcttctgttgcgcaacagcagttgttgaccagccgccgacgccgacgccgacgaggtcgcgcaggcgccagcgccgcgatgatgaggacgacgactccgccagcggaggcactcttgggaacctgtcgtggatgggcgagccatgggaggaagatggcgccaggggcaatttcgccatttcaaaaaatttctcaccgcttttgacccataaattataaaatattgtctccggtgtcctatagctaattacacaatttttgtagtgtccatcagccgtgtcacgtttttacggtgtctctcagccaattacacattttttgagtgtcctgtagcaatttttttttttgcggggaatcctgtagcaaattttgccttcaaattaatctagttttgtactgacgtgggaaattgtgtctatattctgatagaactcggtaagagtcaggttgtgacttgatgagaccatatcttggttccccttaaaccctggatcggcttgttcttttttgtcctgaatcgaatagtttcttgctacggtttctgtcataaatttaccaatatgagcaaaccatgtagcgctctcaactatggttgcctcaaaatggatcctgtatgcatatcactacttgccagtaggtttgattttagtgcataggtgtgtatggtagtaacagattaatgtggtagttcaacttcttccctgctattgctagattgatgggctacttttttgttgccattcctgactgctcaatgtggttcagttttggactggatctacgtagagggaattctctcctatcttttcatatattacattgtttcataagagtcctataatttcatatcaagattttcccatacctgtacacgtgctagtgcttttatctggactcgccttttcctcctgagcatggattctaggaaattgtatgttactttgcttctgtaaccatgcttgcttattttaccaaattacattttagtttattgcttaaggttgtcatgattgataaggtcgattttggaaactaaaatacttggaagtacttttctgagtaggacgataaatatactaagtagattctgcttaccttcttctgccatttcagggtcccttgtagagcaggcacatgcacaacgcccattcaagttacatcttcgcagttggtctcaaatgagatattcccaccatctgttgtgaaagcccttctcttccctggggctatagcaagcaaccttactaagagcatgacatttcctaggtggaatgacctgtttgatatttacaatttgacagaagccaagaccgcttcagcagtaattgatctccagcgtctagaggtactctttttttttttttaataactggccaactttcttaagcagataattgtgacaattgttacactttactctctttctcacttctcaaccagattcttgctggaagctacttctgtgctgctggagcacttgttggtgtcataaaccctgggaggatgaccttgtttggtacccttttggttatctggggtctagtgaaagaagcgctctttgggaaaccggtgaacagtgatccaacacaatcagttcatgtttatccgaccattttaattgcactgatttgtgcattcttgtcaataacttacaatgtaaagaagacagtaagaaatagtcagtctgtttcaatcactaagcctctgcaaagttctgccaagtcgaaactgaagtagacacttcattgtctatttgccccttcatccttgtagttcatttccacaaatttattgttgaagactggcccaaaggataacactactgtggttcttgtgtaccactttgaatactgtaaccttcagttttcacctttgtatcaaagacttatatctataacttttattgcaagcatattcactttaatttccctcgtatttatttatgtatatgctgtttacactgttaagactactggcatcatgtcacccttcctcttgaaggatgatattttatctttttgtaaattccatctattacttgctataacctatagctctgaagttctcagatacatgggaagttttcccacagtataacttgttcaatattcattttctttgtcagtacaatcttgctttaatcctctgataaatcaagaatttatgattaccattttagtttaactatttaagtttcccagtaactttgttttcacctatattctcacactggcccaatggacgatgtgtccttctattttattctgcatttggaattctacacaagaagtactttctgaactgttagctgatgaatcgaacaaaatggagttgaagaggacaggacacatgtatctgtcagaatttgctctatcatgaagtgatacatcattagcggcagtactgctgtcctagcatttgtatacttgtattgtgtaaagaagggcaagaatcaaggctgcatgtgcaagtggctcgtctcctatctcttgctctctgttgatgtctggttgatgatgagatcagaggaaaggagacaggctgagccccacccaaaccccatgtgagcattgtccttttaacctgtctgtatttttgtacactctgctgcttgcccttctggtgaaaccagacctgaactcttttatctacccgactgcagcctgaagctgattaacaagtctgaagaagcaaacaatgccacggagctactggatttgtcatgtagaaggggctgaagagataagctgattcggtcgaaatgttaggtggtttctcaagtcagctatcatagtcttctagaatgctcttcttgtcagatttctctcttggcaagagataaaaacaggcataggctcctcttcaataattgagatcccttctctctatgttacttcctcctgctgtcataatgattgctatggttagcctgtcaaggttatacatgagcctatttggttcttgtttttactagtataagtggttgcttaagatctaaaactatccttccacctagactacattagcctctgctagcctaatttgtcaagaagccctgcttttgcagttcacattcttcccaagccttcctacagactgctgttcagacttcagttccatggttcagatgtctatacagaggtcagttgttcttctgttacttcttgaaattaattttagcatttactggtgtttagtgtattcagacttcgagagctatggcaaaatgactcaaaaatgtttgcagggctgcaaccatttcacctccttgttccttatccttgccatttgattgtgtgagtggtacaagtagaagatttgcctcatgtagatcccagtattcatgctttgcctatagtgaaagactatctccaaatgttttgaagaccaacagtgtcgtcgatccctctgaaccgaagattttggatgcgagttcttctgcttcaagaactggacaatatagtgcaactactcatctatcaggtacaattggagtaatgggaatatctgcctcttcctctctcagattcttacagaagcttgtgcattggagtactcgtgatggagaagaggcacctccctttctcgtgtgtaatgatccacttcttaagaaggagctcatgtcatctcaaaattcacagcgcccttccgactgtaacactgctcttgggaagttaaggctgaggaggctcctcttggagaaatctggagtatgctgcattgccatgccatgtaataccttacatgcctaccatgatgaaatttcacaaggatgctctgtaccttccctccatattggtgattgtgttgtaaaggaactcaaatcggcaaacttaaaacctgttgaatatggaagtaatgtttgtgtcggaattctatgtacagacaatacattgaatgcaaagtgttatctaaataagctggagagccaggtaagacatcttttatttggtcatcaatcatcgtttttgcaacaacatatttatttctttttcttaaacaaactactatatatttaatttaaatttaatgtttacaaataagtagctttattgcaaatgaaatagtaagatgtagacaaaatgcttgtttcctaccttgctcagtttgcaaaattttagcaatcaatatttcaggccttcatttggaaacatctatatgacaaccaaagcacttcatatatgttccacctgttaggcaactcatgtcctatatcagtaacgaatgatcagattttcttttcccagtttgctttgcactggtatactttcttttacatgacaggccagtttacaaaaagattgacaaccacagatcttatgccgattgtagtctgcccattcccgatttgccaatcccatgataacttgtccatttccaatttgtcatattattgatatccctttagacattctagttgacattttccttcaatactgtacacccatcccatccaattggcagcatatggttatgttgttttgttcttaaattccattttcacagggttttgaggtgctgcttccagataaagcttcattggagcacacggtattaccagccatcggcgcttttaggagaggggacatggaaggtgcaagaaatctgttgcgaatatcactacaggttatgttcgtgagggctgtcaatacaataatccttgcatctgatgactttgttggtatattacctgatgatgacccactgctcaagaaatgcatagacccaatggatgctttggttagagagaccatcatgtgtgcaagaacagatagcctgagaccatgatatccttcaaagtgatgctggttccttgtacagtttgcaagtagtagatgttttcattttttatctccagcgagcacacatgtaaattttaggatcagagaagaattcactattcatcacaagtcaatatcattaatagtacagtgtattatgcagtgtgatctgggtatgcattatgccttgctgctaagtcaagaaagatgccgagtccatctgcgagttcagattttgtcagatgtgtttgtggcctggccacaccagggaaaacttcaaacaagaatctagaaatcaaatagatgatgtggatgtttctgtggatcagcctgtagatagaacaaatgaagacatcgtcgaatcttaactgcgcagaaggagcacctttctttttcagataagtagcaactgccttgacatctgagatcacagttattcagtaacatctccctcttgtcaaaaatatatccccatcagaaagaatgcagcctcatgctcttccaaacacttctacaaggcgtgttcagacttcagagcctgtatggtaacacagttatcagaaagttatcagtgtgttttttttttcagaagttgtaacagagatgatgcttccattttgacttgggaaagccaatctgagtgggcctgttcactggtattccaagagaatctggtgattggtgtggaggaggagggggaggggcttgaatgttctgtgcacaggtgggattgcaaaaggtgtgcacaatgagtgagcaatgattcaggctgtctgcaggggccttcaccaaacaagtggctaccctttctcccatgcaggaaccagggacaaaaagaaaggaagcacaggggacaatgcaacaccaattgggccttcctctctctgttcttcagggtaagcaaaggcaccaatgcttaacccaagattgatcatatcagaccctgtgctggagaaataaacaactccagcatcatgctattgtgctgtgatatatttgtatacatattcagatatggctttgttttttaagttcttcggtcgtcgcggtcgggatatttattccattatcataagaaataataacaatactacatacatattcagatgttctgatgcttcatgaccgatcacacacttttcttttctcctcttcacaaaaggggaagaggagatcaggagaaagaatagtgctatcttccattcagtctgaaatgatttgaggaagcatctgaagatagtgtaatgctagagctacagaaagcctttgcaatgtgtttgtgtgtgtgtgtggaatgtggattgcctgtgtgcggctgctctgctgccattttgagtgttgaggttttgttgcttgatgaattgatgatgatgatgatgatgcccaaagtggtaataatgctctgcatctcgatcaccttgcttttacaagtaaagcagcgccatgattgttccctggaatcttatccaactatacctccacacacacacaattcttcttgttcatctctccctctatagatttgtgaattccaattgaaagcaaagctatgcttctagtatcaatcagttgagagagagagagagagagagagagagagagagatgaacaagaggtggtcacatcgatcgagcagcaatctgattgagaaaacattcgcttgtggctgcgataattcgctgtcgcctctttgttccctgtacatgataaatataataaatatataataatggcgaagcactaattcggctttgcatatgcgatgaacaattagcaggaaagggagaaggcatctgtttatggatagatttctgccaaatttgtacgccaccgggattgcagttacagtcaaacgattaggaataatccatgtcatgctccatccacatactacatttgttcatcaagcattctaattcttctttctcgcaaagtagacttagagttaagtgtaactaagagagtgaaagacggggcaaatcacaggccaactcgcatttttgctttcttaattatctgccttttattgggaaaaaaaagaggaagactgatcagtcatcagccacaattttgtgccgtttttgtgtttttttagtaccgttaccgctcttacaaatgaaaaaaaaccctcaggttatcgagggttattctaaaaaaaaatagaaaaaagaaaaccctgaagggcatgaccggtggccgatcaatcttgtccgtcgatcttcgatctcgtaaattttatttccctttcatttcttctcagtgcaaggcatatatcatatatgtcagatcaatcaactgaaaagagtagagaaagaagagaagagaaaactgaatcagatgagatcatatatttagcagcagtttgtcactgtcaaattgcaaatgtgccatcatgtgggtagcttaccgtagtatctggggaaattgcaccggaagcactcggttctgttagcgtagttctgcacgttgcattccattctgcaaaatcaccaaaacatgtaaatatgcatcagcactaacattccatatatatatatatatatatacttcttcagaacagatgataacattcacattcagaactattatcaatgctggtcgatcagttttttttaaacaaagcttgaggtgtcgtaattaaacatcttgatcagcagtggtagtaactaaaacaaggaatgcagaactgacacgtcaagaggtaatattccagttggcatgcagctccggattctgttgggcatagaatctttggactagacacatgcatgctttagtttagcgtttcctttttaaacacatataactaatactattaatgttcaaaaaaacaactaatactattttcacagagacatgctcgatcgtggcaaaagaacaatttgcacacttatgcatgcatctccgtgcaatctaattaaattaatcagctaatgtgattagccagaggcagagcatgctgcattcccaagcagccacctccgcctcttaaaataaaaaagaaatataagacgtattttgtttcgttaggacaagacttagacttgaacgagctaggaacaactaatgaagtatgaaattacctggggcagatccagtcgccgttcttccagccggcctgggaggcgacggagaagccccagccctgggcgacggcggcggcggagtcgttcttggcggcgccgcacttgaagcagctgccgcggctggcgtagttgttgacggcgcagcagcggcagcaccagtcgccgggcttcacctcccacccgccgcccatggcggcgtagtccgtccgctccaccccgagcttcgcctccccgcaccgctggcacgcctccctcttgcagaagttcacgtactggcacgacctgcagctccagtcccccggcttcctcatcgccatcgccgccgccttcgtctccatctctatctacctatctatctatctatctatctatcgagcaaatagaatgtacaagaagaagaagaagaagaagaagaagaagaagaagaagatgatggtcgttatcgagcaaagagcagagcagagagagctgagctagctggagcagactggaatgctgctcagcagctagctagcaagcttgcttgcttgagcttgagctctgatgaatggatggatggatggaggcttgggtttggaaggggaggtggcgcgggcttttatatagggtttggtgatgcactggagcttaggtgatgagctaggccagttgagttggggcccaagtaaagccgcgcaccgggggaagaagcatccattcgtccatctctgctagctgcatgttatgttgttgttggtagtaatattgtgcgtgcatgcatgcatgtcttgtctagctgcctgctggctataggctacatatgctcccttttgggctgagctagctagctctcccataactggggaatctccaggattgatgggacttgtgaattctctgccaattaacaagtgtgaataaatgaattattgaaaatgaataggagcctacaaggtcaggcctttgcctttccagctttgattatctttggttatgtgcatgcatgcatggctgtgtttatatattcatgtgagggatagaatttgtggttgttgacatggagtaaatttagtaaaacggcgcaaactttcacaaaactataaataaattaatcaagttatacttcctctgtttcaaaatgtaagatgcggttgttttggagtcaaacttaaaaaaactgacttacagcaaaaactaaaacatcttaaattttagaaaaggggatagcaatgttgaaaactatatatttagccataaatttagcaaaactcttgagatccatggaaataatggtggataaaatctctaattaagaccttagtatttgatcataaatgttcgctttaggtatatagtttggagtacacatttcactttgaactaaaaatatattgacaaatgttacacacaactaatggatcgatcaagtcgtgcccatgtttttacttaacaccaggttttctactttattgattggaccagagttcatgaataaaccccaccacgatggcttcagcgcaagtacgggcaaggtgtaggtgacttgtagcattgctccacccctgctaggtcatgagatcaatcaatcaatgttctaacctattccatcctctcttttgctctagctaccaccatgaaaaaaacgagtaggaattatgcgccattaatgatggctagagcaggaagttgggatgggggaggggttgggaaaaatagacatgcatggacacatgaatgaatagtctaggcatcttgcccatcagctatggtgatggtgctttgtctgaatttaggaactgaataatggttccaattcctttcaaaagtggagggttgcttgatcaaatactatctaagtacttcctccgcgtcctaaaatatagctacttgtagtgtttaaattttattttaaaatacagctacttctagagtaagaagagatatttgtagtgatgaaatgtcaaaaatacccttcttcttcaccataccgaccaatcaggacaattaatgaaggaaaatttagtctttttacctctttttttagttatctctatgaaaaactctagaaagtaaggtagatagtatgagatgattcttctaagctatatgtttaatgttatgatttatttatagaataaactaaattaatatgtgcttatatatccaacagtaataaatatttgtattggccaatactcatcccattcaaatcaacattgagatttaacttgcctttccacatctattatattggcgagtgatgcacaccatatataaaagaagtcacctcagcaatacgtgtcctatttttccttggtacattcaattttcctgacaacagtcctttaactctcgtaaccggggacatttgaccatgaaaagcggaaacgctgaattgcaaggtaaaaaagtacatgaaaaaaattttttttgcgagaaaaaagaaaaaaatgttttatggttatccgacacaggaaattacaagtctctaaaacctaagcagtgaattaactttcttgcgggcgattgtcaggaaatctggtaggaatcacagtacacttcgttgttggttaacagttgacaaagtaaaattcccccttgcaattgcagattatcctaatgattcatgcatgaggatttaccatatatatctagcaaaatgtttcatgatagagtgaactatatattaccatattttgcttcctcggtagatagaattgagagaagactctctgctacctcagtttttctatcttatggaaataaacttactatggttaattcagttttctattcctaccaacctactatatgtgtactttgaagttgcctaaaacaataattgacaatattgatcgaggaaggagacaccgtctttagagaggttatgatgtcaattccaataagaagtcattggctgtttgggacaaggtttgcaaacctaagacaaagggggttcttggggttatcaatcttacaatccagaacctccttctaaagtatctagacaagttctatgatagcaagaatttgccccgggtcaatcttatttgatcctcttattatagaaacggagtgcctcacttatccaccctcaaggggtcttttcggtggaaggatgtttgcaatttgatagatttcattggaggcattgccagatgtttaataggagatggagtttcatgctctttttggaatgatggacctcctctttctatccatatgccaagactgtcttcttttgttttgaatgcaaagatcccagtcacaattttctttcaatttagttggaagataattttcacttgcccctatctcaagaagcttatcttaacttgtagtctttgaaagttttgcttaaagaggtaagcttgtcacaggaaaatgatacatgggcatatatttggggtaatttgaagtacaggtcacagaagttttacattcttaattttagagttttgcaaccacctcagcatttcctttggttacggaagagtaagacaggtcaaagtgtttggttggttactactcatggaaagattaaatataaagtatatgctggatcataaacattgtgctcctccaaactgtgacctccaatgcgtgttttgttcaactcaatctttggaaatcttaatcatcttttttttttccaatgccctttctcagtgagattttggaatatcttagatattgtttgggacacctctttgacactagatagcatggtggtggaagccagagatagataccatggccattactttatggaaaaattcttatttgagacatgaaatatttggaagcaaaggaatgggtttatttttgaaaatactcatccttgtttgtcttcttggagataactccctaaggctgatctcctccttttgttgtttaggttgaatgagagagataagaatgtagttttgagttgaattagattgttgtaatttttttcttttttcctgtacttgttttctttctttaataaaaatctatttaacaacggggcctcctatgctgtaatttctttaaaaaaaactatatattgccatgaaggtctcactactagaaaaatcatttttcccaacgtgggagtcttattttcgcaggcagacatgacccttagagccaaatgaccgcctacaaaaatataaatcgagatgaaatttgatgtccgcctgcgaaaatattttcacaggcggaccacttaagcggcgcctgcgaatgattttcgcaggcgccgcatcattttcgtaggcgccacttaagtggtccgcctacgaaaaaaaacttgaatataaatagactcggcataggaggagattttttctaagtctccacacctcaccactcacggccggcaagcttatccattcaacccctcagtccctcagctctctcatcccctccccctcacctctcctcttctccccacctcaacggccggcctctcccctcccctgacctttccttctctcccggcggcggcggcgggcggtggcggcggagggcagtggcggcgcgcttccggccccttccttccagatctggcccgaaggggg

SEQ ID NO: 59540 - DNA, 13667 bp, Oryza sativa
acacaccggcgctgttgaaccgtgggattgacaggaaccaccgctcgttcctgtcagcagtcgagggtgcacagctcggcaccttccgtccacgcacgtcgcgcgagtggttgcgtgtcgacccccgtcacgttccttggtacgcgtatgttcacatttcaactcaactttgctttgtgttgtacttatgtttgaagtttgctctatacaggttgcgtgcggcaggccttctaccactttgtaggcttattgaggcggcggcggacgaccgtgacccagcgaagcggtgggatgcagaccggtcactccttgccgctctggtagaccgctggagacctgagacgcacacgttccaccttccctgtggggagatggctccgacactgcaggacgtgtcgtacctgctcgggctaccgctggcgggagcaccagttggtcccgtggacggtgtttttgggtggaaggaggatatcactgcgcgcttcgagcaggtgatgcgccttccacacctagaaccggccaacacccttcctccgtactctacagtcgggcctagcaaggcttagttgctccagttcactgtaagtaaataagttgttattatcgtacatgcttatttgcgatcaacagagtgttttgtactaacatttcattcttaattgtaggcggaccttttacaccctgacgctgatgattactcggtccgacgctcccttgaggcgtacctgttgtggttgttcgagtgggtgatgttcactagcacccacgggcacgctgtggacttccggctggtccactacgtacggtccatcgcggatgctcagccacaggacgtgccgcagtggagctggggttctgccgtgctagcagccacgtaccgtgccctctgtgaggcgtgcacgaagactgacgcgggagcgatcatcgctggctgccctatgttgcttcagctttaggcagccgagaggtttgccataggtcgaccagtggtggacagcgcaccctatggggttggtcgcagtgcgcagtggccagaggacggtcccacgatggggacttactggtgtcgacgtggggttagtgcaacttcgctgcgttataagtttatcagtcgtcttcttttttttcttcacataacatgtctaattccgatcatgtttattgcagcgtcgttacgctcacgtccaggtgagacgaggttacccggacttagtgttcgagtttgaccgtctccaaccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcgtgtgatgagacagttcggacttaggcaggtgtttccgggcaacgtgcagccgaccgtcctccctgccgaccactcatgagttcggattgttcatttctaaatttttttgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactaccgtgactaccttcgctggtaccttcctcgcactcgtgcgcgtgtgaccttcactccagacgccccagagccgcatgttgccgctgtcacggacgcgtatcccacgcaccgtgaccgagactacttcgtgggggtacgtcgaatttgtattagttcttacaattatttcatttatcttgcataatataggacaactactgaattttttatttccatcttgcataggctgatgccgcacgggatatcagtgccgatatcaccgcagtccaagtgaggttgaacagaggtttgcacttgactgacgttgagcagagggtgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctgtttcgcacggtactgctcagcccagaggtttcttaagttttgtttctgtttttgtacgaaaacatcaccccgtcgtaacttgatgttccatcctcgcaggacctcgtttgccttcgagcgcccctagcttcggagcagtgcgacctacagcaccggtttcgcacggtacagttcagcctagagattagttcatttttgtttcagcttttgcacgaatatgtcaccatgttttaactgcacgtttcctcatcgcaggacctcgtctgccttcgagcgcgttcgcaggcacgaccggcgcttccgcgagctccgcaggggcgttcgccacctcttcgggcgcgttcgccagctcttcctctcacggagcgcccatccctcgcccacacggtactttactttttattaatactattaaatacctgtatgaaactgatggtccttgtccagcaggatttgcagccgggatcttcggtactggggcctcttcgtctcacgccggtaggactggtcctactagccagttctacgacgacgacttgcacggtgcacaccaccacgacgtactaggctcctctcagcttggaggagctccagaggcgcacactcaggagcagccagaggtcacacctgtacaggcaggacgggttggccgtgccgtacccccggaccgactcacgtactcccaggggcacattagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgcttcacggtagtgtcagatccagtagcgcgcacaggccacaacagcacacatgaaaagcggcagctcgagttgtcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactagcacacaacacacgaatagtacttgtgtttgatttcgattgaagcctattcattggtaatacgtaatctagatttgagattatgtagaacattcttcactacaattttacattttggcagcaaaccaaatatgatcaaatgcaattttaccttaccaaatatttggtagtgccaaaacttgcttatattttggcactaacaaaatatttgtacggtaacattccaaataggccctaaaaaataataaaattgtattttaccagtcttggagattttaatcttgtatagttttcaatataaaaagatttgataactattgatatttatacaaaaatataaagcacagtataaaatcgccctcccccagggcggcaagggggccgcctgcaaaattccaggccccccgccgcccatttgcaggcggccccccgcacagtacaaaatcgccgtagcggagggcggcaagggggccgcctgcaaatttcgttgacggccgtcgcccgagagcgaacggccgtctgccacgtcactttcgccgccctctgggatggcgacttttaaaaatcgccctcccagagggcggtaggcgaccacttctgtcaattttcaaaatgaaaaattatttttgtaaaacttttaataaaaaaattaaaaataaaaaaacctctcgcgactccccgatctcgccctcacccctccgcactcgcacgcgcggcgggcggcggctgatggcgacgaggcggcgcgccagcagcacgggcgcacatcaaagaggccaaacagtcagaggagggaggacgggagaagatccaaggcggtgcggcacaatggcaggcctaatttgttcagcctcacctgctaactttttcttgatccactcctgcttaatacttcctccgaaaaaaaaaaacgagactaggattgagtaaggctgagtttagttccaaacttttctttaaacttctaacttttttatcacatcaaaacttttcaacacacacaaacttctaacttttccgtcacatcattctaattttaaccaaacttttatttttggcgtgaactaaacacaccctaagatccaaaattctacattaggtaattgtcaactccacttgtctgaaaaggccgtataagaaactggcacatgctagtctgctatagcaattttcatactactacagtactactgtatagttctcattgcgtttgttaattgcgcctgttaggtttgagtttcacgcggggtttttccacgagcaatatcgtgtttagtagttaactaatgacattggcatccacttgcaaaaacacatttagttacgccaagtgccatctagggtcaactctcctttttgcagggtacattctcccggtaattaattaagaaaagccttgcgatttttctatgtcactgttggtgttgatggagacgtcgtagagtacatgatgacgctctatcagatggggtcaactgttggttaactagcctgaagtgtcatacctggaccgctaatcagtggtggaggcatcaaccatgtatacatacctcatccctcaaaagaaaattgttctacttcctccatcccatataaaacctgacgtttaaaggttctaccggtgtcccataaaacatattgtttgagcaattttatggtcatttgttttaaatttttgaatatgctaatgattgctttgccatgtgtaatttttatggccatagctttagtgtgtagagatatataggtattattcttattgaatgccttgcactcagtgaagtgacaactgattattaataagtaaggacaacttgattatattttttcttcaagctaatttgcttttgaaaccttaaagtgtcatgttttgtggacggaggaagtacctttttactaatgtcctaagaaaatatggcttgtttggtttgataccaatttattaccctacaaaaattttggtaacttcaatagtagcaagtgtatgtttgatttgctaccaatttttatccataatagttcaaattgaatactacccaatttggtagtgtccaatttttccaatgttttagcactaccaagattttggtaggggaaaaattggctccaaccaaagaagcctgcagaaacaaatttgattaaaaagtgggatcacctgtctagtctaagtcatctggcaataagctttgaaagagttcattaatactcgctccgtcctatcttaagtgtagtcatgtgttttcatgtcaaacgtttgaccattcattttatttgaaaaatttattaaaaaatctagaaaaatgagtaacacataaagtactattcataatctgccatctaataataacaaaaatactaatcataaaaaatttcaaataatacggccagtcaaatgttggacatggaagcccaaaactgcaccggaggatgaaagcccaaaactgcactttaaatgagacggtgggagtagtatcttgcatgcaggggttcattataacatgctgagtgcatgtagactcaatgaaatgacaaatttagtcattttaacctgaagctaactagcttaaaaatcttaaagcgtcaacatttttggaacagaggaagtacatgtcaatctagctcatcaccctgattgcttgtagtgaaaaaaatggatatgaaatgatatggttttaattgtctgttgatttttgcatggtctattttatctggaaaaaaggtaacattagataggttttgactaacagcttaccaaaatataagtttatttcgcatatacaaatttataccaatcgatttttcggaagaaacctttgaaaaggacattgagtttctacttttattttttaaaaagaagagatctgatctagagtaatttacaagaaaaatcaggccatagactcttacaattgtacaattaactggagaaaaaaaagggaacaaaaccacacaattgtaccgattgatccatatcttatagagttgtaaaatctgacatagaaaaaacgccagtggaaaaatatgacaagtcataactattaccgtgaaatagacatatctctacctattataaaaatttaaaatgtttttgccgtcatcttcgtacgtcgcaaatctgtcatccgttcagattcctaagcatgtttgtagttggttctttccgtgcaaggtattttaagccgctaatcgctcgtgtatatctcttcgtcagtccgatccttatctgtattctttccaaaaaccacagcccagtatattaagccggtacatgttgcagtcaagcccacgtttccaacgtcccacgtcacgtaaggaaagagcacacccgtgtatcatgcaaagctgcttctgatctatcgctatattctgcctcacgtacgtacatgcatgtacatctgtttcctatcgatcattatatctgaaaacgaatttgattcacacacaaattaataatgtgatatatatatatatatatatatatatatatatatatatatatatatatatatatatatatatatagtatgggctccaacatcatccaccgtttaagtgctttaggattcatgctacttaaaccggattattagacctgttagcgggttaaacccgattagatgtttccatttttactatacccgcaggattgcatgcatgtactagtgaaatactatgaatcactgacgtgattaactcccatcgtttccatataagcttccatgcacgtacttaatttccatttgaaatattaatgtgattgtgtgataattcatttccaaatttgacatgatattgaatcaaatcaactaatttcgatgtaattgatttatttccatcaataccgatttatactttctattctttgtgtacatatacactagtagagatggcattccatattttacatactgttgttgtttcgactccatgatgctacgccgccggacgacgtcggcgagattctccgtcgacaagccgttgcatgaacggacgtgcccgagcttcttcgtcgtgggctgctggttgttcgccatatccgacgacgcagccaggcctccacaaatctttgtcgctaatcttcatgagcacgtcgctggtcgtccgcaagcctcgtcgcagccacgattgttgtatgcgactccgtcctcaaggctcaagctcgttcctcgccccacgaagtaactggttgccacctttttcaggtacgtcaaatcaactggaacatataaattatcgcttgtattttttggattttttaggtaccaatgattattgttcgtattctctgtgtgtatgtacagatgattttctatttttaaaggtattttagtaactgaatccatgtgaaatcgatcatctggaacccaaacaaacatgattatattggatgattgtaggtagtgatatcggtgttcatttccgctgatggtttgcatgtgaactagctgactgaattcacccctcgatcaccacgtagacgcagttcggctgcttcctatctgccgcgcctgccatctctccatgtcctcatcgtcgtcatggagatcaattgcctcgcgtttcgttccccattgcaagtatgttcctatcatcataaagcaggcttcttagtttcaaatgcataggtttttgcagggagtttgacatttggttctacctgtgttttgtaggatgattatgttatgcaaaattctaaagaagattagatgctctttcattcacctgtcaattgtctggacaaaacaaatgatcattaatccgatggtagagatgttcaacaattttggacttgctgaacagggtttctcatcaagacaattttgaatgaacaagtccgatttccagaagaccgatttctttttttttcttcgacaacctagcaatttatctaaattttcacatctacccccaaattgttctttggtttattaattccaacatagttaggttaatttctccttgtaacttgattttctttttgtgtatataccctgtataataataataaatttttaagtaatccctccggttctatattaatgagtatgaaaaattaaatagggtatataaccaatttgatcgattgtgaaaaaatagcttatacccaatttaagcaagtatgaaaaattaaattggtgtatacctaattaatacgattatataaaaaaagacttcgattaaatcgggtgtatacacaaattaaatgagtatgaagatttaaacgtgtatataccaaacttaatcgctaacaaaaaatcgggtatatacctaaattaatcgataaccaaaaatcgggtatatacactggcgtagagataaacatagttggctttgcctggtctccaaaaaaatgctatgagaaacgagcatacaattcattaattcttttcagttttagttaaaagtagaatatggttatagacttctatgagaaggtatatttgtcacatacttagccctcggagatataaccaatatacgggtgaaatccttttttataaaagaattaagcagaagaccgatctataggttctatactccatactttaaataaatttaactatagttaaaataaaccatgcaaaagttctcatttctatatatctagcgtatcgaaaaagtatatgtgtacacacacatatatatatatatatatatatatatatatatatatatatatatatattcacgcagtgatataacctatcgaattgaaagcaattttattagcttataccctgacacagtaggtatattatacatacacataacgatacatagccagataaaaatagaagatagattattcgatggtcatgcaaactataatttattccatggtcatgcaaactaataaggagtgtatatattacatatatacaccggtactatgtatatacctacacgaatgtcacacccgtagcaaactatattacatatgtacatcgcggtactatacatataactacaagaatctatttcatgccatatacgtatccacataaataggggcaactactattttcacaaaacaaaccggttatatacctatataactcatagcacagagaaaccaaatcatttgtgaataatgtagaatttacatttataccggaaaaacaaaacattaataaatactctaattattttttccttggccggctgtgggaatagaatctaggtatatattctaatataattcactcccgtgattttaagaaacaaaaacaaaacaggagtacatatactttatatacgttatgcatacccaaaattaaggattatgatttatctgttcaaatgtttcctttatttgccataattatgtaagtaaatcaaagggcattaaatacggcttaattagtacaatgcatgcgccagttttttgaacagggcattgcaccttccaaataagaaattaaatacgggtgtaaacccgttaatcttagaaacacatcaatctccttgatcaagatctcatctaacggtttacactcatggagcccatacaccatgctgccccatttggccatcctatatatatatatatatatgcatgcaaaccaaaattcaacttttacaaattataagaaaaaaattccagtcatcaaatctctactattataaaaattgaagttgtttttgtcggtacttgtataagtcggtttttaaattcattcgtttttggaaatatttatccgtatttgagttgggttttaagtttgttcgtttttgaaaataaataaagagttgtataagaaatctctttaaaataaactcgcatgttaacttgatatgattttctagaaaaatatatatccaagcaaattcttacaatgaattcttagaaaaatatatttccaaacgaattcttataatgaacaataataagattaagatagccttcactcattacaacgcacggatgttatgaaaaaaaagtatgatatgataaagtacggtcctgaattcaacatcttctagcctccttaggtgacagtatttggcttagcacttcacgtttagcgccaatccagccactccaggaggcgaccgttcttttcttcttcggctgggaacacgacgtcgacacacgtgtagcatacagcatgtcagcatgcgtgtcatgcactgctccctccgtcccaaaatataaaattttagaattagataaaacatttcataatactataaatctggataggtatgcccactgtcctaaaatataagaaactagaatcgaatgagatattttctagtattgcatgcctattcagatttatagtccttagaaaatgtttattatattttaggactaaagaattttttttttaccggagattttcatgaggcttttgttctcgtggaatcctctctctcaacttatctgtctgtggaatctatgctcctgccatctttgtgcagagacgttgttctcaagctccggtgagagtgatgagtcgacgtgcacaagctgtatctcactttgcttttgtcactggaatctagtaagatcccacggtgcacggaccgcttggcttggatcttgtctcagctttccgatgccatgtgttaacaagtactactacgaattttccctgtatcaatttgtttacggtaaacccaatgtcgtgccagaatgactcctctcatcctctggtactactacgtgctttcgtcatggcaaatttttgcagaatcgacggcgtctgagatgctgtacatatacggtacaccctccttgttgtgaaaacagatgtaacacataaattttatggaaaaaaccacagacgccaaccggcaattatcactattgaggagccgattataaacgttcgtaaataaatttatggtttctatgtccgacgtttgaccgtcatcttattttttaaaaatatgattctttttttaaaagtcacgcatacaatataatccatgttttatcatctaataataataaaaatattaataaaaaaattaaataagactgatggtcaaatgtgggggaaaaaggagcttataaatgaatgtatttcgggacagaggctgtagttaaaatcaattcttgtgattgcacgccgcggctatcatctcatcatttgtacccgtgacatggatacgcgatccagtacgtacgtagtacgtcgccaacgccggatgcaggaaaagctggcgccgcacggcgtgaccgcgcgcagcggtgcgtacgtacgcgcgcgcgcgccgcctcgcaccgctctccgcttggcccggcgcgcgcagccgcaggccgcaggccgcagcgtgcgtacggcgagggaagcaaagcgtggaccaaccgaacacacgggcgggcgactccgctcgccgctcggcctcgcccgcgcgtcacgtaggtacgcatggcagattggcagcggcatcgtattcgatctcgcccccaccgcgtcgcgtcgccatccacccccaaagcatcccgcatcccgtcgtcccccgtgctctctctcttccggctcgatcggcgaatccacgcgagaactaacacacacaaaagacacattgacccatcattactatactaatcactttcataacctaacctaaatcagagttactcctccgtttcatattatatcccattttaactttttactagtaaaaccttctcaagtttgataaaatttatagaaaaatctagtaacatctacaacaccaaattagttatatcaaacttaacattgaatatattttaataatatgtccattctgtattagaaatattattactccatccgttccaaaatataagtatttttagaatattgacaaatcaaatatttttaactttagctattaatagaaaaaaaagatcaataatgtaaaattaatgttataagatttatcattaaacaaactatcataatatgtaactctttttatttaaatcatttgatattgttggtcaaataacatctcggagactgtgtcagattcaaaagatgcttatattttgggagggggagtatttttttacaaatttaaaaatatttgactggagaaaatatcaaaataactttaatgtgaaacggacggagtagttaacaacccaaacgcaccgaccgcgaccggtaatctcatgcatccatccatccgctgcatctgcaattctgcattggcagcatctcttctcttttctctcctcctcgctgtttcgcacgcacgcaccgcaccacgccgccgtttatcaacgactcctttttaccgcaaaggtttcgtttcctttttcctccctctcgtcgcggccgcaccccgaagcggaaggaaggaactccgagagcgccatccatccatcagcaccaccgcgcgcggggggcgtagtggcggcggcggcggcgggagtcgccggggagatgtgagagggagaacgacgtgggggccggagcggagatggctgcggcggtcgtcgtcgccggggaggcggcggctgcggcggcggcggcgggggcgggagggaagaagcgcggggcgtcgaggagctggatcctgttcgacgcggcgggggaggagcgggtgctggacgccgacaagtacgccatcatgcaccgcgtcgacatcaacgcgcgcgacctgcgcatcctcgacccgctgctctcctacccatccaccatcctcggccgcgagcgcgccatcgtcctcaatctcgaggttcgcgccccccaatccccccgcccgacttcatccgggattttcggttcgatatgcgatgggatcgtggagcgccggattcgtgacggcgaattcccgggaattattacccccaatttcgcatgttttttaaggatttgttttcggtggggcggattacgttgtgattcatgctctgtcttgctgttgcgcgtagagtcaaggttgtactaggtgcacgtacccgactgattccatgattgcctacctcatcctcacgaggacgatttgattgaacgggtttctgatccaagtgaagggagctagcgaattgatacagctgtttttttttaatgtttgaacactgtattttaatgattattacggctctatcgtggtgatttctaacgaattccgtgtttcttcctgctggaattttccttcggtgggtcgagcagcatatcaaggcgatcattactgctgaagaggtgatgtttaattcctttcccccttctgattgtttgtcatgtaagaaggttccatttgggttgggggggggggggggactatgtgcacaattcaaccgtctcttcacttattggttagctatctataatgttgaaattctcatcaggtgattggggattatatacggatgcagcactactttggagttttgtctcaatttttaggagttgcaggatgctcaaa

SEQ ID NO: 59541 - DNA, 4316 bp, Oryza sativa
atattccgccacgttgtgaaacgcagaaaaaatgtatccacaatacgtagctcagcctctctccagtcggggaaattagaataactcccgctccagtgcttgaaagcctcttcgacccgtcaaaatgcatagtccaatactccatcttctccacgggcatgtcttcttggcactcagtccactcggcgacgaagtcagctaaagcttgagacttgatcgaagttcgcggcttgaaagatatatccaaagacatcaattctaaggtccattttgcgatccgcccatttgcttcgcgattgtgaagtatgtccccgagtggaaacgatgtaaccaccgtaatcgagtgaccttggaagtagtgagataatttcctgacggtaattaaaacaccatataatagcttttgaacctgagggtatcttgtcttggagtcagccaaaacctcgctaacgaagtagattggttgttggaatttttgaacatggccttcttcttcacgctcaacaaccaggactgtgcttacaacctgggaagttgccgacacgtataacaacaacggctcttgcggatgtggtgaagctaagactggtggagtagtgagaagttttttgaagtactcaaaggctttttgtgcttcgggtccccactggaaattgttggttttctttaacagcttgaaaaaaggcatcccccgctcgccgagtcgtgagacgaaccggctgagcaccgccatgcagccagttaacttttgaacgtctttctaggagctcagcggtttcatgttgaggatggcattgattttctccgggttagcttgtatgcctctatgggacaccataaatccaagcagcttccctgacggtactccgaagatgcacttttcaggatttaatttcatcctaaaagcgcggatgcttcaacgttgcggccgatctgagttgaaaaacatctctggatcatgcgttgataagttgctcctgcgttctttaatccaaaaggcatggtgatgtagcagtaggcctcaaagggcgtgatgaatgaagtctttaagcagtcggattcctttagtcggatctgatgatatcccgagtagcaatccaaaaaactgagtagctcgcagctggccgttgagtcaactacctggtcaacgcgaggtaacccaaatggatctttgggacaagacttgttgaggtcggtgtaatcaacacacatgcgccattgccccgtcttcttccgaaccagaactgggttggctagccagtcgggatgaaggacttccttgatgaagcccgctgctaacagcttggtcaattcttccttgatcgcatccttcctatcctgtgcgaaacggcggagtcattgctttattggtttagcgtcatccttaacatgtaaagagtgctcaatcacctctctaggaataccaggcatatcagatggtttccacacaaagatatctttattattttgaagaaaggtgatgagcgcgctttcctatttacaatctaactcagcgcctattacagctgtcttagtaggatcagagggatctagaggaatcttcttggtcttggtgtcgctttccccgctctttggcatcttggtcgcaggcacttctccttcgcttgctgtggacgcagccagttggatttcttctcgggcgagcgtgatctcgcaggtctgggccatctcgcagctttccttgtcacacgtgacggcttgcttgatgtcactccgcagggatatgactcctcgaggaccaggcatcttcatcatcatgtaggtataatgcgggacagccatgaacttggctaacgctgggcgtccgagtatggcgtgatacgctgtctcgaaatcagcgaccttgaaacaaatgttctctgtgcggaagttctcccgagtgccgaaagtaaccggaagaatgatctggccgagtggtgtagtagatagccctgggatgactccgtgaaagggcacattactcggctttaattccgtgcgagggatctgcatgtcgtccagagtcttggcgaaaaggatgttgagtgcactgccaccatcgatgagggatctgcgaagcttgacgttgcgaaccactgggtctagtaccagggggtaccgccccgggtggaccactcggtcaggatgatccgagcggtcaaacttaattgttgtctctgaccaccgaagatattggggcgtgtcgggctgaacagcgttgatctcccgttcggttagcttttgctttctcttggattcataagccaggggtccgccaaagatgtggttgagttccttgcgatggtcttgaaaaccagtcggggcgttgtcttcatcatccttcttctttgacgtgctttgatctccgtcagaggccttgcgtgcattcttggcgtattgttctgcgaactgttgatagacgaagcaatctttggccgcgtgattggagtttggatgatgcggacattgggagttcatgatcttgtcaaaagtgttgacccgtgaatgttgccgggaggatggtgtagtagttgccacaagttcctcgggcttgcgatccttgtgattggtacttccactcccccctgtagtcggcgtatctttcttcggcttccaagtggtgcccgactgcttggacgcggtaatggcatcttcggctttggcgtactcattggctttttcgaacatctgcttgaccgtcctgggaggcttgcgcccgaacttgccgactaggtcatcgtggcgaatgcccttggtgaaggcagcgatgatgacgtcgtcggtgatgtcggagatcttgttgcgttgctcggaaaagcgtctgatgtaatctcgaagggattctctagacttctgaacaacattgtagagatcaaactgtgtactagggcgttcaaagataccctggaagttggcgatgaagtggtcgcgaagttccgcccaagatccgattgtgccacggggtaactcgtgaagccaggatcgggcagagtccgctagggccacaaggcaaatagtttgtcatggctttgctgtctcctcctgctgcgtgaattgcgagaccatagacggtgagccaagattccgggttagtggtgccgtcatacttctcgattccagtcggcttgaagccggctggccaatccactcgacgcagttcacttgtgaaggcagcaactccatccacgtcgtcgtcgtagcgatctggtgaatggtggggaacgtatcctcttgccgcgcggcgctggttgataatatcgcgaagatcgacagggcgcctgcgatgtggggagcgaggtcgttcaactcgacgctccctgtgtcgttcaggaggcgagtggacagatcgctcgtcgtgacccctgctcctgcgactagatcccgcgccgacgacactgaggcttggttggtgatagtcttgagatcgaagagggggaactcggctgccagtcggcgtgcggacgcttgcagagttaaccgggaccgagacggcgatcatgatcttggtctggttcaagatgttgacgacgtgattggcttgattgagtgcgtcttccttgaggagggtgtcgaggagggtgatcgttgcaactgcgttctgttgaggggtgcgaaaaaccgccgttccgtcaacgtcttgttgcccgataagttctcgtgctcgtcacccggcatccaaagcgcgctatcgccggtcctcagcctcttttgcagcctattcttgctcttgtgcttggcgctcctcttccagtcggcgtcgttcggcttcctgttgcacgcgttgttcttctgcttcttgggctttacgctgttcttccatctcgttgtcagccatgaagatgccgaagtagagaggcgtgtagttatcttcaaagtcttcgtcgaagtcgtcgaggttgcggtagtcgtagcggcagccgaagtcgttgtactcaatgatctccgttggccgtgagtcgacgccgggggagctgaggtagccatccagttgttccgtcgaaaccgtgctgagaggctggagtatgatgccgacttctctggtgctaagctggatcggggtagaggccggatcccgcctagatctacggggagaagatgcccttgtggtgaagacagcagccaaatcatcggggagtttcatcaggattggcggataggccccatcgtcttgatcgagtcgtgttggagtagattggatctcgttcgagtggtttgaagccgactcggtggagacgatcttggggtagatcttggccgagtttgggataccgaacggggcggagatctggcttcttcccgactggttcgaatccgag

SEQ ID NO: 59542 - DNA, 2413 bp, Oryza sativa
  unsure (1)..(2413): unsure at all n locations
cgagcctcccacacggcccatcacgagcccgcggcttgtgactccccccgacccaacccgttccattccgttccgttccaacggaacggattccattcccgcgccccgctacataaaccccccttcgcctcggcgtcgtcgtctccaaggcttccctcccatcccaaaaccagcgcaagcgaggcgaggagtacgtagtggtaggaggtggcacgccgcggcggcggaatcggaatcgactagggagatggatgcggcggcggagatgcagaaggtggtgagcctgaggagagggggaggggggtcgtcgtcgcggggggcggcgtcgatgtggtggagcgcggacaacggggtgttctcgcggtcgagggcgtcgtcgagtggggaggatggggaggacgacgaggaggcgctgcggtgggcggcgctcgagaagctgcccacgtacgaccgcgtgcgccgcgccgtactgccggtggtggaggagggcggcggcggaggggaggcggggaagaaggtggtggacgtgctcagcctcggcccgcaggagcggcgggcgctgctcgagcggctcgtgcgcgtcgccgaggacgacaacgagcgcttccttctcaagctcaaggagcgcatcgaccggtgcgtactgtgctgtaccacactgcgtcacgatgtcgccgtggcggcggacgcggttgcctgcagggtgtttgatgatttgcgcgtggtaattttgatgtgcagggtggggattgatattccgacgatcgaggtgcggttcgagcacctggaggcggaggcggaggtccgcgtcggcaacagcggcctccccaccgtcctcaactccatgaccaacaagctcgagggagccgcgaacgcgctggggattctacccaacaagaagcagaccatgcccatcctccacgacgtcagcggcatcgtcaagccccgcaggtgaaagaaagaaaaagaagcatcacgttttcaaaattgcttatgctttatataacgttacgtgtgtgctgctctcatggtttatttgcgattttttgaagcattgtaagatatttgcttgaagatatttttgtacgggatgccggttcccaggaaacgaaatgcttttcaattagacatgtccctgtaaactgtaaagttgatttgtctttgttggagcctagattaaccaagatcatttggaatttaacttctatgcttctcctataacacgttcttttgattatgcaggatgactctgctgttaggacctcccgggtctggcaagaccaccttgctacttgctttggctggaaggcttggcaaagacatcaaggtttcaaacaaattttatttacttattttgcaataactgcgatataacgatgcgtttgggcgtttggcaaaccagtccatattcccacagatgtgtgtacttcatctttaatatattgtatacgattagcgaaaatacagagaacatacttttagagaattaatgcataaaggcttacgcatcattgcattaagttggtagaaacaaacaaagttcgcatgaacagataacttttcttaggtgacatgtcccaaaaactgtataccttgctcttgagtgatattactgataactgacatacacaatgcataatggggggaaaactaatttgcagttctctggtcaagtgacttacaatggacaccagatggaggattttgtgccacagaggacagctgcatacatcagccagcatgatcttcatattggggaaatgactgttcgggagacactctcattctcggcacgctgccagggtgttggaagccgctttggtatgactatgtgcaaggaacaaccacaagtgcatgcattcttttctgcagaattcgccttttgagaaaatcgtcatgggttgactgatacttatagagttctcttgttatgtcattagatatgctgaccgagctgtcaaggcgagagaaggcagcaaatattaagcctgatgctgatattgatgcgtttatgaaggtaaaaattgcaaatcctatataaatcagaattattctggtgtctgtagatatgattttcatacgaggtatgagtgaagttttgctataaattttctgtcctaacttgatcaggcttcagcgatggagggacaagagaccaatttgattactgactatatactgaaggtacatgcatctctgagctacaatagctactacctccgtttcaggttatgagactttctagcattgcccacattcataaagatgttaatgaatctaggcacatatatatgtctagattcattaacatatatatgaatgtgggcgatgctagaaaatcttataacctatgtgcctagattcattancatatagggtnccgagtggatgagcaggtcctaattnggcaccg

SEQ ID NO: 59543 - DNA, 7486 bp, Oryza sativa
cgggctccggcggccagctcggcggcgcaccgctgtacgcggtgggggacgaggtcgaggtgcgcatggacgaccccggcttccacggcgccttctacgaggccaccgtctccgcgcgcctcccgtgctccggccgctacgaggtcatgtactccacgctcgtcgaggggggaggaggccgcggccgccgcggcggtggcccgctccgggagacagtcgccgcgtgcgacgtgcggccgaggccgccgccgccgccgccgccgccgctggcggaggacggggcggcgccgggcgcgcgagctcaacgtgttcgacatggtggaggcgtaccacagggaagggtggtggccgggcgtggtgtccgcggcatggccggctcgcgggcggaaggcggcggcggcgatgtacaccgtgtcgttcccgtcgtgccgggaagaggcgaagctcccggcctcgctcgtccggcggcggcgggcgttcgtgcgcgggcgctggatggacgcgcgcgacgtggtgagtcaattctgctgaacggattgttgtactccgtattttcccccttttgtgctggtggtggacaggagaaaccctcttcggtgcgttattcgtggctggattattgaggcgtaaacctgacatttgacatgggatttaatgctcaattggacaagatggaatgttcataattttaatcggtggtgatgtcgcatgtacatgttagaggaactttaggtagtgtttggtaatttgttatttctaacaaaaaaaccactgaagatatagaagaacttcgttttttttttttacctgtaggtgagtggtgacttgaactgatgacctcaacgacaacaatcaatgaattcatgtgctgttctaacactaggcgagactaggtgctttgtattgtagatatgagtgtcccctctagtttgctactagttcagaatctgagatatcaagataagaccaagtgatgacaaatgccatacttgtttgacctaattatcgtgtgctgagtttctatttacatgtgggggattttattgaattcaacaaagcagtaagtcattcttcgtccactggttagtatatgtatgctaagctattggttgcatccttgactacacattatgatggattggagaatgcaaattagtgttaatgagttccagtgagaaggcaaatacaaaagaattgtgcttccaaaacagtagcagttgaaaaattggttgtacaaacaaaaagaattgccatctagaatttaaaacaatgtcaaacaagcaagaactcctgctaaattttatgctaactgaatgaattttatcgtattctgaattgtcaaaagaataaaatggaagactaaatgtgtactccctccggttccatattaattgacgttttagacaaggttgatgtcaaacttttataactttgaccatcaataactttaaaaatatttagtttaaaggaactagaataacatatatagatttgtctttcaaagcactataataaaagtaaacatgcatttatttattatatatattataatagaaaaataaggtcaaaaatatattttgtagaccgtgtcgttgtccaaaacgtcaattaaaatgaaactggagggagtaggcaaaaggaactccgttttttcctgcatgaacacgaggcaaaacaaactccatgaaacctgatatccttggtgtaagcttcactgagagagaatgagacacggcaacacaatatttactttgtataactaatgtttgtgcttttgttattttgagtgcaggttccaagggtgccgcagtatgacgaagggagcaatgtggaagtcatgttggatacaggaaagcaccgtgcagcctgggtaactgctactgtcattaagatggttagcagtaaaaactatgttgttaggcttaaaaataaggaaggctcagttaacatcgtagattactgctatattcgaccacaacctacctttgacagaaagaagtttgagtatgaactggagccctctgcagaggttgaagtgaatctgggtggtgcctggtcgctaggcgtcatctcagatgttggaagctgtggatatggggtaaggctaaaaggacatgatagctcagaggaagaggactacatgcttgtgttgcgtgctttactcagaccctactgcaaacaggatgatcaggaattgatgccttgtacagcaaaggtatttctccaactagtcatgttgttacttgtgatttgggtattttctcctcttctttcttggtactaccagtctactgcagtgttcatttttctgctgtgaataaaagtttacaatgttttcttgccgtgcttgtatgccttcttggaatatgtggtgtttgtcattttaatgtcagtatgccagcttagttgtccctgtgctctggacaagcaggtaacaaagttgaacaagctagagaacaagaacataaaagggaaggcgcgcatgctagtttcaaggaaactgcctaacctaggctgcacacggagtggtggtaaacaaagacacagcatgaaaaaggttgtcctgactccgttcttcttaaattgcaaacttaaattgtgtcttaaattgcaaatttccgcgcattcatacagaaaagcccgcttggcgctttcacaggtcatagtgcttttatcaatatatattttgaccatcaaatattgtgcttcagcatcttatgctaatgacatcatgtttttggtatacgctttcttcctccaagcaatgacattatcttatgctaatgacatcatcttatgctaatgatttagttctctcctaaactgtgttgtcatttggataattgttgttcaggaatttgcttgtacaagtttggatcttccatgtatctctgcacctaaagatgctgttgaaatcaagggcaaatctagttatgtcgatgtagtcgaaatcagtgacaactctggctatgatgttattcatatcagcgatgattcgagctgtaaccctagaagaaagagaaggcgacagaatctcctagaggaataactccattcccggcatacttcctatccgattcaagaatcacaatccaggctgaatatgtcaccagcacgaagtcctttgaactgtgacccgttgctagatgtaatgaggcatcctaaagtagagtcgtgcaaccatgtgttatcacaatcttgtcgccattggaaacaccacaggctcatttcaacaacaatgctgggcagctaattcctctgccaagttatccggtattagagaagttgccagttaaagtgcttcctgaaatgaatgaaatgaaagaaacaaatcatgctcatttacaagctgagttcttggcacctgatgattgtacagccggagaccaaaactatgctctgcctataaaagttgaggtacatacgtctgttatctttatttgagatgaaaattaatcccttcttgattgtctatctgttgctaactcacctcaacttaggtggagagctgggtcgctgatatccgcaagaaagaagcaggtaccggtctgactacctcaaacaactgtgagtacttgttataacgactttgtgttacattcaattgtaaaacctgtcttaactagaacgaaaatatcaccagcaatgcagacaattactgatagtggtgaagacaattcaagaaggccacgatcaggagattctgagataccaaattccagtaaattagaaccatattcatctgagcaacaaaggtttgaggccgatctgccatgcatgccagtgcctaacaatgttactattaatactcttcctcttgttaccagacatacgtttcaatttgtttctcggaacaaactggaagtgccagtgagacataagaaggcccctgatgctgtaagaccatctacgttttcccccctgttttatcttctgtttaaatgtatgtgtatttcccatccatgcttgatcatcttgatgctatttgtacagctggagatgaataccaattcggttgtcttctctcccaaggagcaaacacactgtaatttggagatctttagtccaaactgtaagtcttgccacaactttaagatagtaatttttgatgcattgatacttaatactggtctggctgatctgaatattatttttctgcagccaagaagatcattgatgcgtcacactatgaaagttatgcgtcattacagcagcatcctttgggccaatgtcaagttccaaattattggagtgctgcagggcaatcttcatttgtgcatccgagcataacaatgaacctattcacaatattgccagcacctaacagtcatccaactacttttgcctcaagcttgttgatggggccttgtgagaaaatagaggtttttgagaatctgccacaattaccacatttcggaaagttgattggttgccctcctgagctccgcgaaggaaaggctctggggctaatggcatccttcgcaaatatagcagagagcatacaaaacatgtgaattcaggacgaagaaaacgtctttgaggagaaactgaggtgcctctcggaattggaagaggacggatttgatgttagggccctgaaggagcggcttgaaaacctcgtgagcataaagaatcaccagacagaactcaagaagaaaagagcaagattggatcagttcatgcttgagagagaggtggacaatgcctctgtagagcaaagccagaagctgctcgacataatgatcaaggagcttgagctgaaacttttagagtaccgagagaagaaggcatcactcgtggagaagaaagcagcgaactgttcggaaattgcaaagctccaaggcgacatggatcaaattgaggagtcattcctttctgccgagtatgatttccacaccaccgctgctgcgccgtggtaaacattgatgacagtaagtactgctttcttgcttgctcatttgtgcactgcaaccaagtccatttggatggtgttaactgatgtgaaacaatgcaggcagagagctctgttcacagttcacctagacatatcacatacgcatatggttcactgatgtgatgtgatccaatgcattaggggaatgaggcagctagttctcttttgcctagacttgaaatgctgaacttaattaagtttgtatgtataatggttgtcacttgaatttggtagatcatctcattcaatcaggcttgcccccctgacattgatatgcgctgtttggcctttaaccccccccttagtgttggccaatcaagcagctgtaattttctttgtattctcttggttgtaacccctgtactccgttttttttttctactctaatgttaaattctagcagatctcctgccgatgttctccttaaaaaaaaaaaacaggcttgccccatcttcaatgctagctctgttcactgatgtatgtgaaccaatgcattattaggggagtgaggcagctagctctatttgcctagacttgaaatgtcgaacttaattaagtttgtatgtataaatggttgccacttgaatttggtagatcgtttcactcttgccccatcttcaatgtgagcaaggtctccaacgtctagaatcacctgacctggttaatagttttctgctggaaaaatatgatgctcctcacagtcctctggttgttggggaaaagtgaaaacctctttcggggatattcccaatctcaacaatgagaactgaaaagcgatcttattaacttaatctcagacgttcttagtttcagcagtatgataacctggagtgaacactgaactgaccttggttcttacatcagggctgcacgcgcactgaatctagaaaagcctctggagtagtactaattaattaactaacgatatatagccaatgactactggtgcaaaccttatacattataggagtgtgtaattaattaactgtgtgtgtgtgtgatgagttctatagctagcatttctcgtcggcgtcggcgacggcggtgtgctgctgctgctgctcccgcgaggtggcggcggcggtggcggcccacttggcgcagacgaggtaggcggcgaggttgaggacgctgaggacggcgaggagccagtagaagtagtcgaggcggctgcggtcgatggtgtcgccgagccaggtggtggcgcccttgacgagcgacacgagcacgctgctgaagaagaagccgagcgagagcgtcgtcaggaagagccccgtgctcatcgtcttcatccccttgggcgacctcgtgatgaagaagtccagctgccccgtgtagatgaacgcctcgccggcgcccaccagcaggaactgcggcgtcagcaggaacacgctgatcggcgtggagttcccggtggtggcggcgacggcgacggcgaggcgcttcttctcgcagagcgcggcggcggccatgccgaggatggagagggcgaggccgatgccgatcttctccaggttggtgaagccttgcttgccggtgagtacgcggcagagcgggatgaagacgcggtcgtagacggcgagggtgagcatgatggcgccgacgaagaagacggtgagcgaggcggccgggatctcgaagccggcgccgacgcggcggtccatggtggtggcctgctccacggagaaggtgatcatctgcgcgtagatggtccagaagaggatcgtcgtcgcccacaccggcatcagcctcgccaccatcttcacctcctccacgcgcgacaccgagcagagcttccacgggttgggcgccgccggcccgcccggcccggccacctcgttgtcctcttcgccggccaccaccgccgccatgtccaggcacgggaactgcgcggtgtgcgcgatccgggcgtgctcggggcggtcgtcctcgtagagctccgccgcggtgggcgggcgcttgacgaccccgcgcttccgcgccgcggcgacgagcacctggaggatgtggacgatggggctcccggagctccgcttgtagcggtacctcctggtcccggagaggaagacggcgatggcggcgagcatggcggcggagcagatgccgtaggcccagctccggccgacgtggtcctggacgtagacgagcacggtgacggcgagcagcgtgccgaggctgatgaagaagaagaagcggttgaagaagaggcccatggcggcgcgctcccggccgtcgcggtcgtcgaactggtcggtgccgaagccggagacgctggacttgaggccgccggtgccgagggcgatgaggtagaggcaggcgtagagcacggccatctgcaccggcgtcggctgctccccgggcggcgggcggaggtgggtgacgagggtggaggcggcgaggagggcggtgccgatggactggacgagggcgaagacggcgatggtgaggtagcggccgaggaaggagtcggcgaggaagccgccgaggaggcagaggaggaaggaggtgcccatgaagtcggtgacgacgttg

SEQ ID NO: 59544 - DNA, 22721 bp, Oryza sativa
aagggagctagcgaattgatacagctgtttttttttaatgtttgaacactgtattttaatgattattacggctctatcgtggtgatttctaacgaattccgtgtttcttcctgctggaattttccttcggtgggtcgagcagcatatcaaggcgatcattactgctgaagaggtgatgtttaattcctttcccccttctgattgtttgtcatgtaagaaggttccatttgggttgggggggggggggggactatgtgcacaattcaaccgtctcttcacttattggttagctatctataatgttgaaattctcatcaggtgattggggattatatacggatgcagcactactttggagttttgtctcaatttctaggagttgcaggatgctcaaaggggaatgatgcatagttttctgaacctatagctccatacaatgctgattttctaggcttctgtcagtttaagattaaatttgttgccactttgaatagagtacaatattgcagttgtctcaagtctgttttctatataataaactaggggctatagtttataatttatataaaactgtgaggatcttaaatgtcattttcatagatgccaagcgatgctggtggtaactcacagtaaatgtttttatgctgtgctcaggttttgctccgggatccattagatgataatgtgattcctgtagtagaggagctccggagacgacttgcaccttcaagtgccactcaacatgatgtggaaggtgctgaagaagatggtaagtttggcttgtgattctttctgaactgctgatgttcatattggcaacacgattctgtctgtatgatgtttgttgtggtaacttttagtatatgtttcttccttgatggtgaaatgccaatacccttttgatgtcaaggaattggacaaaaacaacgcacaacatgtttttaagaaatatgaaagaattcaaaaatattaattggccgcaaaattctttattgggttgcggccacaccatcctgttgtattcttctttaatttgtgtccttttcagttggacattcagttgaacaacgcgacctgtcactccaatagaaaagtccaaagcatacagtcatgaaacataattattattctgcgatgtctattggactttcttgcactagatcaatatattatgtgtcagtctatattgggattttgtcttaaactgagattttgggataaatgaaagaaatttgaaggaccctgatatggattcaactggattcacgagccatgactaaattaacacatcgtggtgggcatataaacacagaaacttgagaataataacattgatctatcactatatgaggactttctgaccctctacagaatagtatttgtttggtttaatttagtctacagtatgtaatacatattacaattgatgtgccattttataaccataagttgatccccttgcatcaaattgacttggaaactttctatctatcctatcactccatcaatcaacactggctggtatgctgataaaatcctaccaatgtctaacaactgttgtggttgttttgattgtaatattctatttgttgtttgtgaactccatcaatagtttgttaatatcccgcaatacaattttatgaactccagaatctccctttgaattccgcgcactggaggttactttggaagccatttgcagttttcttggtgcacgcactactgagttggagagtgctgcttacccagctttggatgaactgacatccaaggtgactgaatatatgcttaccatactgtattcccttgttatgaacttgattactcctagaaacatgatatgtgtgattttatttgaagcaacaagcataatatgttaattgctagatgaactaattccccttatttttcatatgtgaaataaatatataattgggtacttgattggtaaaataatgcttccacatcatattttacttgtactataaactgttcaattacaatttataaatcaaattctgattcataggttgtgctagtaacatttttcagtaggaatttttgcacagactgaccaaattcatgccacagctgttaccttgattcttttctatagctcaaatgtccatatatgtttcaccatccatataatgccagcaactatgtgataacttaaggttaagaaattatgatatcttgcaatttactgatgtagtgagcatatacttgtctgaacttatgctattcacaattttagcagcataatagtgtagtttgcccaagaagtggagtgctgtattattgatttccgtttgtcgccaaacaaaattgtagctaaagttgcattaagtaattgtacgatgaacagaagttacatttgagaattgtatggcaaatcttcacagctattccttgaaacttctatgcttatcatatagccattataggtctcttaactacttgttacattctcagcacatcaactgcattatgcatactaacttgatctactacaaacacacagattagcagccgcaacttggatagggtgcggaagttaaaaagtggtatgacacgattgaatgcgagggttcagaaggtctgatttcttggtttgctatttgacactactgagtgcagttaattaactttatatttttcagataatagtcatgatgttcactgtatttttatgccatattctcatctgatttctacttttgttgtgagattgttctgataattagccatattagctgaagaatctgtgcacttctgacaggcattgccatgcttttatcatttctttgctatgtcatagcacgtacattcttgtatccagggttagttattttataaacagaattaaagaacctcaatcatctagaagagcattggtaatattatatactattctatatttgacaacatacagttctgctttctattctcttgcatacttggtgtgtatcacccgttatttactagcttttcttgttcatgctttcctattagatcacaaaatgtttgttctctttgccaggtgagagatgaacttgaacaattattggacgatgacgatgacatggctgatctttacttgtccagaaagttggctggggcagcttcccctgtcagtggctctggtggaccaaattggttcccagcatccccgactattggttcaaaaatatcaagagcaagcagagccagtgccccaactatacatggaaatgaaaatgatgttgaagagctagagatgttgttggaggtcttttttgtttttctgcatcacaatgtcttgtcattctctggctgagatactaaaagtttcttaaatttgcaggcatacttcatgcaaattgatggcacattaaacaaattgacaacggtaagttgaggcagctaagtcgaatttacaatatcaaaatgggctagcaaaacatggcctaaggcttttgtttacaacacaacatcgttgaaaattaatagtactctaggctttcaccctttgctgactgtatttgtctgctatactgtttcagctgagagagtacattgatgacacagaagattacattaatatccaggtaacatttccctatgatatagctgtgcacggcatgctgatcttttaatcttggcactcacctcattacctctcgtgcagcttgacaaccaccgtaatcagttaattcaggtaatttctgaactacaagacctcatgattctctcttcttaagtgcaaattccacaaaaatagaattgatttcaaactagcatgctgttaaacccacactgaaataagctaaatgtttcataaaacttggttaccattgattcagctgattgtgctattctagttagtaatgcttgcaagtataaattctagtagttatataaatactctgtcattgtgcctcccgactttctgcaacagtaatataacttggatttgcttcttcctgcagctagagctattcttgagttctgggaccgtatgcctgtcgctttactcattggttgccggaatttttggtatgaacattccatacacctggaatgacaaccatggatacgtattcaaatgggtaagtcaaccattacaaaagggtcgtttaccgtcaataaattgtggcctgtctaaccaagctgtaaactttgttcctgcgtcacaggtggttctcgtgtcaggacttttctgtgccttcatgttcgtctccattgttgcgtacgcacggcacaagggcctcgtcgggtcgtgaaccttgcccaaactgtaaatttgagctagagcaaccttgcgtatgattaatctcttgtaccaaaattcatcagtataaaattgggatgatgaaaaagaacaataaataggaaaaaaaaagagtaaattccaaagagatatatgatgcttgtcttctttacccgtggtttgccacttttaggtgaaaaagaggcaagctggtaccctggacaattttctcgtctgtctcgcatcaccacatgctaattattaatgccctggtaacttcagaagaaagtgttgctacaaatgcattcttccttgcagaagaaagcgttgccatttttctgaaaggtttgtggaagacttttaccatgagttagaagcgaaataacaggacgaacaattcttaatgggaaaaatcaaccaatcgctttcccttctagaagtattaaggcatacataaacataagctaaattacattcgcgggagattacctgcgttagagtttaaatcttgatacaaacaaatatattacacattctctatttaaatagactttaacaggaatttatatttatctagattcattaatatcaatataaatgtgaaaaatgatagaatgacttacattgtgaaacagagtaagtatatgttatattgttacggtgttaagtgtaaagtgttgtgtgtttatcgtgtaatcggaaacaaagaaacggttatgaatgattaattgagatcacaccgcggtctccaacagttcggttatgagtagtatgatcttgtcgatagtacacacaagtagtatgttcttgtcgaacgttcaggggatcggagattaattatgtgcagtaacttcttcacagttagaaaaatcaactaatgccagtatctatcatggacttcacaggtcaagcacaaacagtcaagatggtgtgaaactctctcacatgcatacgcaaggaagaaataaaaagaagaggtatttgcaattccacaaggccgtgagaacgagcattatgcatagcaaatcttcgtttaagtaataaatcctatcaattctgccaagccacattgcaaaaaacctctccgatccgttcatatgatcgttgccctataagtacaaagccagatacaattaagagctgagaaactcatcatgatcatagtactttgtaaggtagttcagacatatatacacattacacaccttttttttttcggagattacacgcctaaaattttgttcctaaacgcagcatcatatatactccataaatcccgtttattggagatcttgatctagcaaggcatatatactaattaagcagtacacatatatatacgtcgttaagcaagtctaaatttggcaaggatgactcccagcttctccttggacagaggctgcacgcacaatagaacaaattaaattaccatatttcatatattacacttacaaagtatatatactcccttaaaaagttatttacacatttatgtcatgtattcctccctgcatggaagattgttaggaaaatgtaactactatgaaaacaatttttatagaaggctaaaatggattatgtgggtctacgggtagtgggccgcctatgaagattatgtttcatagacagcctctttaagtgagccgactgtcataatggatcttcgcagacggacagttatagaacccctaatcacaaatatgcaggcgggttatcgcggctgaaaatagggtttgtttctaaaagatccatagccctcacagtaaaaaagaaagatcttgttttctagtagcgtgtgtgtgtgagagatgtacatatgagacggcattcccatgccattgcatgcatggctgtccctgcgctgcgcgcaggctctcaccttggacgtgaagtcgtcggcgccggcggtgatgaacgcgtcgacgtcggcggggaggccgtcgctcgacacggcgacgatcggcgtggtcacccccatgccccggatccgcctcgtcgcctgcacaacaacaacacacgctagcgcgccgcccgcgccgcgcgtcagccggccacaccagccgccaaatcggccattatttcatccatccatccatccatccatgcgtctcgtcagagatagatcgatcgatgatctcacctcgtggccgtccatgaccggcatctgcttgtccatgagcacgaggtcgtacggcgccgccgcgtcccgcacccgctgcaccgccacctccccgttctccgcctcgtccacgacgtcgccgccgcctgccgccttcagcgccgctctcgccacgacctgcactcaccaccagctcgatcgagccagccattaacgacgatctcttaatcacatattactagctaattaactaagcgatgaattaccctattgatctcctcgtcctcgacgaggagcaccctgatcatcttgcgagccatgaactcttactctgctgctctgcctgcagcagatcattcgcctagctgctagctatatactactcatagcaagcagtaattaacaaagctcgatagctagtagctagcctggttgaactgaactagtagtggaagatcatgaggagagatcgcgctgtccctgttagacgcgctgggctttcacgaagttgcatgggttgcgatccacacgcgatctgcagctgcttggcctatttcctgcaagaatctctctacctccaaaacggcaaaacgcaactacgtgccacgccagccttccacaccgccgctgtccggtttaacctttcatctcttactaacaacgtgtgaacacacatttcataccgctgaacggtacgtttcgtaaaaaaaatatttttatataatatataagtttatatattataagttttttataacataacttcaattttatactaactctgtagttttacgataactttattgttaaatctgtaattttacgatacttcaccttaaacttgtatatttgtgataaatttagtgttaaatctatagttttgttgtaaatatagacacatattaatcgtcggtgtttcaactaatcggtggttctcttttcgtcaaacaaaccgtattccatcattgctggaaattgcacacttccggaagttatagttaggttgcattaatcgttatcttggtttggaggaagattttcaatgcacgtaaaattttaaaaaaactcattaacacataattaattaactattaactattataaaatattctaatagattaaagtttgaagttgaagaaaaaaaatagagtcttaatatctcgcgtccacattgttgcgattgcaacagggatatgtgtacacgtaaaaccgcttacgagcttagccaagctttggggttggtgcaattgtgcagagatcgtggtgctaacatcgtcgatcggacggctggggattggatcagatccacggcacgtgattattcttgcggaataagttcaccggaggtcccttaatttaacggcgagattttttaagacctcttaaccataaaatcagaaatcttcacccctaaactatacaaaaccgttcaccggaggtctctcggcagtatttttgcccgattttactgacgtgacatcctagtcagcaatttttttttaaaaaaagtacttgggcccacatgttagctgcatattctcttttctcttctcttcttcggagaggcgggcagatgcgggtgcggcgaccggcggcggtgcgggcgcggcggggtgtggggaagaagcgggagaggaggagaggagcgcggcgggcggcgcggagcgagctgcaagttgccactcaggtcgagcttgagtagctgcgtgaggtcgccaatcggctaatggtggatggaaccacgacggagctcaacatcacgtcggcgaacatgttgccgtcgaggaatatctcagccaaggtgttgcagttggtcaggttgttcaagaactcccaggcgccgccgtcatcggtcggcgtacggctccgatgagatggatgccccgctcctgcggagcctcccctccctggggtgggcgctcctctcattgtctcccgcgcccgcgcggatgctctccacggcagcatccgacgccctcgttgagatcaagccaggcgagataagcatggtctccgacatccccaaggagcacctccgccgcaaggtgcttctttggacttactctgatttatgtagtgtcgatagattcgctagccctcgcagacccgtgtgggaatcgctcgagatgtctaggtttggtgggttcttttggttgttacttgggttagggatagagcctggaggtgtcggtcgtgaactcgtggtacagactacagtgctattgctagttgatgttcgaatcgtggagtagatagaaatgcgaattcggtgatgaagttttacacttgtatggtttgaactgcgtttagaacttgggaggaatgtgctggtccgcgcgcgcccacgtcgatcggctgggagctcgccacggaacacgttgttcacgagtgtgaggcctcgcaacgacgtcatgttgaagaaactcggcgggatctctccagtgaggctgttatgcgacaaggctaacatgcggagcgctgggaggcttgacaagccgtcggggatggaactttccataaggttctggtcgaactcgagctgcacgatcttcgtgaggttcgccagcgatggcgggatgtggccggagagcgagttgtggctgagccggagcaccgtgagattcggcaacgcgtcgagccaccgtggaacgccgccgacgatcgaggttgttgttgttgaggtacgcgacgtcgagggcggtgcaattgcggagcgcgtcaggtatctcgccggcgaacgcgttgtcgcataggctgagataccacatccgccggagccagccgaggccatcggggatgctcccggagaaggcgttggaggtgaggttgatgagtagctcgagctgcgtgaggttggcgatggctggtgagagctcgccggcgaggcggctcatggacggctcatggacacgtccagcgacgtgacgcaccccgccgcccgcttctctgcctgcggccgcgttcgcgcccgcctccactctgctgccacgctcgccctccgctgctccacctgccgccgcctccctcgctaaagaaaaggagagaggagagaaaagagaagagaaggaaaagaaaaagagaagaaaaaaaaatatgtgcagctgacatgtaggccccacgtactttttaaatttttatttgctgactaggatgccacgtcagcgaaaccacccatatatactgcttagggaccttgagtgaacgactttgtatagtttagggtgaagatttctagttttgtggttaagggacctcaaaaaatctcgctgttaagttgagggacctccggtgaacttattcctattcttgcgcatcccggacacaaccgggccagtgttcaactcgtgtatacgaatgcgtgcggaagcccacgggccaaggcccatagttgttgggccctaaccagtccgtactcgtacaggaataagttcacttttggtccctcatgttaacatcaagtttaaagcacgtacttcaacagcgatatcgggtatagcacatcattttataaaaccggtgtaaataatatcccacggtagtgtgggatccggtaccggtattaactgacgtatgttagtgggtgccagtcaaaaaattgcaatgagctctcctctcctctcctctcttttcccgcttccccttccttctcgccgggtgctttcgccacgagtgcggcgtggtcggtcttcgccgcgcccgtccgcggcttttcgtcgacgagagtgttgcacgcctcgttcgatgtctacgacgtcgacggagacggccgcatcacagctccaccgcgtgtgccgcgctgtacgagcgccgagggtatcggcgccggcaacgacgacgcagagcgcgaggtggccgcgcgctggccgccgccatctcctcgtctcctctctccccgacgccacagccgcagcaaggagaggcgccgccgcctgcgccgctcttctccgcgttggcgccgccctgaagaagagtggagatctcagaggagtgagacgaagtcggaggaagaagactaaagacatgcccctgacatgtgcgccccactgtaaattttctctgacttgcaagtgtcagctagatatcacatgggacgaagacctaattcatgtcacgttagcgtcacgtcggttaaaacttgaaagcggacccaatactatcatcagcatcacatcggttaaaattggactcaatactatcttgagacctgatttacatcggttttgtaaaatgatggatgcgttatacaccaatattgcacttgaaggatgcgatttaaactcgatgtcaaaatgacatgagggatctaaatgagcttattcctactcgtacgggggcctctctgggctctgctctggccacttgatgctgctactggaactggaatctcattaatcctgacaggctgggagtaggagtatcagacagacagctcatcacagttgctctactcttcgcaaactggccgctgctaaaatggaatatgagcattgaaacaacagctttgtttgcttacagagtagggaaaatgaaataaataaatgtcgatgaactcgtgtgtatgtgcttttcgcggttttagttacaaagttattctccaaacttctaactttttcatcacatcaaaactttcctacacacataaggcctcatcgtttggcatattcatatgcttatcagccaaaatttgagttttcaacgtaatatttagagctgattttggggggtttttttatcgaagtttagttttcagcctttgcttttaaatcgctaagaacacatatataaaagttttattcacaaattgattttcgtttgcaaatatgccattcagaaaatatgccaaacgatgaggctgataaacttccaacttttccattacatcgttccaatttcaaccaaacttctaattttaattttaaccaaacttccaattttgatgtgaactaaacacaacctttatttccaaattcatagttctagctaaaaattattcttttctgagaggagaaggtacaattgctatgagctacggtttggttcttgcaggctttgcattgcagcatcactccatctctgaagtctgaagtctgagctgattactgaaggtgagaaagggctgtgtcagtcaaaagctctgctgactctgctcctatgcttgttgtaggagtactagaggacatcagatggctggcgttgaatccattggcttctatctgtcttccttgggaaccaaccatacattaattgcccatgtagaaacaaacgatttatggacaacaaaaataaaacccactggttaaaaagcattttgaagaatattaaggtgatttgatctaatatggaaacaattttgtcgttacggtgattgtggcgcgaaaaacaccttatttctgataataaaaatggaggtggaattcccctccgattaaaagaaatactaacatgaaaatattaaattacacgcgaaaccatgttaaattggcgtgaaaattataatatcacgtcggtgtcggttaatataatttatcccgaatataaagtgtaaattgacaaaaaaattctgtgaagctatcactgtaacaacaggtgcttgggaaagcaactttctggcagctgccgcaagcacgaagatgtcataaccttacaagggaaaccacctgcattttctactgttctgggttagatcaagctgatatgtgcaaaactaccaacaaacaaagaactactactatacactaggagaaaaaatgattaaacgaagctgtcgcgacttcccaaagcagtttggttcttctagtatccgtgtgacaattcgtgttcctgataaaaaagacctgcatcatcgtctcatccgacgttcgtgtcacgatcaagttgacactgactcgatctaccaaccacgggataatcgagttgatttgataatctttcaccaagataagtttcagcaatgttgtgtgtgtactatctcctttttttttatcctcccagctattaaatagccctccgatatcttgctatttaggagtattaaatgtagattactgataaaacctattccataacccctagactattttgcgagacgaatctaacgaggtatattaatccatacttagcggatgattactgtagcatctatgtttaatacttctaaatagcaagatccaaacagggcgtatgaaactttcaaccaatgatttctcttccctcagacaatggaaacaacatgatatatcgtgtaagatgtaagaagctacttgcttcttcagtcccaaaatataacaacttatcaatagattagacactatcgttgctataattttttgacggagagagtagccatcattttcttgtatgcagtactccagttattttttgtcgtgaaaaaaataaataattgtgaatactactgcaacttaaacgtgcatatactgtaataatactgtatacgatacatatacggagaaaaaaatacggggagctgaaaattctcccaggtgcctctcggctacgcgcacccggcgccgcccacacgcaatcgcctccttctcctcctctctatttatacacacaaatacgccaataaaaaattagacttacctcctcagcctccccacccacgcgtctcaccggagctccgccgccgccgccgccgttttctcccgtcgtacgacgctgcgtgttcccgagtctcccttccgccgccgccctccggagccggcctgagtttggacgaggttgggagggaggtcgccttggacgaggagggggaggaggaggaggtggtggtggtggtggggcggcgccgtcgcggggggagatgggggccgcgcgtggcggggtgcggcgcgtccggcgggaggcgctcgtggcgtgcatgacgtgcccgctctgcaaggggctcctccgggaggccaccgccatcaccgagtgcctccacacctgtaagttctctctctctgtctcccatctatcccgtgtctctcccatggccgtctctccctgcgcccgcggttcgccgcgccgccgcgtttggggggcgcgcgctcctctcatggctttctctctcctggcgccgccttgcgtgggttctcgtggcgtggcgtgtcgactgcttgggtttcggtgtcggattcttcgtgtttgatcgaggctggtggtgccccgtgcgagtttctcgatcccgggagagcggcggcggggggagcgccgcctttcgcctggatttgctgcttccggttgttttgcctgcttcggtttcgcgtcgcgttccctccgtggtgttcagctcgacgccgcgttcgcgcacgagcgcgcgcgcgcgcttgctttccccgtggccttggctggccggcgttgtggttggagctcaccatgcttcgcgcgtgcgtgcgtcgtgttcagccagcgtcgtgtcgggcgatggctcgttccacgtcgccatgcctcctccgcctgtgtttcttgttcgagttctctcctcgaacgttctcgaacatcccatggcgtgcagtggtagctccaaacgagcaggtttgtaaccatggattcggtctgctttgtcgtcgtcggcagagtaacagttatgctctccggaggccgcggtcgccggagccactccggcaacgccactcgccgccgccgacgccaccctctgactatagttttctcctcatgctcttgctccatcgcgtgccagcgtttgcccctccggcgctgccatgaccgcgatcctgtcgactcgacaatgtagcaaagctgctgccttaagccaatccaggcagcctctcatcaccgcggccaaagccttcttcctttgagtagagttcatcggcggtggtcgctgttgtcatcctcgtgatatggcgttcgggtccaaattccctcaaagtctgaagtctgaagaaaactttcgatacatgttttctttcggagctttttggtgctgggaaaaagctgtaaagcgtcagcacttgctgcagaatgtatgggggttgtgcggtgttggcggggttccagtagcttccttactgttcgtgtttgctaacggtgggggagcttggaaatggtgggcatttttgcactgattgcgattaggaacacgttatcattttggttaaatgaccgacaccgatgatggattgatgggagttcagtggaaagcaattgtgccatggaatatggttttcccggtgttctggtcagtgtgaccaaatgagtttgcgttaggaaactagttcagatttatgctttcttgattggtccataatttgtatctgttagccacttagcctcttggaatttttcttgttcgttagtcgcataaacttgcacgctgtttaaaaatgcaacttttgtgtaactttactaaatgtttgctttggtctatgtttttggctggttcacctggatatgtttttttgtggtaagttagaaataaatgtaatgtaattatgtaaagtagcgagttgtcggatgttgatctagtggtagaaaaggtgattgatagataagaaaaaataattgcttgattagtgaatgctcacttgttggtatcattgttgcaattggaagtttgtgtcatttgtcatgctatgaaccagatgattgctaagtaggcctagtgcttctgctgcagtgtagatgttaattattgatgcatgaagccatgaatacgttgttaggaaccagagtagaggcagtgctatgctagagtttgcatgtttttaccaaatcactaaaatcaactacgtagtcttagttcattgttgccacttgctgctaaaggagttctcatgcttggtctgaaatatggtagttctgttttacctctgtttgaaactggcatgttctctttatagttactcgtctgaccatttcttaaacagtttgcaaggagtgcattatggagaaaatagatgacgaagaagtcgatcactgcccagtatgcaacattgatcttggctgtgatcctgaagagaaactcaggtgaagtcattgttaggtttcttctgtgaaacattgtctgctctttttacaatgcattctcgacttccatttcgtgtacaacccattaagaatcatcatcatttgaacctccagagaccagaggccatgctatctctaattgattgtgataacacagaacttatctgacaaacttgaccagagaggataaaatggtgatagaccattttacccattcttgagttctctagcaaacttggccagaaaaatatcatatttattgttagtttgttggtttgtcctcaaatacatccttgcttgtattgtaaagcaaaactgtcaagattattcatgtttaatgtgttgtattcatacctaactttggtttctctaacatgattgattgtttccttgtttgaaggcccgaccataatgttcaagatatcaggaataaggtttttccacttaaagtgaaaaaggttggtgctcctaaggctccaactgtgacattgccagtaaagagaaaacagaggtcactttcttccttggttgttgacactccgagggtggcagtacagactggtttgacaggacggagaaccaaaactgcgagaaggacagcagtctcccatgtaaactctcctggtaataatggaaccatcaagctagcaaataaatctgaaggtcgagatcataaaactcagaaaatctcagcagcacaatctgccaagatgacaaaaactggcaataaaaagaaggtaatatcaaagtgttaattacctggtttatgtgtagaatcagatggtttcatgcttaagtttgatctgaactgtcttgtatattggattaatctaactaaacattccactcccaaacagaataatactgatgtagatgtcacaatccagtcatcttctgaagataggaaggatgatcatacaattgacaaggaagatctcaagaagcctttaaatagcttggttgacactgcaaacaggacgaaattttttagatcaggtcctaaaggccaggctgccaaggaagacaaaataaaaaactcaattaagttactggcagaagatgacacagaagacaaactggtagttactggcagaaaggttatgccatgctcaaataagttaaaagttaaagaggaaaataatcgcagtccttcacaatctgcatcatcgaaagataaaaccacctcagactatgagctgaggaaaggacaacatgctgattcacagcagggacagattggttctacaagaactggtgctttgcatgatggaataactagaccagtatggtttttgcttgtcccttcacctgaccagtaagtttgcatcatatccaatatttgggttctcatgggcatttcttttctccccttaatttcatatcaaatgtaaactatttttcaggaaacaagatcccaggctgcctcagctaccaacatattacgtgagaattaagtgagttccccttggtcctgcagtttcttatgatttttaatatgctacaaagaagcctgttggatttaggatcctattattcctgtgtggaatgttaagctgcttgttttaggttgtccagtgtggaatgccaatagtgttatttccttgttctgttgtccactaattattgcaactgcgtcctactatttctttatataatttaacagtatatacttacaaaacaaatttgctcgagatgaagatgtttccttgaaaaatattacatacttttttatcactactaccaacgatctgagctatacaaacatgtgtccgatttccaagaacttctatttattttcttcaatttgtgttttgtccttgtttcagagatggaagtctgcagacttccttgatccagaggtacatcatgaataagcttgacctagcaagtgaagatgaggtaagctttcagatttctcttttcagttcaattgctataaagacatcagttatgcaacatcactcactagactggtatatacgcaaagtagacggttggcaaacaactctcaactatctttgctacagaggctgttgattttgtagatttggatggtgacatatgactggcctacaatctttagctatctctacccttcaaaagtgggctctgaatttgtcctctgtaaactagcctttcttttttttttttttgcgggatgtaaactagcctttctgttccatgtttcttgacaacaacagcaatgcacatgaacagctatgaatctgctcttttgcctgatccctctattctaatctctatccgcaaatgcaggtggagatcacatgccatggcgaggcaatctccccctcgaccacattgcaaggcctgctcgagctgtggctgaagagctcgccggtggagcaggtccaggcgtcgctgggcgctcaagccaaggagttcgtcatggagctcggctaccgccggccacagcggcctccttcctcttagctagctgcaacctctactcctccagtgccacaatccatctgctgcaaaatctgcaggcaattgcaggaggaaagaagactctgaaactaccgattcatcagctcatatcatgttcatccgtcagtcagactagggtaaaaaaaaaaagagaagaaaaaattacacctttctcatttcttagatcatgtaaagagggacaaaagattaaaaaaaaaggtagaacagtgcattaggctactaagataatctaaaagggtaccctaactatgtcttgtttaccatccgatgaagttttcaggtgaagtcccatctcctgtgttaacctgtgctgggcctgtgtgcgcgcgtgctgtgctacagtaaaatagtaattataattactgtagtaaattagtcagctgagtgagatggtctatgctggttttgtagagttgtagtaggagtagcaactgtccatcagcttgtctcgtagcggtctactggtttggctggtttgaccagtaacggtctctgtctggggctatatctgtgcattgtgctgtgctatactgctgtataagcgtacacggcagctgtgctgtgctatactgctgtatacgcgtacatggcagcgactggctaccggcacacagctcatgctcctcacgcactgaacaccagggttcgacttaccgttggttaccggccttactgcgggagtacgataatagaaaaaccacagtaacctctttaaattcaaataaatttaaaaaataatttgaatttttgataaattttacacggtttcgtactgttttttacggttaccgcctggtaaccatgcttaccgccaaggcacagtaaccccagccccgacagtttgggaaaccctgctgaacacgcagttcttttcagctaatttagtggattatcattgtcacaggatcttgaaatacattttcttttttaaaaaagctaatttgtattacttggttttaatccatttgttaagtttttccttacgatctttaatttattatccatacgatcaagtagataatctacaacaataatctgatgaataatttgtttcaaacggtcccccgtgttttacccttagactccctctagaacaaggaattccgtaaaatttaacaggtattgaactaattcatataaaattttcacgttgcaaaagatcccttaatttgttatataacgtatctattgttttacttaacataatagaatccttggagtcaaactttgtaaagtttggtctctgctatatttgaagccatctattttttgttgtatttttaattgaataactagaattctggttagagatgttttcacaatattatattttatcattatatcatacggtttatgcatgctacgaacaaatggctcgtattctggaatataggctgtccatctgaaagaaattggcgaccagctttctggtgcttgtgcttgtagtaggacctgttctgatctgagcagctcggctggtccagccgtccaggaaacaaaaggccaacatcattcattctcgcccaagaaaagagaggctttgttctgagcgaagcaaacatatgctaaggactaaggaataaggattcatttagaaaaacaaaacgaaacaaatgctaagcaacgtgcatacaacactgccacggagtggttttgacatgatcatttttggttacttagatcatacaatgtgatggcatttagaccaaagcagtagaacagcacagaagaagtttcttttcgctgagaataataaacaccaactagctggaagattcttcaatgatacacccttgtgatccagccaaaacttaaacttttttcttttcttccctgcagcaattcaattacgctttctatattggtacagaaaattgcaactacagaaaatttgagaaaaatgaccaaaagaaagtttctttcttccttttccttggttcagaaattcagccgttctcaagatacaggtgataaaccagaccaccattcaggtgaactagcaaaagtgtgaacagtggcatatgaggcaccatcaaacattcaagctgcaacaaagtttgcacagtgaaaagccaacggagcaaatggggcataggcactaatctgccttcaatcttctcctgtccaccagatcgaatctttagtgattcagaccaagaacagtaacaagtagaaatggatggattttggcatttcccccttgtatccaaagccataacattggaaaagaagtcacatcagaacaacacaatctccactgatgcttccccaaagcagacaacgagagaacacaaacataactgagatatttgcattgccatgagtccatgacagttaccacacaaacatagatggatcgatggacatgcaccaaacattacaatttacaaaagattatgatgcatcctatcaagcagatttcactttctatgtttcaacaagaggcacaagcacatcatacatgtgcagaaaaaaaaaagagaagcataattcacaaagcgaaccacgccataagcatgagcattagcatttgcaagataaagaatcagattcaatggccactgcccaacatgtatagcatatttgcaaattaacaccaccaccatactaatttactcaattcagttgcgactcaatatgttcatagtatgatcacacgcaaagctagtatttgtacacgctaacaaaagaatcaacaaacaccgtaccatatatatcatcaaagatcaaatcaactgctaggtttgataattacacagtataaattccagccaggagacacacacaatcattcatagctaatttgcaaggcaagaacatcaattagctacgagtgttggataaagagattgatgcatcttggggggatatcatcataccaagccgagtagatcaagcgatgcgaacgtaggtgggcaagattggtccggcggcgctcatgccggcggccaccaggccgtcgccggcggcctcctgctcggtcaagaagaggtcgtcggtggagcggagcgtggcgtgcgcggcgacgagggcggcgccgatcatgaccgagccgatgacgttccagccgacgttggtgaagagcagcgcgatgacggtgaccccggtgagcgcggcgaggacggtgccgtcctcgaactccatcccgaggaggcggagcggctgccccgccgacgacgcggggcgcgcgaagtagaggaagaaccaggcggcgcagagggcgaggagcgcgaagagcgtcccggggtgccagagcagcgaggccgcgacgacggcgagcacggcgagcgcgtagttggcccggaagtaggccgcgttccgccgcgccctggccaccgcctccccgacgctgggcggcctggagaaggccggcgcccggaacacctccccccacggccgcctcgccgcgatgagcgcctgcccctgctcccggaacctcgtcaccagctccgccgccttggcgatcggggacggcggcgccgtcgggtcatgcagctgcgcgggcggcggcggcacgggctggcccatcaccggaggaggcggggcggcggggtaggcggagggagggggcgggtaggtggggatcttggcgtaccctcctgctcccgaggagggtgaggcgtaggagccgtacatggcggcggaggccggcgcgggctgggcggcggcggaggaggtggagttgcgcatggtggcggcggcgagatcggcgagcggagacagggagaggggatcggattgaggaaagttgtggtggatttcgctggattcgcgttgggctttcgctttgagtttgcgtttgcttcgctgggattgtggggggaacggacggcgtggagttgtggagtcgcgcgtttttaacgacggggtttgcttatcggcaaagcaccttctgtctggctcgtctttggtcatcgcatcgtatcgtgttgacgttaactagagtttttttttgttttccctcttcgacttgaatttcccatgaagttactaattttccatggaaaatgtcccttttatgtccctcaactttgggttgaattttgttcgcattcctcaaccgtaaaaccggatataaagcaccccttaaccattaaaaccagtataaatcgagtccctagatggtattatcatctatcagtacagagaaaaagtagatgttatggaagaaaaataaaaaatagtggaccttcgcgtcagccctaatttcttccctcccatctctcctgctccatcttttctaaccagtcattgccaatgccacctgacggccgacaaggatggcttcaaagagttgaggtgccgaagcagtgcgagctcacagaacgtgatcaccacggctgcacggttgtcttcctcattgagctcaacaatcatgtcgcccacgatatggacaaacaatgtgcaaattgcaagggagcacgacgcagcacgcagtgtcgctgggtcgaagagaaagtagagtcaccggagtcgatgtggaatctcgctggcggcgctcctcccttcgaatctcaccgtcttcccagaacttcatcgcctcgcccgccgccccctagcttcaccaccaagacgcctcggtcaacaccaacgatgacggtgtcatgctggtgttgctcccgatgtagtggggcaggcggatgtttagagttgagcccgtccccattgtaggctcgcatttgtcatcaagggccgcttgcacaacgacgtgggacagatacagggccgtcttaggggcataggctagttgtgcgaccatctatgacccaagccggtattaggcccatcaccaaccaaccacaaccagtaccacaccttatttcctcatggctaggatttagagtgagatcttgtgatcatctcatcttctcatttgcatctatctaatcc

SEQ ID NO: 59545 - DNA, 7919 bp, Oryza sativa
  unsure (1)..(7919): unsure at all n locations
acatatatatgaatgtgggcaatgctagaaagtcttataatatgaaacggaggaagtacttacttcagattggattaagcaaattcgttttatttactactttacatatgtaacatgttgcagatattaggactggatatatgtgcagacacgatggtaggagatgatatggtgaggggtatctccggtggacaacggaagcgtgtcaccacaggttgaaaaatagaatttcactttcagaacatgggatttgctggacaatgttttgattgactgtttcttccaggtgagatgcttgttgggccagccaatgcacttttcatggatgagatatcgactgggctcgacagctcaactacatttcagatcgtgaagtcgctcagacaggccatccacatcctcggtggcacagcagtcatctcgctgttgcagccagctccagagacatatgacctatttgacgacatcatactcctctctgatggtcagattgtataccaggggcctcgagagggtgtgctagaattttttgagttgatggggttcaaatgccctgagaggaagggtgttgcggacttcttacaggaagtgagtgagtctactatcttcaaaaatgtatatgcacaaatttatcggttatttatcaacatggaaataccgaacaggtaacttccaggaaagaccagaagcagtactggatgcagcatgacaagccctatcggtacgtgccagtcaaggattttgctagtgcattccagtcgttccacactgggaaaagtatagcaaacgaacttgctactccattcgacaagagcaaaaatcatccggctgcattgaccacctcgaggtacggtgtcagtgccatggaactgttgaaggcaaacatcgaccgggagttcttgcttatgaagagaaattccttcgtttatatcttcagagcctgccaggttgttagggatccattcaaacaaatggagtattagtatatttgagaaaacaaacaacatcatacgactgacttcttgttgaattgctatggcagctgatggtggtgtcggcaattgcaatgaccgtcttcttccgtacaaagatgcaccgtgattccgtgactgatggagtcatcttcatgggcgcactcttcttctcagtgatgatgataatgttcaatggtctatctgagctaccgctaaccatttttaagttgccagtcttcttcaagcagagagacctcttattctttccagcatggacctacaccataccctcatggatcctcaagatcccaatgtcctttattgaggtcggtgggtttgttttcatgtcatactatgtgattgggtttgatccgagtgcaggaaggtgagatttttggacaaaatcttatttggtcagtataatttatccaatttctttcactagctattctttactcctgaactgttgcgcggcattaggttcttcaagcagtatctgcttatgttagcaatcaaccagatggcagcggcactcttcagattcgttggtggggcagcaaggaacatgatcgttgcgaatgtctttggatccttcatgttgctaatctttatggttctgggtggttttattctagtaagaggtaaaacttcatctctgtactatgtagttcttctcattgttgcattttttagtaagtcaggttcttattcatgtatgtactggcagagaaagtgaagaaatggtggatttggggctactggatctccccgatgatgtatgcacagaatgccatctcagtgaatgagtttttggggcacagctgggataaagtcttgaataattctctctccaatgagaccctaggcgtacaagcccttaggtcccgtggcgtcttcccggaagccaagtggtattggattggctttggtgcattgctcggattcatcatgctcttcaatggtctctttactcttgcactaacatacctcaaacgtgagttccttccgaattggtttgcttttgttttctttcttttcttttgaaagaaaagtgtggcaaaagctctgcatcatttcaagaaaatagggagaagataatgcaaacaaaccgaaaatatggtagagactaaacaataagacaacaaaaataaaatatgacacagcaacacaaaaaagcacctcaaatcatcaaagtttgttcattgttcttacctcagaacggttttatcttccgattttacattacagcctatggtaagtcccaaccatcagtatctgaagaggagctgaaggagaagcaagccaacatcaatggtaatgttctagacgttgataccatggcatcaagtactaatctagcaatagttgacaacacggaaactagttcagaaattgctgataattctcaacctacacaaaggggtatggttctcccttttgctccgctttcactcactttcgacaacatcaaatactctgtcgacatgccacaggtaacatattttaattccttaacttatattgtccaccagtgagtcattaatgacaattttgtcgtgaccttttgtatcaaattaaaattcaaaaatcaggaaatgaaagcgcatggaatagttgaggaccggttggagctcctcaaaggtgtcagtgggtctttcaggccaggagtgctaactgcgcttatgggtgttagtggtgctggaaagactactctgatggatgtgttagcagggagaaagacaggtgggtacattgaaggcaacatcaccatatcaggatacccaaagaaacaagagacatttgcacgtgtatcaggatattgtgaacagaatgacatccactcaccgcaagtaacagtctcagagtcactgcttttctcagcttggctacggcttcccaaggatgtagattcaaacacaagaaaggtcagtcaaaaaaaatatttttaattccttctctcagcttataatcaattgtttaaattgtttttatttttattttggagaagggtatttcttacccggcctctacatccaaccgaatatatgcagcctttttaaagtaggaacttagcctatcaaacagggaacttatctctcaaataacctaatctgaaattcgctcctatagagatttgaactcaggactttcgggtgctactcaggtcactgcaaccactaagctacatgccctttcaactgagcagagaagggtattgtttaagttgtttaacctttctctatgcagatgttcattgaggaggtgatggagcttgtggagctcaagcctttgagagatgctttagttggtcttcctggagttaatggcctctcaactgagcagaggaagaggttgaccattgccgtagagcttgttgctaatccttcaatcattttcatggatgagccaacttcagggcttgatgcccgagcagctgccattgtgatgaggacagtgaggaatactgtggatactggtagaactgtggtgtgcacaattcatcagcctagtattgacatatttgaagcatttgatgaggtgagcataccttggaatatctgctacaccttttggtgaactcttatcggttttgtaatatggaataactgggttaacttattaaaatttaacttattttggctgattttccaaacttttaatgtgaccaatgctttattgtcctaaactttagataatgtgcagggtcctaaatgttttattaattattgcagcttttccttatgaagcgaggaggagaagaaatatatgttggcccgttaggccatcaatcttcagagctgattaagtattttgaggtatagtaatgttataaaagttctaatatacctctttttggtttgttcgatactgttgttaatcttatattgtttcgtgttctcaagggaatcaaaggagtcagcagaattaaagatggctacaatccagccacgtggatgttggaggtgtcaacaatttctcaagaacaggcattaggtgttgatttttgtgacatatacaggaaatctgaactcttccagtaagtaattactattatgttaaatcctgtaaatcaaatagttgactcactttgaatcttggtagtgaaagctagaatctccttagctgctttatgtatggtggtgacaaaccaacaagagtaaataagtaggcttcaatacagttggtcagatttacatggcttctacagataatgcatcatactactgcaagtatgctactaacaatttagcttgtgataaaattcaagacaatcggtttgttcatgccattacatattgcagttttcggtagcattggactttcttttctccaaagcagttttgttgtggctgaacttgcatcaactattgccagcgtcttaacttgctggttatagaatgctagcagcattgtcaaggtttgatttcagaatactatgctatatagcaaatggacaagagctagagtggctccattaccactgcagctctacaacaaatagtggtagtgtgctccacaggtcaaattcatattactactgcaaactgttgtgcgacatgccgacatgagtcattttcacatttcatatgttcatatgtttgaagtttcaaaggttttaaatttcctgataatttcttttttttgcatttatgaataattaggaattaaactaagcctcttttttttgaacgaactggcacagagtgtgccagtttcattgaatatagtgggagtaaaagttatttacaggtgtgaaaggaaaaaaaaactatacaaccattatcgacaggacgctagatttacaggaggagctgtgttagcttctttgcatccgcgagtacccatgttttcccttccttgattttcgctaacagaattaagctaaggctgtacttctacatggataaagatttgctttaatatcttatcatcaattagattaccatatagctatgatacacacatgtttgccttttatgcgcttcatgtacacttctgagttttcagtggacatccaaaagtgtgaaattagaagtgggaagatttagtatgacctctctgaaaactttttaactaagtggtagctgtttccaacacattgctatgaaatatgataattgcaatctgaacattgattactgccatttataggaggaacaaggcattgatacaggaactgagcacaccaccaccaggttcgagtgaactatatttccctacaaagtactcgctatctttcttaaatcaatgcctagcatgcctgtggaagatgcacctgtcatactggaggaaccctccttacaatgccataagattatttttcactactgtcatagctctcctctttggcaccatcttctgggatcttggcggtaaaacgtatgtaccctaccttgtacatatcaagcatatgactaaaccatcttcaaaatgttatttatgcgccttttgcttcttgctccaggggcaagtcacaagacttgttcaatgccatggggtccatgtattccgcagtgctttttattggcgtcctaaactctcagtcagttcagccagttgtatcagtggagaggacagtcttttatcgtgaaagagctgctggcatgtattcagctttcccgtatgcatttggacaggtatttgtttttttagactctcggttggcctagttctaatctcatgtatataatgtatgacttcaaagactctgatgcgtgaattctgacttgcatttgggattgaactgaaatggctgtgcaataagctattcgttagcactgtcaagctcttttggtcccataacctaacaatgccacttttccctttttaggttgcaattgagttaccatacatcatggttcagactctgatatatggcgtgctggtatactcaatgattggatttgagtggactgttgccaagttcttgtggtacttgttcttcatgtacttcacactgctatatttcacattttacggaatgatggcggtagggttgacaccaaatgagagcatagcagcaatcatctcgtccgctttctacaatgtgtggaacctcttctcaggatatctgatccctcgaccggtaggttattctcccatctcaatttcgccccctttcttttctcatgaaatgtcgcttttattagtcctttagaaccgttttaaatttctctacagaaaatccctgtttggtggaggtggtactgttggatttgcccggttgcatggactttgtatggattagttgcttcccagtttggtgatatccaacatgtgctcgaaggcgacaccagaactgttgcacagtttgtcactgattactttggcttccatcataacttcctgtgggtggtggccgtggtgcacgtcgtcttcgccgtgaccttcgccttcctcttcagttttgcgatcatgaagttcaacttccagaggagatgagaaagtgatcattcttttttgcattcgttctattgtactactgaatagctattagctatcctgtaaatggtatagagatcatcttctagtatttcattatttcaagcatgtaaaaattcggacatctagtaggattctctaggaaaaagaacccttgttgagcttcctgcctcttgaccagctctagctgataaatgtcggatgcagatgaatgtaaagtatggccttcaatgttttcatttttgtcgaattaatgaaagcagaaaatttgttgattcaatccctttgcagcaactcttcagaataacttttgttccattgttctatagatttgactaatagcggagtaaatttttcacaatgcggttactgatcttgtagtaatttactaacaaaataacctctatttttaaatatatgatattgttttcttttgaacataatgtttcactatttttaagaattatttattttcttgcattttattatgaaaggtatttaaagcattaattttttttactaaatttttaaataaatcgaaatggttagaagtcaatagctgcgaaagtaaggcctggtgccctggtttagttcctaaattatttttcccaaaaacgttacatcgaatatttggacatatgcgtggagcattaaatatagataaaaacaaaaactaattgcacagtttgcatagaaatcgcgagaagaatcttttgagcctaattagtccatgattagccataagtgctacaataacccacatgtgctaatgacggcttaattaggctcaaaagattcgtctgtggtttccaggcgagttatgaaattagttttttcattcatgtccgaaagccccttccgacatctgatcaaacattcgatgtgacaccttttcgcgaactaaatagggcctaatacttctgtcatgatgtgcaccttctgttnnnnnnnnnnnnnnnnnnnnnnnnnccccacataactttccttttgaatttggggatgctagttggcgcagctctgcgtcaactttcccaagtcacacccgctgcgaggctgcgaccctctgtccccatctctcccgatgctaatgttaatagtatttttcctaattaatttagagttgaaagcttttcaaatttggaattaaaagtttcagattctggagtaagttttgaattttgatttgaaagttttggattttgagttgaccggcgaccgcacgatatacggagaccatgagctctttcccttccttatctggaggtgttcgctggaatcggaagtagcgcgcgtgcgctaatatggcaatttcgttcgaattttgaccggcgttaggtttcgctttacccgccactcccattttttttcccgcgctttctcgttcccgccaatccgactccgagtctctttacaactgcgtacgggccaagcaaagcgtaagcctcccgagctccatctcgacttggtcggtgcgcccataaattgcaagctccgcttcttcat

SEQ ID NO: 59546 - DNA, 25522 bp, Oryza sativa
aacagaaagagagaggaaaaaaatccccacctttccatggcctccagctcgaggacgttctcccccccccccgaatgaaccctccgcctccgcgctctccgccgccggcgcatcaggggtcgtaaccggtgccctcctcctcggcggcggcggcgggggaggaggaagcttctcgagcctgcggctcctgagctcgaggtactctcctccttgcctcttctgcagcgcgagggagcgggtgcgggtgcgcaccccgagcggcgcgggggcaacggcggcgagctccatgactgcggcggccaccaccttggcttggcgcatgtacttgcccatggctggccttgcactcatacttgttgacggtcgttatcgatcagtttcaaccgtcaatattactaaaataggagagaactagtgatgcttgcaatgcataagtatgttagaataataatattccactagtattaggtttactaaccttttgcagagaatgatcataaagtagaggagaatcgacatcaactcagacgataaatcaatcggacgaaatcgagaaccagacttgacttgtgtgtgaataggccaagaactcagaattgacacgatgaattgggccaaaattcacaagtctacggaatagagcaatagaggaggccaccagccgaaattgggctggattgggccagccccaggttcggccgaacccaatcctggcgccgttgaatccaggttttggcatggacgtccaggattgcatcccaataatggttggagggcacttcggataattccccttccacaaccatcataactacctctatataaggagctcactctcttcacttcaacacacaccttaagcaatagctctctcatttctctcaagtttagtttagtagtatctagctagtggaatagaattagaataggagtcaggagtccggaagccttcggaagagttcgggtatggctgtagtagcttttctcctcttttgtaagctttgtacttttattagaatactcttctatatacatttatggtattgaaatactttcacctattttacattatgttcatgttatactgaatatacggctagcttatctagcagatgctttggtgcgggtataatgtttgcttatgcaattgctctatgtcgtgacgatgatattagggtagtatctggtagtttagacgtagtgtctagattacgggatatcattatttggggttatatattgcgaatgagaggtgggctgctgatggtgacagctcactacgtgtattcctccgcgcctatatataatcctaagttaatttcctggggaggatattcctccgtatttagccccggttatatggtcatgacgggctgtcgtaaggaactcggcagtcaggggtggcttctcgaagtaccaggagggcatcgaatagagggtattagctagtatatcagttaactagaatgtatatatactatgtatactagaagtatatgaatagatttcctttctcttttctttcgatttagcttagatgatatattatgaggatgagtagttaaatgcttgtgtgtcactctacccttggattatcttaaccactgcttagaatatggttatcacaagtaatatataaattattagttgagttctctatacatgatcttcccacgggataaaataaatacgatatccttggaatactctcgggtgaaatgctacaatggtatatccgtgcgattggggatgaactctgtaaccataatataccagaagtatttctgcgccattgctggaaaatatatttctagtaatgtcgttaagaaataccaacaatactcgacgagacgggagagggtagaggaggggtagtcggagaggaagtcgaggaggcaggggaggtgggggcgagcgcaggtgcaggggaggggtgcgccgaggagcgcgaggatgctggccgcggcggaggccgccaccgcaactcagaggcaagcccagactagtgccacatcgaggacggcgccatccaccgctccgccacgcccgccgcaccggggcactgtgccataaccgcatgcttggcgagcttccaccgacaagtggggcggcgaggacttgtggaagctagagcccgtcgtcgacctcatcaaccgcggcgccatcggcatcatcccaaccgcttcctctcccgctttgccccaccggcctcctcccccaaccgccgcctcatcgcccgtcgccgaccgccggactcccgcctctacctctgcggccaccgccgtggtgcccggccccgcctccgcctgcgtgcccaatgccgcggcgcccacccgcgtagggccgcttcactagcggcggcgacgcagacgccattcgcgtccgagagaagagaagagaagagagaggagtaatggagaggaggggtaagagagatgacgtggcatcctgacatgtggggccacgtgggtctcatgctgattcagccgccacgtagtacaaaaccggtgtcaaaaccaccgaaggacctattgtgaccggatttgattagttaagtgatgccggatatctggttttgtggttggggaatgattttataactcgatgacaagttaagggaccttcggtgtactttttcctaatttgtaagggaagcagaagaggggcaattgtcctcataagcactagagatattgaagaaatgttgaagaaatgatcaaatgatttgaattcaaatattataaaaataatttgagaatgatgatttaccatgtgtatgtttaattttagaatgaaataaattgtagatataattactactccctccatcccaaaatttttgacgccgttgacttttttagacatgttagaccgttcgtcttattcaaaaatttgaagtaattattaattcttttcctatcatttgattcattgttaaatatactttaatgtatacatatagttttacatatttcacaaaagtttttgaataagacgaacagccaaacatgtttaaaaaagtcaacggcgtcaaatatttagggaaggagggagtatatacttgcatgttgtatgttgaactttgtgtgcttaattagttcatgtgacatatttgcatgtaggttttaggagtgctaataaatagttaaatactatgcttgcatgttgagctttagattattagtgggtattagtcttataaaagaagagattagaacgcacgaatgtggtgccgtttcaagtaggtagaaaaacaaaaggactgcctatatacttcctccgtttcacaatgtaagtcattctagcattccccacattcattgtgaaacggagggagtagtattttacataaaaatcaccttacatatcttataaattccagaacattgaatcgctttaggattcaattttttagatattggatcttttattaatctggcctctatattcacatagcatatacacaaccaaaacctacacgagtcctttaactacaaacctcacacagaggaatacacaaacacacacaaaaaaaaaactagaagacttagctttaacctttatcaatgacttactctttccaacgcagcatgagaggagaagatgagaatcgaaactagtccaaactgcctgttatcacaaccaccatcttcgtctctatggaacacaaccaccatcggctgcttgttgttcgtggtcatcacggagctgtccagcatgacatgtacctacctttactgtcatgagcttgccggagatgctccacaatcgtcgatatctatccgcagctagaccttggtgccgacgctcactgggtagctaccacctctagggtactaccatcgaagagtgttcacagtcatcgtccttatctacatcaggcaagctgacaatcatctcaccatcaccgacgaccaccttccctgtcctcacttggccatggtcagaaccgggtgacggagctcgccaagtcatcgctgccctaagacgccgctaccgagagcctccatcgccgttgtcacaaactgtcgtgcacgaaccaagcatccaccactgttgccgtgcacatcaactgacccgctgtcacgagggagggctagccccaaccactgtccgtggccaccaaccctcaccaccggtgaatagaggaagggacaaaggacttatcccataaccactacccaacaccaccgctactcgccgccaccacaaagggaggtggcagtggaggcggttgttgcaggtcggcctagcgctccagttatgtgcaacgaaggtgcgatggcagtgagggcgcacgatgtcagtgttcagaacaccaacgggcaccaccggtgccatcaccactatcgcaccggcaaaccattatcagacgccgctggcaccgcttggccgtccgctactggtcattgtcgccaccaccatcagcatcaccactgccgtgtcactctccagatacaagtgagcctcgctgggcaccaccacacctacatgaacaaacaccatcagatccggagcttcctcaggcagctactagtggatcctgcccttagcggcacgacggccatcaagccgccaagaaccaagccaccaccccaccgcgcgcaagcagggcccgtagttagcgacttgtgtccagcgcgatatataatggtttttatgatattattattatttatttagaactaaagtgtattgaatagaataatttgccttgggactatgtaatcgttgcttgataggaccaaggaagtagctgttgatgcggtcgtgtccggttaaacatggagcgatgcgttggaaatggaccaattggaaacggacgcagcaagtgtcggtccaatgtcacgcacgcggaagagcgtatcgatccaatgtcacacgcgcgggagagcgacctacacaggcccaacacgtgcgaaaccgactaaaatgaggagacgaaccgaaatcggtggaggagcactatgtaacttttagacagaatcagattaagatacggacgccgtaccaaagatccaacgaaacacccagtacatacgtagttacaaaactaaaatatgtagataaaccaacaaataacattattttcatagcagtttctacggaatttattgtttatatatgccagacttttcttcagctaaacagagcagcgacggacacatggccggccacctcactcgctcgccgccgccgccgcctgcagatcggcgtacctcttcttgcccgccgcgatgaggcgttcgagcggcggcatcgccgccttggcctcctccagcgcgcagaaccgctccacccacgccgccagcagcggcgtcctgtccgcgtccacgatcctgaccccggtcgtcggctccgacgccagcatcgccggcacgaacccgccgagcgccacgtcgacgagccccacgcgctcgccgccgaaccaccgcccgcccgcgcgctcccggagcgcgccctccagcgcgtccagcgccgcgcgcgtccgcgccagcgccgccgccctctcctccccggtcttcccgccgtcgtagatccccatccacccgctcagcagctcgccgtcgacgaaggcggcccagaagcgggcgacggcgcgggcgtaggggtcgtcggcggcggggaggatcgtggtggccgcggcggcggaggaggaggaggaagggaaggcctcgtcgaggtactcgacgatgagcatggactcgcagacgggcctcccggcgtggaggaggacggggaccttggcgtggacggggttggcggcgaggaggaggtcgctcttgccggcgaggtccacctccacgtactcgtagctgagccccttgaggttgagcgccaggcgcacccggaccaggaacgggctcccccacgcgccgagcaccgtcagctgctcgccgccgcctcctgctccatctccggcggcagccatcgatcggtgatctcttcacctgcagtccaacgagtacacgtacaccgatcacgcacgttggttttgagttctttgctgctgacctttaccttggtgataaggagaaacgagaatcagtggctgcatatatagtccctctgtatgattttataagttatttgatttttttagtcaaactttttaaagtttaaataagtttataaaaaaatataattataccttcatttcgtattttcattccgtataaaataaacatattatcaaaatatatttaatgttaaatttaacgaaaccaatttgatatcgtacatattgttattcttttttctataaatttaattaaacttaaacttatgatataaaacggatggcgtatttggaagtgatattatgtttagagtctggactctggacggaacggtgtgttgaccggtgatgtgtcatgtctctgcgccatccacggaaacatcaaacattttggtgttgaataatactcgtgtgactcatgttgtgcttccttcaagacgaagcagcagctagatttttacacttgcacggttgtatctagtttgaatactcgcatatgtgattttgtttttttaattactaatttgtttcattttaagttagaataatccattgtgtaattgtgttttcccctagagaatgagagaaatgataagagccactaaaattacattcgagggacaagaaaagtgacatgaaatataaacagagccatatatattttttagttctcttcgattgtttaggcatgcaccattatctaaacagggccatggcaatttgatcgctccaaacgctacatattcttccatgtctgatgcgccattatcaaaagtgatgtactcctgtggtttcataattcgttttggatatcgacacggtttacaaaatagatttttaaccttattttctattataatataaaataaataaaatatatgtttacttttattatcgtacttttaaaaaaacaaatctatatacgttggtctaatttctttaaagtaaatatttttgaagttaaaatagtcgaaattacaaaagtttaacattaatcttgttcaaaacataagaattatgaaccgtatatgtgatagcaatgtcataccacgtaagcagtccaccttccaagttgaccatggttgattcccatgtccctcgtagatgtggtttaatatgtagattgtcctgaacagaatgaacggtggtgatctctatggttgagaatgatccaggccgtctaatgtaaatggatgatttatgatttgtaatatcgctctatatgatctcaattgtccgagtaaaatcaatggttctgacttgttgaaagagcggtagcccctccacgacacaagcttcgaccgttgtggcaatttcccctcacccttgcacccttgatcaagcagtgcatagtgaggagcactccttctggtgcaacacagtggtgaccggtgaagttgttcatacacaggtgttgggtccttatgtcctacctagacttttccgtctatccctagacttttccgtctatctccgatgcaccatcgtcaaaagcaaagtcatgtaatagtaggaataccagatgacgtaagggtctccaatatccaagttgaccatggggtccacggttcaacccatgtccaattgtccaacttgtgagccgtggtttagaagcaattaatgaacatgtatctattatgaatgatcgagtttgttcaatataagttgacactccgcatggctccatgcgatcctaatcgttcgagtaaaatcaacgactctgattagttcgatcattgtgaccatttgtttccactatgttagaagagcattggcccctccgagacacaagctctagctatcgtagcagtttccccctcaccaatcaccattgttggtcgtcagcatagagtaaggagcactacttccagtgcaacaaggcatggccaacgaagttgttcatacaccgatgttgtccttatttcctacctagacctagatgttcccttccctgttgcaccatcatcaaaagcgaagttgtgtaatagtaggaatattggatgatgtaagaggtctccaacatccaagttgactatgggggtacatggttcacccatgtccaagtgtttaacttgtggattgtggtttagaataaatgaacacgtatctattgcaaatgattgggtttgttcaatataaattgattctctattcgctagtacgtctccatgtgatcccaattgttcaagtaaaaccaactactctgattagcttgatcaatatcttgtctatgtcctgaccgtttatttctattgtattagaagaatactagcccctccaagacacaagctccagcttggccaccatcatagaataggaagcactacttctagggtagcatgaacgtggtcaatgaagttgtggatacacaatattaagtccttacgtcatatctagtattgttgttttcgatgtgccattgtcaaaagtgaggctcccaaatagtacgaatgctgggtagagtaagcgattttcaacatccaagtttgatcatgggtccacggttcaccccatatccaactatctattttttaggtcaacgaatatgtatctattgcaaatggttggttttgtttgaaacaaacaggcacaggatgattcatcagtacagtttcatgcaatctaaattgtccatgtacaatgactcctattaggtggaacttgtttatatcgtgattatttgtttttgctttgttggaaaagcattagcccctccgccacacaatctcttgtcgtcgttgcaatttctccccccatcctcgttgtccgttgtccttgagtgaggcgtgctacttccgatacagtatatatatgcccaacgaagttatagatatgccaattctaagtctttacgtcataccaaggcttcgatattgttatctccaatatgtcatcattaaaaatggcgccccataataataggaatgtaggatgatgtggcggtttataacatcaagtgtacttctgccaaattggtctacagtttgtgagttgtggtttaggatcaacaaataatcgggtccgttcagtataaaacgaacgctttatgattcgtgcttacagctccgtgagatcaaaatcaacggctccaattatctccatctctctgtctccgtattgaccgttcttctgccttgtcggaaactgcctccatttcttcactacccctccgcgacacaatctccggctgccgcgctagttgattccccctcgccgtcgccggccacctcgccgccgccgccgccgccgccgccggggaggtccctccccacgccgttctctgcgcccccccagatcgaggccttgctcgatcgaagaccttagccggcgcagccgcggaggtggcgcgcggtgcctgattccccacccaaccaaaccctagagcccaaatccggagggcggggatttgcgccgccgcgggctggtgcgagtctcctccagggcgtggtccccctcatggcgcggcggcgcacgtgcgggtgagctcgggccaccaggccatggacgagctcaacctattgcggcagcaccagcaccagcaccagcaccacctggtggtgcgcggcctcggcgaggagatcgacctcgagatcggcccgggcgacgacccctccttccccggcgcggccctcgtcggcgtcacccccggcgcgcacgaccccgcggacgaccacaagagcctcctcatcccgtgctcgcagcccgtcgccgaggggcagccgcagccgacgccgccgcaggtggaggagcacgacgggctgctacggctgccggggcaaaccaagaagaagaagaaggtggtgaagaaatggagggaggagtgggcggacacctacaagtgggcctacgtcgccgtgcacgacaacaccagcaggatcttctgcaccgtgtgcaaggagtacgggcggaagcaccgccggaatccctacgggaacgaggggagcaggaacatgcagatgagcgcgctggaggagcacaacaacagcttgctgcacaaggaggcgctgcggttgcagacggcgtccaaggagaacgcgcagccccctgagatcgagaggccggtatatgtcaaaggttggtgttgttgcctcaagccctgtgattatgctgcgagttcgcctgtggtcttctataagaataggggatgtgtaccaaatccgtgcttacaattagtactatggtggtgtttagttgtttggcaaaatgtcattttactgattttaacagtgaaaaatgtactgggtgaaatagataacatgacttttgatgcatagtttgggcatatgttgttacatttatctatgactttgatattcgtcacttcatcccatcctgacagttcatggaggtaaagtgtgtctgtgctccgtgcaagaaaaggaatatagtgtaaataataagttgaagcaatttccagttctccactaaactgaagatgcttggcattcccttgcattttaactcctttatcagcgaatgcactccattttctattaatttggaagaagttaaccatatatttataaaagtacttaccttaactttcaaggttatatctgaattgtggcatctacatttttcagctctgtcgaaaactgcagcctctatacttgaatctatcctaaagaaggaccctcatgaagctgagtttatacagtctatccaagaggtggttcattccttggaaccagttttggtgaagaactcccagtaactctccttccctcctcccctccctgagaaacagtttgcctaagactcaagtataacatgatttctgattgtgatgtttcagacatgtccaaattttggagcgtttgttggaacctgagagatgctttatcttcagagtgccatgggttgatgatagaggtgaagcacatgtaaatcgaggcttccgtgtgcagttcagtcaagcgttaggtccatgcagaggtggtcttcgtttccacccttccatgactttgagcgtagcaaaatttctagcttttgagcaggtaatatattacttggttcaaatatattatcatgcaaatagtctgctgctgctacctgtcttttcatcatgtatgtcatttgtgctttttgtatgaaatttcagtttttctgtttccgcattacactccatttgattaaatgaataccatggtggatgccatgcacacaaacacgactcaagaactgagaaatgcaactacctgaacctaagtagatactgtcatattgtaatgtttttttttttactttccatcattccacattggattcctaatccagtggcatgattttactcatgatagccttacattttttttcttttgatacttgggggatctgcactgtttcttttttttgtctgtgaacttctgcccaaaattgtatctttttttttccaatagaacacaatcaaacaaagttatataaaattaggatgcttgctgtgctatatgtttatttaggatttcattattgagcactataattgaaagtagagtgctttaaattgatgtggaaattagaaaccggcatgaagcttttataaagcattataaacttatttcctttgatacagactctaaaaaatgctttgtcacaatataaacttggaggagctgctggagggagtgattttgatcccaagggtaaaagtgaaagtgaggtatttgtgtcacattttgtttcctttggaaaatagtattttactgcacataaatctgaaaatgttctatttcagataatgcgtttttgtcaaagtttcatggatgagctgtatagatatttggggcctgatcaggtattcctatcagatataatatcattttttttagattatgacatttttctatattagaaaaatggaatcaaattgttttgatctaaatcagatgattttgcttaaaatcttactgcaggattttcctgctgaagatgttggtgtgggtccaagagaaatgggttatctttttgggcagtatagacgcctttctggtcattttcaggtataatagttgttctgcaatgatatgttattcgaaatactgtttgtcatcttctgccgttgccttttattttgggtattctgattctgactaattgaaaactaaggaccattaaccaaagggaaattagtgactaaccttccctagttagagagcattataacattatcttaaacttcttttcatgttcatcatgacgtcctactgggtagtgctatattatcatgctgtgcaactgtggaatcaaatattagttccatgatatctgaatgtagtcaagttcagatcatactacagggattgaggaaccaaaaggtggtattgctcaatagtttgttatagcttggttcatctgtcctgtatctggacatttctcttcattcttggtaaaatacaccatttagtagttcgggaagcgtgcgcacagagaacgagagaaatcttctcttgttcaccagctgcagaacgcagccctactttaaggctattggtttgcagtttgctttatatttttttgtcagtcttttctcttattctgtagatttcattgctatgcttgtgcaggggaattttacagggcctaaaatcttctggtctggttctagtttccgaacagaagctactggatacggactggtaaagtggtgccttaacatttcctgtgagcagaaactattgtatatcatgttgcttgctactatcattctttcacaacttaccctttttgctgcatatgtcaactagacaattgttcctgttgaaaagagtaattttataacctgttgcaggtattctttgcacgtgtagtgcttgctgatatgaacaaggaactcaaaggattaaggttttaacatagatctatttagtttatttgtatatagttttgtaaccatttgggacttcctaatgtgcatggcttctgcagatgtgtgataagtggttctggaaagatagcaatgcatgtattggaaaagcttctgtcatgtgaagctattcctgttacagtttcaggtataccatatacagattgaaaccttaacatggattatcttgctaggaaataacataaggtagtatgataggcaggagcatgacctagtttactaccatgatttcaccaattaattttgtacatttatcatgactaaaccttatgggtttgtctgcccccaagatgcaatgattcacatcttattactgctttttacttaacctagctcatgtttgatttcccagaattctaatggccttatttatttaatgacatatataatggtttctgttcttgttcctgtaacattacccttggtttttcccttaccggttgtcacattgtaacccaatcctaaataagaataattcgtctacttgtacaagaataattcgtctacttgtacaagcaattctaatcaacgagagctatcataaattatttttctcttactggctgtcacatcgtaaaccaatcctaataagaataatttggtctacttgtacaatggcaattctaatcaatgaaaactatcataaattattgcagattcgaagggttatttgttagacacggaagggtttgattacatgaaatattcagttctaaggaacatcaaggctcagcaaaggagcctcaagtgggtagatgccttaacttatccttagttcataaaggtttagattttgacatactattccatttaaccaaacagggaatacttgaaatcatatccaaatgccaaatatatagatgatgcaaagccctggagtgagaagtgtgacgttgcattcccttgtgcatcacaaaatgagattgaccaggcggaggctcttgcaataattaactctggctgccgtgttcttatagaatgtacggaattttgaatttgtccttttgatcacttcgttccatatcatctactgatttatttttggtcctactgaaggttcaaatatgccttgcactgctcaagcagttgatatcctacgaacagcaaaagtagttgttgctcccgcaaaggcaactgccgctggtggggtaatgcaaatgttcttatcaatccttctgtggtcaaaactacatgatcctagatgaattgtgttgctcgtttttctgctgttataaattaatttgggcgcactgctttctaagttagattgatgtatattccagctgagcttggtcatggtccctcttttgatcatgcctttgtttctctcgtatgacaggtagcagttggagaactcgaactgaaccctgagttcagtttgatgcagtggtcagtggaggattttgagaacaaaatacaggtataatctgctgctcctgcttgttggcaagctactcgtatttactaactagaagacctgctgaaagtcttctttttaaaaaaataaacaggatgcggtgaaacaaacatatgacagatctatcaaagctgctcaagattatggaatcatgaaagagaacccagagttagttttcttcttgtgctctgaggatgtcttcctttgtttccgcctggtttcaacccagaagctgatcgatctctctatgcaggtcgttggtgcatggtgcaaacatatgtgcgtttcttaatattgcacaagccatgactgatcaaggatgtgtctagtgaggctgctcaataagcagaaatggcgattgttgcagtcctgcaggcatgatctcacgggagcataggtttttgtttatacatgccctcaaatcaatttagtgttgaaagctttcccctggtaggaagcgaagcttgggcccatcgtagaacaatatagaagagccctttgttgttgtatgtagtctcgtagatcaccgatgtattatccattctttcttttttttttctttttgaactatgtattgcccactcttaccaacatcaatgccaatgggaggaggaaatagaagcaattctttttgtatctagatggtgtcatctgaatgaaagtaatttatcaggagttaatcatacacaaacatatctatgccttgaatggatcagcagaactctggttgcttcacgagctataaaccaatcatcctcaagataaaagcaaaccaaacttctacatgcttttgttttgtttgaactcgagcgtcaaatttgcagacttgcttaatgatgcagcattcacagcaagaaggtaaatgtgggttcaaaccgaccaaaaacacaatagattacataacgaagtaaattacgcagccgctgtatgttcatctttaatacactcaaatcagattgatgataacctctcgaaggtattcatcagcaggcaaaccaattcatgggaaaacgcacaaaatggtaggcttcacctataatattatataaccacattgtgcttccctaaaacatttttgctctcttctatggttttgaagccttaagcggccgacttgcctgactgttctgctaagtaatgctcaagcatgtcctcttcgtcatctgtacagattatgaaaccaggttattgtaaggtaagtttcgcttccaaactacacaaattgttgtaggcaagaaagaatatcctcgaagtaagtgaaaatttaccatcgaagtcttcatcaaagtcgatgtcttcctcttcttcctcctcttcgtcagcagtggtacttgctcctttctggaaagaaaatttcaaatatgtgagacttacaatcgtacaaagattcaaagatcataacaaaaataatataaacaaaatatactggtggctatgcatgcccttaactggaaaaggggaaaacatgcaatacatacagtatttaaaaaatctaatatactccctccgttcctaaatataaaggattttggttggatgtgacgtatcttagtactacgaatctagaccatccaaccaaaatcccttatatttagggacagagggagtaggattaagtaccattgtatgccttccactttcaaaatactgtcttcctgagagtttcttttccttcggagctgtaagagctgactctggcataagcctgcacatgaaaaaaaatttgtttatgagaacatgttttggcacttgaaatttcaagatcaaatgctataagaaagcctgccatttgtgaagatgactccatgatgacatcaagggaaagctaaataaagaatcttacttggcacgctgtagcgccaattcagcttcaaaacgatctctccaagccagaaagctctctacagtaacagcttcaccatggggcacaatgacctataaatgttccattataaagtacattgcatgggaaagatacatactgcagaggggcagaataataaatggctaacgatcttagattatataatacagaaaataacagtaaccgtggaatttgatcatgaagtggctcagcagtcagtacgacaagcataactaccgctctgagaaatgcatcctagactagctccagtgtgtgatgaaatatatgtactcttaattggaaaataattaatcatgtgcaaataagtcagtctgaagcttggccaaatattcatttcatcttcttatcacagatggtcacaaaaaagaaaccattaaacttgccaaagggaataagttagctatacctcctcttcttctgcctcattttcttcagattccccatctccagcattctgtccatatttctcacttaaccaatcttgtgccgatgtgacaagagtatagaccatagccatgccgagattttcagttgcctaaaccatggggataataaacagagcatgacaaggcatatcaggtgatttttaatgaatatacctgatagacaagaatagactccgaacatcgtctattcaatttaagcacaatatattcaatatcaacataatatctgaatgaatattcgtgaagccacagtgagcattttacaaatcctatatacaggcatgacagtggcagtagaagcaggtaataaaagtagtttgtagtagtaaatagtaaaaaaaatacaataactgcccaagtttatttgactcattctgaaacttttatcttcagatgaacttagcgcatactccctccgtcccaaaaagagtttaaaagactaccacgtccttcaaaatatgtggagaaaacgagaagggggaaaaaacgaggaggacggagtactattgattcaatggttagaacgagaagaaaaggatgtaatatttaagaggtctaatggaccactctaaaattacactcttttagggataaattcttaagctaaaactacactcttttagggataaattcttaagctaaaactacactcttttagggacagaggaagtaagttgttttgcacacagttgacagttagattgacaacaaacttgagccaagtacttgcatacctcttgctcaagcttttctttcaaggatgcaagatcttctgatttcattcctcgtacactgcatggaagttttgcaattcaactgtaagagttggaaagcatataagcacacatcttgcataaagataccatgaaatttaatggcgctaagcttgcttccaaccaatgctggatcaccaagttaaaaaacagaaccttttgacattcaaaagcggaggctcatccggatatttttcggtgtgtgcaaaaatcagagccagttggactgcaaagcaaggatggatgacacaattacaataataattgaataaatcaagaaatacagaacatctaaatgttccttttctcttattttaatataatattgattatgataaaattattctttacctggcacataagccgactcatcgaaatcatcatcctaaccaagtgaaaaggaaaagatcgttaatttcaccaaactaatcataagacaactgacgaaactgcaacatctcttcaattccaagagttcctattgccaactatactttaggtcataactgaatgaagaatcgaggaagtgatacatatggtaggatccccggcacaaacctgaggggagagcacgatctggaagcagcgagccgtggtgctgagcccgctctcgctggggtcgatctctgcatcatcatcatcatcatcatcatcaaattcccaattcccaggttaaattccgcaagcaacaagctatagagcaagcaaagaactagtattgtgcagggggaagattaaaaaaagaaaaagaaaaagagagagaacccttgatgtcgtccatgaggatggcctgcagggcctccacctccatctcctgctcctgctcgtaatcttctccggcgccaccgccgccgccatacgcaggggcacacagacacacgacgaggtgagcaatcatacaaaaacgaggaaaagcgcgcgcggcggaggaggaggaggaggtcgaggatttggggttcgtaccagccatgatcggtggcttcctggctcagctctcctgctctgctctggaggaggagacgagacgtcagtagggagggcaggcggcggcggcggcggcggcggcgtgcgtcgccggaagacgaggaggaggtagaggggggagttcgatccgatgccgatggattgggccacgtattgggccggaaccccaaataacgcgtgtgtgatgtactgatgtggtcacgaaaaccttttttttttatctcccctgtatatctctatcactactattataaaaattgaatatattttcgttaagattttggtacgttacccgtatttgagttggttttataaagatatagatttatggaataagttatggtatcacgaaacactatttgtatttaactcaaacatatgaagctagctacagggttttttcacgtttgtcacggcaattacagaacaccttgacgaaaaccgagtcagtctcagtatcaatatgcattgcaattacagaacaccttgacgaaaaccgagtcagccttggtgtcaacacatatacatgcatacatacatattgcgagagtaatttttcagttgctgccaaaaagttttctctgtttaactaaaaaaatatttgagcgtgttatttatttcagattgcaattaaaaaaaactccttcgtgctaaaatataacaaacgttgttacaaatatagctaaaaaccagcatgttcactccaaagactaggaattattataccacattaataaaaaagaaaaaatatacaccattagtagtagcactcttcccgattttaatttatctatgtcaaacataaaaattgaagatgtttccgccgatattttggtgcgtcatttgtatttgactcggttttcaagttcgtttgcttttagaaatacataaaaagtgatataagaaatcattttaaaaaactcgcatgttaacttaggagaagagttagactcctaattgcttcagaactcttgccaagtcataagaaagcaacacacaagatatgaccatcatcctaataaaagtttcaaactagatatcaatactatcaaaatgtataacgccgttgtctattcccacaatgtttgaccattcgtcttatttaaaaaattaatataaatatgaaaaagtatatgttcagattatattttatttgatgatacaacaattcacaacaaaatttatgatatttatataatttttttaataagataaatggtcaaacgttgtgcgaaaagtcaaaggcgtcataattttgaaatggaggatgtactttttagaaaaaaaattaacaataatatgattaaaatagcattcacccatcgcaacgcacggacatttttctagtaacctatacaataaatcccacttagagcaagtttaatagtatagcccactactagccccaaatcatctataaccaatgtaatagccaattcatacagtagttagttactatactattaatacctggtcccacctgtcatatacatattacgtcttaaagtccgtgctgcagctagctacagatctgtagcccgctgctcttctctctcttcctttacctcttcaaaatatgtttatagccggtttatagcctgctattgcacctgctcttagggtgtgtttggcacccctttttcccaacacatcttcctcgttttccgcgcgcacgcttttcaaactattaaacggtgtatttttttgcaaaaagtttctataaaaaattgcttaaaaatcatattaatccatttttgaaaaaaaagcaaatacttaattaatcatatgctaatgcactgctccgttttccgtggtagggttgggaaccagcgtatgcaaacacacccttagtttagttattaagtatcttctctcatgtggtgctttcacattacgttaattatttacgtccattggatttacacttaatgtctaagatcatcccaaagtcactttattttgtttctctcggatttctcatgttttattcatgtatttacttcttctcatcatgcacaaccatgcaaccttcaattaatcaagcaaacaataggccaccaaatgctatgaatgaacctaaacggtcttctttttaattttgtgaatagcataatgaacatatcacatactatataggatagcctatacatttatagttgtgtctctaaattacattaaagaaaaatgaactatatgacatgttctgttttgatcataaggcagttcaataatcgatcattcacggtatcaacatattatcataatatctttttttcttatatgttaagttttttctaaaaattatcaacctcatcttttcacttataattatacttatcagccaaaatttgagttttcaactttaaatttggagttgattttaggattcatagtttatcttttagcgtttgcttttagctagttaagaacatgtatataaaggttttattcacaaattatttttcatttgcaaatatgccgtttcgctttttcctcttatcagccaaacgatggggttgtataatgttttgtatttgtattttgacttaagttatagctagcatttttatatatacccaatacattctaaatttcttatcatcaaatttgcaaacataagttctatagcaattcacgcagcaacttacggggaatcatctagttaccaagaaaacatgttttgtcaaatacctacaacgccataattactgatcggttacaagcgaataacgataattttttaaacaatttttattaaaatgttaaaaaactttgggataattgcttattttactatgtttcgaaggctaattatcaatcagaccttaattttttctagtttgcttaattgaccctgtttttctgaatcgaacctatcgtttcaccctatttaaactacaccgttagggtttcatttagaaaaaagaaaaaatacatttattattcacgctaaccaaatacccttccttcaatcttatccatctcctacctcctgcccaactcttatctctctctctctctcctctctcggcgtgaacagcggtgtagggaggggcggtggggctggatttagcgcacagaggggggaggggcggtgacgacgcctacgtgctgagggaggaagggccagtggagctatcgacatgcggagagacggggacggcagcactggcaccggcccacggagggaggagggggcggcgcaggcgtgcggagggttggaggcagcgacgatggcgccgacgtgtggagggagggaggtggcggcatggagggattagcaggataagcgtggggagagagacaatggtggtgttgttctcggcttcctcttctgatttgttggttctgctttcttaccaccacaagagcaaaattggtgtaccaaatttgtgtcaaattttgttcattttattttatcaaaattctattaaattgattcaaatttatcaattgaagccaaatctatcaaagttatgtcaaatgtgaaacatatgtcaaatttgttagaaatatgtcaaaagattcgaatatatgcatgttttgatataataggatcaaaacaattggctgtaagtgccaagttttacaattgaaaacttgcccaaaacttgtaaaatgcatataaaatccattttaactccaatctggatgaatcaaatttctgtgaactcacaaacttatgactttaatttagaaacataaaacttggcacttacagtggaagaaatagctctaaaaattcatataataaacaatgaacatagagcaacctccaaattataaaatttatagaaaattcacctgaactctttttgaagtgaattaagttccagaatgttcacaaaatcatactctcatttgtcatgaactaaaacttagcactctctgtaataaatatgtcaccaaatgtttatttaataaaatttactactatagtgcaaactagagactataaaatccataagtaattcattttaactctaaatgggcaaaactaaaattttgttagtttcacagaggtatgcactttcgatctatagactaatctctaggtgaaaccataactaaaacatttctaaaattttaaataactaatatggtctataatgaaacaagcaaactataaaactcataggaaaatcatgctaactttaaaaattgtgaaaccaactttgttgaactcctgagaacatccccttcactgcagcaagtcaacaattcataaatcatggacctaaactgcacctaaggactattagagcttaattaatctagtgctagtattaatctttgaaaattaataactctcaaatgcaaagtgataaaatataaattctttcatctaaattcatcttagaccagtacctaaccacactagtaaactcatgcattcttgagcattttagatttttacatgttttggtatttatcgttactgttatttcttttagacggtgaattcgttatcggtgaggtgattggtcttatagctgatctcaaggaggttttatatcaaccaaggcaagtgttgcccttcctttgaacatattgaatcctatgttttcgggctaaatgttttgattgtaaagttgcacgtgtatttctaagtatcggtactttcaaaactatagattgtagttgtacctttaaaagatgcatgaatccccttttgaaaatcaccccttgctgttttgaaccttagggttacttagagtactttaattgtgctcatatgactatactatgcttttataaagtgcaaatgcttagccttgcttagtgataaataaaacatggttatgagtcacttgatatactatttggaactcctttttaaacattatgttcagaggtgattctccgattatttgtgaaataaaatgtgattttagacttaggcggcaagtgatatgcatatggtagtagttgcataccgatagggggagtgttcacttgagtcgattaaggaccgaacatcatatcacccactatgtttaccatacatccacatgtgtctttatggggggaccttatcctattaagttaagcacttatctaatcttgcattcgggaggccgttgtagtataggtagaggccatgagtgtattgtgggctgcctagaggaactacccatgtgtgtgtgtgatcataggatgataaattccctacatgtgtgatttccgtgaggggacgagtgtactattctgctcatggcatgggtgtctaagtgtgtccaatacaacgatattgtaccacgtggtgggttcccgttgtgtccgccaccacggcgttaagtttaaggcgtgggcccgccacttaacggttctaggtcatataacgtgtatggtttaggatggaggaacacgtatcgtgctcacggtcatgagcgacatgatgatgtgctatgggcataattttgtgatttctaaatgcttttgaaactaaatgttttgagatgatgatgagattggtatatgtgatatgattgccttacttctcgttgtgttttaagggaatgatgtctatctatttatgttgaaatcatgctatgattaatatgctttacatattgctaaaatgttttgcttaaattacgttgtaaatggtttgtgaactaaaattggctttatgctgaaaattgagactacaaatagccttcctttgacatagagctttcatgtatgtaggttttatagtgctcttgccagtacattaatttgattaatgtactgagtcttgccatgttttgtctaatttatgttttacaggaatagacttagtttaatttgagtgatgcgggcttcgactgcttcttctaggatttaaacttaataggtaaacccctagtcggtgtgcttgaggattgggtagtcaagcttccgctgttctctaatatagctatatttggccggtcggcccatgtatctattaagtagttgtaatctaaattttatttgttttagatgtattttgctatgtatatccatgcttaagatgaaagtgtgaatctagtgcacatcctgggaactagattcatatgagtatgagttaagaatatttgagatgttgtagatctgtagccattttttgtcaagtctcctgaatgtgtgacacatctggtcgccgccttcgagtggtttgacgggcacatcccacgctgaagttgactggcaggctaaatgcctagcaatgtctctaatattcttctctcgaggcgtcggatatttcattatgtttgtttgatgacttgaattattcacttcatatctcaaatataataggaggtccgaagagcctctccgacatcatttctctatcaaactactaaaacatcaccaccaaatagttgagcatcctaggcccaaaatctttagtgaccaattggatctttggcaatttgatatagatacaatccctgatctttattgagaacctcataaacaaaatcctagaccacataataaatggacatgatcctctaaatattttagttggaagaaaccttataatttactaaaataagacaagagaaggaggcatgcctaggatagctggtgcttgagccctaggactgcctcaaaattcttgtttacattttgttaaatcaccatgcaaattttatagaaaactgacatttcaatagttgaatcctatcttaaccctatccgatcttactataaagatgatgaccaccaacttctaaagatcaacatgcaagtgtgtcacgtcatcacacactagcaattattatctagagtattttaaatcacatgggcttttcctcctcccgtgactcccgtgccgcttgccttgggcgacacggaggcgactgcctgagtgcgcggggctccccaatcgcgttccgctcttgttgccgccaccagcgaaggcggtgccggtggcgccggcgcctccctccctcttcctctccccttcttcatccctctcttctctccatccctcctttcctccagatctggggcatccagtgtcctgcctcctccccacctggcatcggcggcctcctcgtctcggtccggtggcgagggctgcgcggggacagccggatctggccacataagcccagatccggcgcctctctagcggctcc

SEQ ID NO: 59547 - DNA, 5233 bp, Oryza sativa
gcacggcaaggctgcgcccggcacggaccgagatctgtgccaggcagtggcaacgaactccggtcaccccagtcgctccccgtccacagccggatcggagtcgaggtcaaccaggggccgcccccatcgctaatcccgccgccccgcccccattgctgctcctcgtccacagccgacatcactgtcgtcggtgcacagagaggtagaccggggcgtcgcgtaggaggacagcggccgccggatctgggtcgaggtcgaccggggcaaacggtcgcacggcggcatgagggcgaactccggccgccccgtcgttgctcccaccgccgccgccaattgccgccgccgcagccgccctcgcgccgcccccattgttgctcctccttctccgccgccaccgccggttaccgcccttgcgccgacctcacgccgcctctagctgtgtcggccatggcgcgatggccacgaagaagatggagaaggaaggaagaagacggaaatggagaggatggatagaaaaggtgacgtcagtggcatagttttaatttagtaaaattggaatgacacggttacgaataggcgaattataatggtatttttctgaataggtaaaattgcagtggtatggatcaaattaacacattcaaaaaataagactagcgcgcagtgcgacacggcggcggcggtggtggccagcaactcccggtacgggacgacggtgcggacgagctcctagctacccactgcatcggcctgacaccgcaggctggtgtggacgaactcctacccagtgcaatagcaaccgaactcagtaaataaaggtggaaaagatgatgtactaaggaaatacaagtggtggaagatgctagaagcttctagaaggtacatgaagaaagaaggtagggaggaagaagatcgacaaggtgcctagtgggttttttgtcccgtttgcacagggatgcctagtgggttttttttatcccgtttatcccacttctattttattttttcttctaaattttgtattatcatgcgagaaataaactagcaagcgggtttttatgtgggtagcgggacaaaccacttgcatccctacgtttgccgttcgccgatgatcgaagaacttggggagctgatctgctttgatacaggagaaagcccagtcagccacctttttggtgcaggtcatgtgacctaaagttcggcctttgctttttgagacttgaagtttgggaaagctagtagataactgcaaccagagagagagttctagtgagtccagattgtttctttcgttcatcaaaacgcccgagaaagagggaatgctactagggacgaacagagttctggggccagaggaaaggggaacaaaaggtttgatcaatcgatcgatctctcctggaagtgcaggctctgttctttttgtagtttctgtcctcttgggccaagcgttggaagtgacagagccggccctgcctttccttcctggaaaaagtacactaaaggtcccttaacttgttatcgggatacaaaatcgtcctccaaccacaaaaccagatacgcggggtccctcaactacacaaaaccggtcacaatatatccctcggcggttttgatctcggttttattctacgtgactgctgagtcagcatgggacccatgtgggccccacatgtcaacgaaacattagtgtcttcttccccacttctctctatcccctctcagcttctctcccctcccctccaagcagatcgccggagagggcacgatgcggggcggagcggccagatagaggagcgggcgacggcgcggggagcggccggtcggacagcgggcggcagctgcgcccgtcgtactggcctgccggaggaccgggcgagcggtgggcggagcaggcgacggcgcggggagcggccggctggccagcggggcagtcgagcgaggcgggcggcgatctcgctatcgttcgcgtgcggcgtcggcgtcgtcttcatcctccgcagcgagctccccggtgacgctcatggagctttcctctcaccgccccaacagcaagacgctcgtcgaggcaggcgtcgtcccggacatggtggaggagctctacatccgaaaggtagacgacgagccgctccgcaacaaagccatggccgtcgccgtcctcgccaacgtcgtcaatactagcattgatcgggatagtcggataccaccgtggtgaataaagaaggccatgtcctcacgtccaagtactccatctacgacttcgtccacatgctcaagtgcttcattcccgacgagctcaacgcctcaacctcagcatcatccgtgtcaccgcgcacgccaattcgctcgccgccgtggtctcggtcgtcaaggagaaccaccggggccactccatcctggagctcccggactgaagcgctcggtgtcgccgcgacgaggctactcatcaccctgtcagtgcacatggggcacaccatcgccgagaggctccgcaagatgcagagcgccggcgccagcgaaggaggcagacgaggggcggagggccgctctgctacgggcggttcgcggtcgtgggcggcggcatgtcggcggtgtcatgctccaccgtgcgaggtgtgtgggggagtgcggcgtgcggggtgtttgcttcgggaccatagtgcgtcgggcagcgtcgtcgtcgtcgggcggcttgtcgccacggactggtgatggacgccggccggcgaagagccgccgccgccgccgccggtggtagctcctccctcgccggccgctgcccgcgcccatccgctctctgcagccgccgtggagaggggaggagagaggaagagagatggtgaggggaggggaagaagtggctgacatgtgggacccacgtgggtcccacgctgagtcaacggccatataggataaaaccaggattaaaaccgccgatgacctattgtgaccggttttgtatagttgagggaccccgcatatctggctttgcggttggagaatgattttgtatcccgataacaagttgagggaccttcggtgtactttttccttcctaacaacgtcgctcctgggccgctcggctcggcaagcgaggcggagcttgatggagtccttgatttggtagatggcagcgtcgctcaggtggaagctactccgccaagagccctgatcccgcgtcgccgctgtacagcagcacgccatggatgggctcgaacgagtcgagcagcgtatatatggacaccggcaagtgtcagctcagcctagcttctagtagtacagcaggcgccatgaatcttgtgaaatcaatcaacttttacgttcctgccagttcatagcgactgcaataccacacaagcttggatatctagctacgtactcagccggggaagtcgtcacgaagcctgtcgtccaggggcggggtcgtcgtcgtacttggcctcgatgatgctgacgccgcagtcgtcgttgtagggcggtgcgctgcgacagcagggacggacgacggtggcatcctgtgcagcttgaatgcttggccgtcggcgttggcgaggtcgtagttagcctcccccgtcaccgagctcggcacaccaccgtcgacagcccgtgcccgtacgttcaccgccgccggtgtctcctgcccctcgagctactacctcagctggccgagcgagcgagctaggagacggcggcgagaacctgcaagtgccatgctcggcaaggtcggccgctgcggcggcgtgcgcggacgacgacgaggaaaggcgtcgtcaaggaaagggaaagaggggtgatgatgtgggtcccagagcaattttctatttttaatcggacaatcactgtcatgtgggtctcaatgtctcatggagtcttggtacttttttattttaagtagacagctacgtcagcagaaactgctgtctaaaccggcttaggattttatttgcatcggttttagaagttgagggacgagttcagggatgaattttagactccaggacaaataagggacccaaagtgaacttattccaaaccaaaatagatcagactgtaaatgtaatgggccgttagccgcagcgccacaaaaaccttgcaggctggttcggtgatcgctgggcctgccacccgtatagggccgcgtctgttcgctagatgctaaaggccatattggccatctcttaggggctgggaattatgtgccagtttagttggaaaaaaaaaatttgcccgtcacatcgaatatacgaacacatatttaaaatattaaacgtagtctaataataaaacaaattactgatttcactagaaaattatgagacaaatttattaagcttaattaattcatcaatagcaaatgtttactgtagcaccatattgtcaaatcatggcgcaattaggattaaaagattcgtctcgcaattctctggcgaactgtgtaattatttctttctacatttaatactccatgcatgtgtccgaaagcgtgaaaattttgtttgagaactaaacatgccctatgtcttgtttccatataaacgaaattttcattgataagattagctaatattttactatgaataattttgacaacctcagagaaaataagccatttactaacaatagaggtggcgagatttaacttatttttcttttttaaccctacctacaccttgtctctaccaccttaaggccccctttgattcaaaggaaattcataggaattttaaaggatttaatttctataggaatttttcctatatagctctttgaatcaaaggaatgaatcctatggaatcctataaaattcctatggaatgcctcttcccatgcaaattttgaaggaaatttaacatgaggttctacctgtgtttctctctcctcaaattcctgtgtttttcctgcggctcaatcaaacggtcattcctatgtttttcctgtgttttgcaatcctctgttttacacttgtattcctatctgaatcctatgttttttctattcccccgttttttcattcctgtgattcaaagggggcctaaggctccctttgattcaaaggaaatttataggaattttagggctcctttgaattggcggattggcataggaatattggaggatttaatttactaaggaaagtttcctatgaaaccctttgattcataggaaagtataggaaattttccttaggccccctttgaatcacaggaatgaaaaaacgggggaataggaaaaacat

SEQ ID NO: 59548 - DNA, 43529 bp, Oryza sativa
  unsure (1)..(43529): unsure at all n locations
agcgtaaagtcctcccacctgcttctgactcatccatatcatttctgatgcgtctagtttggcgtcgaccctttttcacccttaacttagatggatctggaacataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaatgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaataacaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttaggtggaagtcccttctcatcccaaccgttctgcaagtagtcaatagcccgcaacatacccgcatgacgatcatgtataaggcaaacgttgggcctcatacgcaccactgcaatatgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcaccttacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtctagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataactttctgttgcacgactcactacaactgatactgacattgtgtagacttcttggtctattctaaatcctctcaacaaccaactataaattgactgaaatgttctctccacaggcctatcgatgcccttagatgtcattacaaaatctgacagatcaacacaatctggaccaaatctaatatttccttcaccgtgaactatctgaaatgtgaccttatttgacattgtgcctgatgaaaacaataactgcgttaacctcgcatttctgtactacgccctaagttacattctctacaatattgttctccaaaattctaaaagtaggttacattctccaaatcaaactaaactacatcttacaattaacactactgtctatgtctcatttcatactattatattctatgctctggatctacacatatgtgctgtgtgctacagatatgctaaaatatatgaaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatggcccctcgccgcccatttgcaggcggccccccgcacagtacaaaatcgccctcccccagggcggcaagggggccgcctgcaaaattccaggccccccgccgcccatttgcaggcggccccccgcataatacaaaatcgtcgtagcggagggtggcaagggggccgcctgcaaacttcgttgacggccgtcgcccgagagcgaacggccgtctgccacgtcattttcgccgccctctgcgatggcgatttttaaaaatcgccctcccagagagcggtaggcgactacttccgccaattttcaaaatggaaaattatttttgtaaaacttttaataaaaaaaattaaaaataaaaaaaattcgagtcgcgatttgggaggaggggagagaggacgacggtgacggctggtccggtggtggacttggttatgtttgctgggcctgggagcggcccaaatttgctatgcctcttcgtgggccaaatttcgtggttgtgacatgtgggctggtcctggtagccagcccaaatcgcgaaaatcttctttttcaacatcccgacgcacagaaacagagcttttaaatccgcttctgatattaagcaaaaggttaaaaaactattatacactttattaatacggagagaaaataagaagtggggaacactattggttcgatagctaaaaacaagaagaaaaaaagatgatgcagtgttaaagtggtctagtggaatacttcaaaattagatcattccaaaaataatttcttaagctaaaactatactttagcaaatgaaaatgtcattggtatccctcatcatcacacgtataatcaactttgatcagtgattactactttcgaagtggattctttattcgagaattctctcggcctaaacaataatatgcttatgcgcaagaggccatatgccaagaaggccaccacgcccggcccactttccttcactcaatgggcccggtccgcctaagatctaccttttccttttttttcttttgtgtatatgtctagacaatctgtttggttagagggagtttaaaaggatgagactattaactgttttgtttggttgggggatataggaattttggtgggatggggatgaagaattaaggaatgaactccctcctttccaatacctgggtaggggcagggaattaggagggaattcctcctttacttcgcctaaacaaatctcagtcatcggttttcattagtgatctaatctccaactaaactccctatcaatttccaccacctctaccaaacaaaagactgggatgaaaaattaaattcccatcttaatctcaccatcaattacctcgtgtaaacttccaatccccttccctcatgttgccaaacaagccgagaaaagaaatgcgaaaagaagagaaaagaaaaaggcgagaaaaaggcaaatggcaaggggggaagaagagtggaggaagaacctaagcagcaaaccctagtcgcgactacaccaccaccaccaccattgattccgatggacttcgcggagctggaggcggtggagggcctccggtggccgtggcacgcgtggccgccgaccgcctccgccgccgcgtcgctcgtcgtcccgacctccgtcctctgcacgccgctgcacccggcggcgcccgacctcctcccgctcctcccctacgcgccgctccgctgcggcggcggcggaggagggggagggtgcggcgcggcgctcaacccgttctcgcgtgtccaccacgccacagcgcggtgggcgtgcccgttctgcggcgcgtcggccaacccgttcccgcgcctcctcgcccccgacgcgctccccgccgagctcttcccgacccactccagcgtcgagtacgcgctgccgccggacgccgccgaggccggcggcgggccgggccctccgtccgtcgtgttcgtcgtcgacgcggccacctcggggccagagctcgccgcgctcaaggcggaggtgctcagggtcgtgcaggggctgcccgagggggtcagggtcgcgctcgtctccttcgcggcgtcggtgtgggtgcacgatctcggcttcgaggggtgcaccagggtggtggtgatgaacggggagcgcgagctcgagtcggagaaggttcgtgaactgtgaattctgggctaattgacggagccgcttctcaatgctgtggtttgggcaagtttgctcaagttgatccagtcactaggcatgggatttgctttaaaaattatcatattacagagtaaaagctatcgatctcgatattctaagtaaaatgggcattgtgcatttaactttaatagtctgctctcccaattcatgtgagttcaaaattcacactacaatttctgtggtgtataggagttataacaggggatgtaggggtgttcatgtacggttcagaagaaatcatctagagctgcgcatgagcaagtttagtttgtgatggcattaggctaagctgtcagtgggacatggatgaaaattaatacgaccagtttcaagaaactgcctgtgaacagacctaagtggatgccacacctttgtttgctatgttgctcctgtcctatgcatggttcatttatgcatgtagggcagcaactcttagatatgtacaaatgacaatgtatccatgactccatgtagcctaaaaatgtctgaaatgttataattgtagtatgactggagagagtttggcactatctaaataaggcactcttgggatcttgttaatatttggcttacatatgctgttgctatgttgctgttgtctagaagatttggtccttgcaacttgcaagtttgaagatgtttggtttggataggaaaactgtgtggtcatattttcagttgtcccataggctcatatcaatcaatgatccacttatgcaactgctttgcgctttaggatttattatcatcattatgtttaccttacaaaccttctcttattgtttcagatacaggaatttctaggtgttcgtgatgctcgatacaataagttggctatgccaaggtccactaaagtgcagagatttttgctgcctgtttctgaatgtgaatttaacatcacatctgcgatagaagacctgagatccatgtctgcttgcccacgtgggcatcgccctttaagagccactggtgctgctatttccacagctgttgctcttctagaaggttgttgttcacctaatgccggaggtcggatcatggtcttcacatctggtcccacaacagttggtccagggcttgtggtggaaaccgatctcgggaaagcaattcgttctcatcgcgacattttcaatggcaatgctcctctcattgacaaagcccgagaattctataagaaagttgcaaacaggttaacagctcatgcattagttcttgatctatttgcttgttctctagatcaggttggggctgcggagctgagatacccaattgaagtgtctgggggcttaatggtgcatacagaatcatttgagtctgagcagttcaaagcctgtttaagacacatattcaatcgtgagggtgttggttaccttaacatgaactttaatgcaacaattgagatagtaacatcaagggaggtgaaaatttgtggtgcccttggtccctgcatctctcttcacaggaaaaacagctctgttagtgataaagaaattggggagggtgggacaaactattggaaaatgagtacagtggacagcaaaacctgcatcgtgttcttcttccgagtggactgtagccataatactgagcccccaactgtcttctttattcagttcatgacgaggtaccggcatggtgatggtagctatcgcctaagagtaacaactgttgcgagaagatgggctggacctcgttctcctgagattgcagcagggtttgatcaagaagctgctgcagctgttatggccaggcttgccgtgcacagggcagagacataccatgttagagatgtgataagatggcttgataagatgcttattcgctttactgccaagtttgggaactatgtccctgaagatccatctacattccggctgtcaactaacttctcgctgtatccccaattcatgtactacctgcggaggtcacagttcattgatgttttcaatagctcccctgacgaaactgctttctttcggttgatgttgaatagggaaggagttgtggggtccctaatcatgatccagccaactttattccagtactcgtttgatggcccacctattcctgtgttgctagatgtcagctccatctctcccgatgtcattttactatttgattcatacttctatattgttattcattatggctcaaagattgctcaatggaggaaacttggctatcataaggacccaaatcatgaaaatttgcggaagctgcttgaagccccagaagttgatgcggaggcactattggtagaccgtttcccagtgccaaaactcataaaatgtgatcagcatgggagccaggccaggtttcttctagctcggttgaatccatctgtgacacagaaaacacagctttcagatggttctgaagtcatattcaccgacgatgttagtttgcaagtttttattgaacacttgcaggagctggctgttcagggttagtgaggcatggagcctggcgatgtttccacttttgcagttggacccacctctgatcctgaagatatagctttcagaaggattgaatgtcatattcacagatgatgtttgcttgcaagtttattgaacacttgaagtaatttgctgtgcaggattgatggatcatgtggactgtttatatgttactttctggtcttctgttatcttgaaagttccgggagagctttactgcttggaaggatgggatctcctcgagttgttgtacatttcaccagctccagtttgatgtaagccatcacttaatatttttgtatagaatgctataatgtctattatttatgctctacaagtgctggagttctcttgagacatttgctaatttctgagcagtaaaacaccctttgccttccaattctggtaatgcaataggaccgttatgttgttttctggtggattgaggattttaagtcactcttctgttggcatcatacgcccttaagcgcagccgtttaattctctgtaaacacttaaaattttgatatccacaattcttttggttgcggtttcacactttcactactgtgttgcttgtgtgattcttcaagaacgtctgttatttaatactgcccctagagtttatcatatgatgtttgacatattatagaccaaacataacataggcatctttatatgctggaagcatttccctgtcataaatgtgtgctgaatagattatggtttagtttgtttatgcaatgtacttagcttaggtatcaccacagctctagaaagagcaaggaagcttcatgctatgatcataccatcatgtgtcaagacccaaccttcttaataactcaaaagacagataggctagagttatagtaatggattccccatcaccaagcacatggcttgttccccccacttgatcacaccaggttacaaaaatattgtgctgatgattaacaaacatgttaacttaccagataccataataataatagtctcattgataccctttacttcacaatcacacaaacttaaattaacaacattggaataaaatcatcaagtagatcttgggacacacggtaggggacatcacataacaccaatccagctacacacaaatagattattgcttctggtccataaacaaattaaacatgacaactcttccttcttttaatccagctaaacaagtaaaaccttatatttctaaggaaaccataacacactgcaagaacaccattcttatggcaccatgctcagcatcttaatactgcaacattttcagctcttgttcttgtacttgtcctttgctcttggtgctggaagaaaaaccacacacacaaggggtgtgaattaagatataaatcttgacacgaaagcaaattttagctgaagatactgaccaagaccaatggcttcggaacccttcatgatcctcaagcgtttgcatgactcgacaaacatcctgcagagtaaccaatcagctaatgcgagaaacttgaacgtggtatcgctaaaccgcattctaatcatgaggtggaaaataaggaaaacagttaagggggcacaagaatgaagtagtaacatactgccacgggacatctccaacaagcatccagtcaccatccttgtcttcataagttgtaacagcatcagagccattcacctcattcatattgttccctgacagagaggttcatgcacagtgttttcatcaattccggatcaaactttgcattcaaattaattactagttgataatctgtttctgcaggttcccgtggccagcgatttaccagttgcggtgaaggtgccgaacatcttctgcagagcaagggagaggtccttgtagctgttgtacatcttcaggtccaccttgcgcaggtagggtgccccgtccatgctgaccttcacgaaggcagagctgttgctgccgctggcattggcagcgggctgctgctgctgcttgtcagcttcctcttccttcttgctcttcactgactggacggtcatgatgttcctgcggaacgaccgaactggtggccaacccactgcctgcgccctgatgtgtaacattggaaattagctactacatcgatttttttttcttttgctcagttttttcacatcttgttctaacttattggcgctgtgaaaaaactgagatgatttactttcgtgactggaagttccatccagctagatcatgcatgttacaatattcttgctggcgaccaactctgtgttaactaatgtattatgtgtgtatgcctgcagcaactttatggtagtactgtgtgtataatgaaaatgccatcaactttagttattgccacatgaatcatggccaccatgattatttcaggaattaattgtatacagatgtactccttttctgatcgttctaaatattttgttgtgatcctatcttcttttcaggaaaaaaaataaatcaaaacaatacgaaaacaactcctttttcagatggaatctgccaggagatgaaggaaaaaataaaccaaaaacaatagtagtaccactacatcgccagcaatttctgacacctgctgcacaaagcaggcatcagatgagccaatggtgattaaaaatggtgataattatctgctcagcactttgcaagcgacaaagaacatacacgatggtgtcgccatatgcactttctgccagaggatctcttttatatggataatttgtgcttcttttaaaggtgttgcttcatgggcatctcaagtttatgcagcaagctcccaaatatataaatccaaacaaaagaaaggaagagaagagggggggggggggggggggagaactaactaataacctaaacatgcatacaccttttcaccaaatgccattatgctgctactatatgtggatctttttccataaatcaaaactaaacatgcataaagttcctccaaacagcacaccaaataattcatcttttatccctttagcaaaaattaacaatactaatcccactaaattctcactaattattaagtaaactagtaattagacgatgcaactatatatacgaaggatcaaattggaactactgtaacatattaatgccagatttatatatgaaaaaataataaaatcatgctaggtccagtacatacttgggagcaggtggcttctcggcgtcggcggcggcggcctccgccggcctcttggccttctcggcggccggcgcctccgccttgccggcggcggcctcctccatgccggcggtgggcagcttcagcttcaggtcaatggtctcctcgaagcccctcttcgcggccttggccgccgcctcggcggcgccgccgccacctccgggcagccccagccggagctccgtcccgacgtccacgtcggcgccggccatcgcagcagccgccgctgccagctgcttagcctatcgcggctatcgcgtctcctcgccccaaatcaagctgccttctcttctctctctttctctctatggagactggagatttttaagcctttgtggtgattaggaggtgttggaagaagagagaggagccaagaacagcttggagatgagtatatatatagagagagggaagagaagaggagaggagagagaatgcatggtaaatattctaagctaggtagggtggtagagagagagaagaaatatgagttttattttattttttattttttattttggaggggaagagaaagagatcagttagttagagcatgagtgaggccacttggaggttagtagacaataatttttgcatccatgtttcctccggttggattctctattacaacttacaagtatcaagtaatcaaggttaggaggctagagagcaaggtgtgtaactagtgaagttccattggatggttgttcaggatttgtaaagtgttcctgtgccataattgtagctgtggttagtaactgctcctagctacacccaatgtgcataaatatatgacttctggaagcttgcaattagagtttttttttcaaacgtattcaaaaacatatatttgtcaaacaaacacaccttaaaaaatatttgtcaaaaaaaaacaatttccatattgtatcatccctctgccttcaaatacttgtcgttggacgcttttcatcttaaatatttggttgctcgtcttttttataaaaaaaatatttaaatacttcaaaattattctatattaacgaagtatgttgcatcctaaactattcataatactttcatacattatgatctaatcattcagattttattgatagtctaagttaaagtcgtgttaatcaatggtggtatttatttatggaaaccaaagggagtttttttttatttttatttcatgttcatgctacatataacaattgttaaagtaatattggaggagccgcaccctcttgaacaatgagagcaacattaagttgaattgtacatgttttttttccaattacagatttcttgtaaaaaaattaaaattgagaagcagaggtcaaaagtagtcatagcaaaggctacagagaaaatcagtttgactttaataccggataaacataagaatgtaccttattttttataactatatttttttcatcaataaaagagtgcaaaaataagggggaaatgatcttggttcttaggagtattatcattagcaaatttcataaaaccccacctattatgtagtcttagttgaacaaaaccactaaaattttggcacgtgacacataaccccggttctatggctatcaagttttacaaaaccataccatcaatcatttagactttgatataccatattttgaagttctaaaattacatcccaaattatgagttttgtatctattatttaataattgttactttcatggaggtaaagttttataaaattttgatatgtgaatatgttaaattggttaatgttgtggttttgtgaaactttaagggcccctttgaatcgcagggtagaaaaaacggaggaataggaaaaacataggattctgacaagaattgaagtgtaaaacagaggattgcaaaacacaggaaaaacacaggaatggtcgtttgattcgagcgcaggaaaaacgcaggaatcggatgagagagatagactcaaaggaaattttccaagaggttggagctcttgctaaatttcctccaaaatctacatgcaatgtgtcattccataggaatttcataggatttgaaaagcttcaatcctttgaatcaaagggccaaataggaaaattttctataggatttgaatcctatgaaattcctacataaatcctttgattcaaaggggccctaaatccataatacttgggatgagttatgtggcacgtattaaaatctctttggttttatgtaggtttgatcatgatacgtgtgattttatgaaatttactctgttattattacactgattttcttgctggcaatgcaactgatcccaaggctgcaggatgtagaggatccgggggagcctagctcgcgccggtgcatggacccatatggcgccgggcccaccgcgcaggccccggtggcacgacacgtgtcgcctgatgagctggacggcgccgattctgccccctccccgtctccccctcctccggcgtgagggcgtgacgcgatgcctgacgtcaccgccggattttttcaccgtggggccgggctgcaggtggggacaccgtggcgtgtggggctcacacccctccgcggcaggatctaccttcgctttattctttgggtgatgatccacttgcagagatgcatgcatgcattctgaactctgaagccaaggctcaagggaagaatgtgcgtacgtgcaaatctaaaaggaattcatgtacagtttgtgctactaagttttttttttcttgttctagataatgtgaaaaaaatatgaatgtcaagggtcaactctaagtaaattcaaaagtacaaaatggcccacaccaaaaagagatactcagtcgtatccaaatgcatggtcaaaatttgaaatttaacacagtcgtatccaaaataatactccctccgtcctagaaaaaaaatatagagttttagagtttgacacggttattaagaaagtagatagaattaaataaggagttgtgatttgttgagaagtggaaggtatgtgggaaaagtaaatggtggagggttgtgattggttgggaagacagtgttggtggagaagttgctatattttgggacacattctaagtgctaaagttgttatattttatgacggggattttaattcactctaaaaaaagcaatatgttttcgtcggatggaagtaaaatggattcgagtaggactatcaaacaaagcgagcacattcaaaattcgagttcttttgtctcaatattggtactgtccttatagatttttacttcctccatactaaaatataagaatgtaatattaaatgggatattttctaatactacgaatttagaagtatattattacattatcataaaatgccccatctaattctagattcttatattttgggactgatcttgaaactttgtgagaattcatattttttttgctttgattagagtgtactaatactagcttcggaggcctcgctcgtttgtgctagctaaggcaaaaaatagtgaactgccggctgtgcttttgggcgagctgcagcctgcagaggcccaaaatgtctcaaccaccaaacaaattatgaacaacaattactagcagaaaaatgaacaaagcgataaaaaaatttatgtgtataatttctacgtttatatatttgtcaattaaaagctactgcgtcgtaatgttgtaaaataagtacctcaaaatcaactcaaaattaagtttgtaaaatttattttgtttactgcggttgataagaagaaaaagaagaagatcaacaaacaatcagtatgaaaaacacatgtactctacaagtactagggtgtagctctatccttctacccttgatctactgtatactctacaagtaggctgaaggaaaataaaaaaataaaaaccgaagtgaaaaaaaaaacatgacgtatatctgactttgatgggcagcacagcagcaagaagaggagttgttggattcccaggcctccagggtggtgggccccacgtgccgggaggggtggggacaggtcaactcaggtgtcggccccaccactcctgcgtgcatgtgggttgtgaaaaacggattctcagctccacgcgaccaccttatatattcccgcccaaattaatcaactactaaaaccaaattaatcaactaattaaaccgatcgagagagcactagcctacctagcttaacataatggcataggattagtgctgcataatttaatttagtagcagcagcagcatttcttggcttccaatcattctccagccagccagccatggatcgatccccaatttaacttaattattagtagcagtatagtagtaagaagagaagcatgatttgatttgtttaattaaatccgtttgctcagaacatagttactcgaaaaggcaaattagttaacgctgttaattagtggcagtgtgttcagggaaatctctatcagaatctatgcagaatttgacggtgcatatatatatacacacacacatctgccatgtcctactactgagtactgactgatggagcttgttaattgtaagcccctgcatgtatgatcagtttgaacataatccgccctgttttacgcaaagatcgaattaattgtgcagaactcatggactaatatgcgtcgcgcagtccccgggataagctaattgagatgggtgatgagagggcagagtgatgcctagcaagtacaagaaaagtcctgatcgaaatgcccgtgtcccctcaaaagcaatacgccaccatctattgctagctagctaaaccagcaatatcatttgatttgtttcagtccatcagtaaatcgaagtgatgcatcagtagtacatccatgatccatatgcaatggattccctgtcctggtgaggcatcggatggcactactgctttttttcccctccagacggctggaatcacttttcccatgtgggtggagcaaccgcctgaaattagatatacgtacaaaccaggatttttatagacgggcgccacaaccgtttgtaaaaaccgatttttcctggtgagcacgttacgatgtccgaccgcaggaatctttagtaagaaataaaaagtctaaaaatatattccataaaccttagtttagatcgtgttgatggcaatatcgtctccgatctagccaccggatccacacctctggaggcnnnnnnnnnnnnnnnnnnnnnnnnnctgtcattgtctctgctctcagtgcccaccgacagcggatccgtccttcacaagactggcaccatcaacgccgccactactggggtcacaacgatcaatgttgccgctcgcatgcatatcggcagtggatccatcattccagaggctggcatcgttgtcgtcgctgcttctgaggttgttggccgccgttgacgaaaagaggaaagaggacccaagtggcgtcgactcactgcttaagagagggaaaaatgaatagaggaaagaggacccaagtggtgtcgactcaccgcttaggagagggaaaaatgaatagagtaaagaggaggagagaccgagggaagagactagggggaaagagcgggctcaatgcgccctttgattttaaagtggtcgtacgtcgttggtcgatgcgtctggttgtttagatcaactaaaaaaccaccacatgcgaaagttaggttattttcatagacagactgtttaaaagcatcttatgtgaaaatcaattttcacatgaaaatgttgatcaagtgtgttctccgtattttcaccaacaggttttacttaagccattttatatataaaaaaaggagggtgtttatgaaaatagtttattcatatatagttgcggctgatcaaaactcaatgcaataaaaccagcgtgccacgttactagttgtggtgtttgcatgatatatccaatataattaaccatccgttagatcgatgtttgttctgctcgcgcgggctctgagaaattctcgagtgcatgcatactgttcttcgtgaatgggcagtggcggtagcgggggcgagcatgtgatgtggagcgagagtagtggggtgtcgccggcgcgtggagtggcacgaacggccatgtgccccgggccggtgcaccccccaccacccctgacgtaccaaacgaactcctgcatgcctcacgaccgttgcatttgcatttgcctgtggctacccccagcttagctactctctcttcgtctcaaaataaatggacttttcactcatctcatacataccgataaaacactagattatcctttattttatcaagatacaatacaatctattttccaccttatctactaacaatacaattattctttactttctactttagagagtagctagcaccgtgttgtttctctgttctgcatctactagctagctagctagcctgggtctaatttaaggccctagctaagcccctatccaaagcattacttttctctctgcctgttactgttagggatcctaatcttatctcaccatcgtgattaataatcatcacacatacatactccttttattttagggaatagttattaattactccctccattccaaaatataaggcataaccacccctaacccaaagaccgagaaaataattattatcatattgtagtttggatcattctaataaatacaatgtatgcatccaataaaattagagaacatgaaagtggatgatttaaaaaagtaataatttaatggagaagagatcatagttaattacctacatgcatacatgctttagggcagtcccaactcatagtgtccataaatagtgtctatggtgccatgtcaataagacatcatgatagaaactacactccacaaaccatggtttcttaaagtgggccattaataaatacatcatctctcttctctaccaatcatatttattcttcatatattatgaagacactattatctcccaatgcaaaacttgatagtgtctagtgcataggttcttgtgttgaagctgtgtcttgcatgagacccagtttcttcctctcttcactctctctcttaattaatatagtgccatataagttaaaagtcctacatgacaatgtagttaatgccatagacaccatcctaggtggaagattgggactgcacttatattatagaatatctaaaagtggttgtgccttatattatagaacatcattaaaaaattggtagaatggagggagtagttagttaattaattagggcttcgttcatcgtcaagacctggggattaacatgaaaaagtttagcacaggaacaccgactgttacatcgaggacaatcagaagattggaagttccagtggcgcatcaagtggctctgaagaagagaacctctgatctcgacacacgatgccagctttttgccggtgatcgacgctgaccgatgataggatcccagtaagtaattcgtgctagtaataacgtgttctttagcagaaatgttttttttaaaaaaatcagggatgaatttagagaatctatagcaagactattcccgccatctcaaaatataaataatttttaaaatagtgacaagttaaatctttataactttaactgttaataataaaaataaaaataaaaaaagatcaatcatgtaaaattaatatcactagatttatcattaaacaaactatcataatatgcaaaactttttatttaaaatattttatttttatagatattgttggttcgaatactgtgtcgaaagtcttaaaaatatttatattgtgaaacgaacggagtggcagttatgatcaagcattaattatgaactgatcaacatgattgtcatccttttcatcacaagcaatgcgatatatacatgatgtggaagtgatagggaatggagaaagagcagaatacatacatgcacacacctcatgattcatgaatatatatacaataatgctccgtagcatggctcacacccacagataatccatagaagtagcatgactcccaattaagctaacccccctaattattgtattaacctgtctagaaacacgttcctgttgcatgtgcccgattcctcccccggcctacacacacaccgatcgatcgatcagtctcactggccgtagcatacattgcacgatccaagaaacggcaatgtagaggcatgcatgcatgcattcagaatgagatcgaaaactacctgcaactagcccagccccagccaacaagtttgcacactggcaaatgccaactcaataaaagtactcccctttacttcctctgtcccacagaaaccaacctaatactgaatattgacatattctagtattataaatttagacagaccttaacatccagtattagattaagttttttttgggatgaaggaagtaaaatataagtatttttaggttggtaagagtattaaaaaggcatataggaatattggagaaaatatatgattggttgaaaagagaaaacagttaaagatgaatgattattattggctgagagtaggagataaatgaaaaaaaaacctaactttaaaacaaactactgtgatataaattaatagctattgccgtgtttagttgttttggtaaaaaaaatttgacatatacagacacacatttgaagtattaaacgtagactaataacaaaacaaattacagattccgcctgaaattgcgagacgaatctattaagtctaattaatccgttattagcatatatttactgtagcaccacattgtcaaatcatggcgtaattaggctcaaaagattcgtctcgcaatttacatgctaactgtgcaattgctttttttttcattcacatttaatgctccatgcatgtgttcaaatatttaatgtgacggaaaagttggaagtttgaaggaaactaaggccttgtttagattctaacttttccgtcacatcgaactttactatacacaaactttcaatttttccgtcacatcgttttaatttcttcaaacttctaattttagcgtggaactaaacacaaccataatattagtactgtatactactatgtacagtacacagaccctgaccagctagctgctggggagctgtgcctttggatcagctgaaaattgctgcatttctctgcagctgccgctagctgacgccgccgtcatataagcttggtttcccagtgaggttttacactgctctctgacgacggatggatgcatgcatgcacgcacgcactgcagatgtggtgtccgagtagcacggtgcagcgacgtcagatgcacgtcgcaatgtcgtcgtctacgggaggcagcagggaggcatggaaacgagcccatgcccctcccgagtacgcacaggatcgtactatacgtacagtactactgtgttggattttttttccccattcagtgcatgcatatgcactccaatttattgtatttttttttacggattgaccttttggatactgaggtgtggtggtacggtacggtggaaacaatgcagattttgttagcagtagagctaataaccagctgagatgtgacttttgagatctatgcacgcgacatggcttcattttatattgatgtgcgtatatagatgtcagaatgttcatatcagattaatgtagggatggtgaaaataagccccttgtttagatccaaactttttcttcaaaatttcaatttttccatcacatcgaaactttcctacacacataaatttctaacttttctatcacatcgttccaatttcaaccaaacttctaattttaacgtgagctaaacacactcagcgtacgccttgacgaatgacgacgcagcgtacgcatcagattgagacggtccaggccgtgacggcaaaattcagcttcaggcttctgcactggtagcttggctagcaccagaaaattaagtagagcaaaagtgtgaaggtagctagcaagcggagtgaagaggaataatggtcatattgaggagagtaaagttacgtggaaatgttgtttaagattaagatttttatgtggtatttattttaaaaggtagtactataactaaggataatttggctagaagaaattagaagggcatgagtttgagattcttttttttgcatgaaaagtaagacgatacattatttattttttaattgccactttgctaattttttctaaaaatcggtacagttctcttttggtctatatcctcctagtagtatatcatatatatttgagaattgacttgtgggtattgatataaaaacaatgaaactaatccttgtagaaacatctgctatatgttgggtttttctaaattagtagaaatgatatggtctttgataaatccccatctaaatcttatgtataggtactttttatggcaacgtaaaggcttcggtttctgagcacaattacaaatacatgacgagaacaacaaactcatgcgtactgcatgccttaagctagagagacaacggatatatagatttttgtcaacaatgttgattcttcgttgagtgttggtggttgacattagtctatgtttcacttccttctttttttttgctctttgtaagtaatattttgtgcttttttttattattgaacggatatttgtaacgagtggttgtagtttcttcgaagcaaagactgaaatatatttcattacctaaaaaaaaggctagcggagtggaggaagcaagctagcatggccgacctgcctgcctgccaatactacacccccaaatgcccggcagacgacgcgcacgcactggcgtggcctggcgcccatgccatgcacatacagggccgcacttgcacacacacacagtcacactcgcagcattattcctagccttcgatcgatcgatcgatatatgtcgagataatctatatctgatagagcgatagagatgacacgatcacgcgacgagtcgacgagcgctagctaacaaaacgaattataaacgtacacgatatatacacgtgtgtggggacgatacggcggcgaacgaacgaacgaacgcatggggcgcacgcacgcgcgatatggctgtaggggagcaatgccgtgcagccggccggccgcctcaactcaatttccacgcccgtgctgtcgccgtcggcgcccacgctcgcgctgcttcaattccatcgcgatgtgattttccgtcgtctgtacgtacgtcgcgctttgccttctctccaccgcgcgcggcggcgcgattatggttgccagctactttctctattttacaatgtaagactttctaacattgtccacatttatatagatgctaatgaatctaggcacacacacatatatatatatatattcattaacttctaaataaatatgagcaatgctggaaagtcttacaatctgaaacggagggagtagcatgtttaggggtgaatctagcgtgggtgatggaaaactcgggtccccctacgacttcactagatcaccatcgatagaaagagagagagagggggggggtaaataagggagagtacgtaagatgagaagggggactggacgaggaagaaggagataagttccatatattgttttttagatccatcacggaatatgttgatgtatgcgtactgttacactgcagtaagttgtggtggtcaatatatattaagaggagaggaaatacatgtaccatcactaaaataaagtgaagagagtgaaacatcctctttactcgcatgaatggacgagatggacgatatattgtgtgtaatactattcacttgtgcttgtgtcttgtttatatgtcttttggagatttgcttacgagtggtatattttaacgccattttagggcgaatcttgtagccgacagatagctagtgccatcaacctggatttatcatgttcctgatgatggaacagcaccggaaaggttaagttgctacatgagttaggaggtaattaaactaagttgttgccgacacacacctctcacacgcttagatggccatatatatgtttttagagaaaatgaaaacctaagctaaatatgaacatatcatattatcttatagcaatttactcaaaaacaatcgagacaagaatataaagtccctaacatctactccaaaacaactccttcaagaaaaaacgcaacatttatctatcattgccatcagaaacatgagatttttatctgaagcccgagaagacacatgcgaaggaaatacaaataaacgtcgatattactgaatccaggtaaactagagattagatttttcaccctggagtcatctccattactccgtgccaccatctagattaaatgagcacaatctgcgatgtgtagccaccaaagacaaagtgctaagcttcctctattcacaatcaccagcgaatggatgaatccattgtcgagacggattcatagaaatagtaaaataaaaactatcaacgaatatatccaagtgtgtcccacttgatatcttcatgatcagaatggaactcgttagctcagctgcacggaaagacaccaccaaacccttcattagctaggccaaatctcccttcctagatctcaatctaataaaacttgctttcggtagatcgatctataaacccatctgaaatatttcgatcgagaaataggaatgcacatcacattgtcgcattggctggattttcaccttttaaaaaacttattctacaaatagatccctaaaaaaaacttattctaggaatgaacccttttcgcggcgccaacgttattgacgtcaataacgttggcgccgtccccctcatccccaggtgaaaactaagtcactaatatctcgttggcgccaaggacctttttgtaaaaaaaataaaaatgacatatttgtagcagaaaaggacctatttgtaataaaacactagtgccaatgacctatttgtaaatatattattattataaatagatcctatattttaaagaaatacaaattaaataggtacttggcgccaataatgttaacgccgtttcccttcacattagtgacttagcttccatcgggagctagaagaacgtcgccgacatcattgacgccatcccatcatgttggacctaactttggcgtgttgagcaaaaacaagtcgctacaccacaccacacaggatccaacacggcaacgtacatccatccatccattcatccatgcatccgtcgcgcgcgtccgtgataccgcgcagctgctcatacgccccacatgtgtggccggttgggcgcgcgcatgcgtgcggtgtgccttgccgaaggggatcgatagatggccataattttgacaaattgacccttccaaaaaacttattttaaaaataaaccgtgccaaaaactaatttcaggaatagaccgtggcctcagcgccagcccacggttttaacactgatatcagcgccaacccatttggcgctaagctcgtgtcatggtggacaaaaatctcagcgccaacgccggtggcgctgggacgttttagctcacattagataaacaagtgaagctagcctggtggtagtatcgacaagtttgaacttgaaggtcacgggttcaaacctcgttagtgtagtatttcttttcagtttttcttttacttatcctccacgaattattgtcctattaatttcttttccaaagaattataaatataaaattttaaacttgaatcgtataattttggttcttatattcgttccctctaagtctaaaaataaaatgaagttgtaaaaggcacgtgaacattcaaaagaacacataaaaagagcaagttgagaaaaacaataattaaaatgaagaggacaggaatcaaactcccgtgccttggattgctactacgcaacaccaccactgagctatctacgcttccttgcttttgaagcacctatgcgattttatggtatacagaggtcagcgctgtggagtgtggcgctgagctctccatacaagacgagtttgtaccacggcagatgaaatctcagcaccaactgcagtggcgctgatacgctttagctcagcgtcaatgacaggccacggcctattcctgaaattagtttttggtacggtttatttttaaaataagttttttgaaagggtcaatttatcaaaattacgggatagatggagctcgagcgggagcgcgcccccgcccacgtgtgacagtgtgtcgatgacgacggatgagccgaggcgcatgcatggtggccggccatcagttcgccaccggacgacgtacgaggatggattctcatgtgggagtggaaccccggcccgctgctcgcctgcttccctgcatgctgtcccggtgcgtgaggtgccgcacgtgcgtacgcagtacacggtagctagcgccatgctcgtggatcaacgtgatagtagtcgtaaccagggccctgcaggaaaggaagctgctcatctctctcgtagaggccgatcgagctactgagcaccgcgcgcgtcgtgggtatttttgccgtgacaggtcgatcagccactggcagctagttatggcctcctgtagatggtggttggaccgtggtgtggatatcggtcagacacatttgggtgtgtattcataaattatccgtttgttggtggcttcgactcaacaaccatacatctttagattaggaaacggttctgaactgttgagagggatatcctcttgttttttaattattgaaatagttataattttttttagaaaatatttaataagatagattactccataaacatataaggttaatttaacttctacaagctgaaaagaaaaaaaatagtcgaccaactatagtttgatttgtttattcaactaataaaatttaatattaacccgcatgtttgcggattgatacatatatagcatattaaccattttcttgattttctttaaaaagtttcataacactatttgaatgacatgcaaacaacaataggatgttctctcaagagtttaaagtccacttccctctagattgagggactgcttatgtaacatttgcgaggaaatccatttcatcttattcacttttgaactacccataccggtttgagattagtgctgctacgataacttcaccttatccatctccccaacgccgcgtcctccagattgagtagatcgatgtcaatgtcgccgcctcccctactcagcaaggtcccccgcccccatcatcttcactgtctccagtagatccggcctgtagctaaagatatcgccactgactccgtttcctccaacctcgtggttctagcagcgatggcaccaccacaatgtcttcttgtgtttgcacgcccacgattatccctctaagcccaagtggacttcattcccctactctttgcccaaattttgatcccaaacctagtaattcgtagctcatctgtcagagttgggatgctgctgccgtcgaagaagaggaggaacttacgagagctggaggagatgggactcatacatgaatcttagcgcagatatatagcggtgaagaaatctctttaaattttctgttggatgccgtttaacaaatctattagctatctatactctcatgtatgtcagtgtagacacgcttaggcaaccaacaaactagccatcccgaccgttcgaattgaaccacacgtatgcgcacaaaaaaattaacggagagctcgatgtgtggggccgcctcagagcaaggttaatagtagagctcgctattggctacaaaaataacacatcatcctgttatagctagtttcaaaagctaataaataaagtaatgagctctatagttatctctacctatttctcatgtacaacttttattttttaaaaaaatcttaagtagtaccatttgattggctgctcacaaaggatgtacaaagtcacacacatgcagggaaaaaagctaggcctgcagcatgggtagccagcgcctctctcctttcactctctctctctctctcttccaactagataaaaatttactatatgaaacactatagcctactgatgtggacttattgtagctgctctcaccggccggccggaacgcacgcacgtagacatcgacgtacgtgcccgacgacgacggtcatctcgacgggcggccggccagccggcgcttgtctcgcctagctacaaaagcagctacaccacacgcgatccaacacccattaatccattgcgaatcgcgcgtgatcccgtacgcgcgcggccgatggatcgatcgatcagacgatcacactgcacacacgcgcgcagagccgtggcccgtttggctctcccatcccatgtgtgtttagttcacgttaaaattgaaagtttggttgaaactagaacgatgtgatagaaaaattgaaagtttacgtgtgtgaaaaaattatttttaatgtgatggaaaagttgaaagtttaaagaaaaagtttgaaactaaactcggccgttgtgcggtggtggagggaacccacgctgcttcccgccgtacgtacgcgtcgcagcaatggaccaaataccagcaagctgagacgacgctggtcctactgatccatcctaatgcagtagttgtagtgatggccactcgcttttctttggtagctgcatcctactactgcttacacagtacagtagttacaacttaaccggggccccgtgaacgggacctgctccctccatcgatctcgcagcaatccgaccggtccctccccactgcacgcacgaacggcatgggtattcaacagctaattatctaggcaccgacgctctctctcacaactcacaactcacaagtcacaaccatatgacccagcgacgacgataataacatatgacaccgatggctactgacaaactcatagaattcgttcaccgatcgatcgaccgatgcttagctagccaccagccaccgcacccgggcccaagccgaatccaaccatctgcaccattcgtttcaaaataaaccaactcctaactacggatcagtctatgttcgttgataggattgatcttttttttttggacggaaagcaatagctcttgcaacgtgcgtgtgcgtgggcgtggcggacaaacagtggccgtgccgtgcgtgtccctgttgggtctcaaccgaacaacagtggagcgaaccgtggcatccggagacactcggacgacatgagcagtttcacttgtccccctccctcttccctttgctcgattatatccggctgttcagacttcacacccatcagagcactgcactgcaatgcatatgcgacccagaattagtgcctacttggactattgtaccgctgtcttaagactattcccagctgctaatacgcgtaccgaactaactggtacttagtacttggcttaagatagaattaatttgggctgtaccctgtacgtactttgcattagtacatagtactaggctactagctatagctaattagctacttgttcgtaatcaaacatggtgcagaaataacagtggaaccatgtggccagtggatgtatatcgatcatacatgcaatccactgatcctgtgtcgatcagacgatcgaagcgtctcttacttgttctcttcttttgttcggttccctggaggctggagataggatccatatcacacaaaggtcccattcattctccaataagagttggacgaagataaagatttttgtggcacacttttcaaactgctaaacggtgcgtttcgtgcgaaaactttatatatgaaagttgcgctaaaatatcatattaatctatttttcaagttcgtaataattaaaactcaatcaatcatatgttaataccgtctcattttgcgtaaagaacttcatcttcattttcgggagaaaaaaaataccaccaaagtgccactcgaatcacatcaaacgctgcatgcagagttgataaaccagacaatttttcttttgaattcgctcgatcgagatatatatcgccgtatcgatcgaggaatgtacagactggtgtgtcgatgaggagcagggatcgctggtacgcaatctttcctgtcgcctaaccgacatgagaggagggatccatcgatcgatcgatcgatctcatcacccgttgattaactcctcgtcgccaaggttcctgacagatcgaagatccggattacgcttttgtcgatcgatcgattcgagtgttcggtatagacgagagagaaatcgatcgctctgcacatgcatgatggttggtcggtattagtctgatgaactctgacgaagcaagttgatggcagacatggacgggactgaacggctcatatcgaaaagcagatgacatgtatctgctactagtactacactgctggtaatattcctcgggagcaattgggttttgatctggtaaactgaagatcatgttggttgtgatcgagcgataatggtttgccaatggcatacttaaccaggggaatgtgatcagttttcattgtcttgtttgatttgatgagatggggggatggaggtgacgacatatgatgagcaggtgaaggtacaaaactttatggccccttttgaattggaggaaaaatgttcaaaaaaaaaagaggaattgaaatcctacactattcatgtctttaattatttatgtctttaattcgtataggaaagaaaactttcttatttctacgattctagttgaaaaatgtatgaaatttaacatccactctaagtctctaatctcttgaaaattttctttgaatttatctctcttatttgattcctgcgttttttctactgtccaatcaaatggttattcctgtgttttgcaatcatctgttttacacttgcactattatcagaatcaagtgttttccctatttctctttttttttaatcatgcaattcaaaggggcctatatcttgctctcttttttatactaaacttttatcaggggacactgactgaaagtgattagaactggacaagctttcctggatggattagaaagacccttgtttttcatgtgacgtgaatcgaccatggtaaatatggtatccctagaacaaactgagctagcaccgtatgattctcgtctgatttcgatcttgcttgagcataaacggatttcactatatgggtacatgcgcacacactttagtttacacaatttagcttagtactcatttggtttaaaggatttctaaaagattattgtactaattaaaaccataggattttttttatatatacattattcgtttcaaaattcttaagaatcatagtcctataaccttatcgtatatgattcttagtatgagatagacattttagaaaaaaaatcctaggaattggattacatgtgacatcttaatttttctatttttcatattcttatgatttagaaattcttcgaaccaaataagccttacccctccataaaagaaaatcctaactacgaatctaaatatatatgtgctcaggttcataactagaattgtcttttttttgtttttttaacagactagtatggccgttgcaagttgcaacagtgagtttttttctcgggcttccttccagcgtagcgcaattagagggtgggcataatattcagcccatgaagtaatttcgcggcccataatttggcgaacgtttactttagctgttgggcctctgccacgcggcgccgcctcgccgtacgccgccgccgccgccgccgcgaaggcaccggctcggaggcgctgcgggcgccggcggcgaggcggccctctccggacggcctccgccgctcccaaacagcgacggtggtaccgccgcccggggagacggcaggcgccttcgacccgacgcgcgctcccgtctcgccggcggcgggatggcctccaccgccggcgccgggaggccgccgtgggacccgaccgtatcgctccggctgggccacccggcgctcgtcctcctcgagcggtgcggcggcggggcgcggccgttcaaggccatcctcgcccacatgctccgcctccgcctcgccttcgagaccttccccatgagcaggctcctccacttcgccaccgtctccttcccgcaccacgcgcgcgccgccgagaccctcttcgagcacttcacccctcgccccaacctctacatctacaacctcatgctctcttcggccgcggcggcggcggcggcggcctcctcctcgcctagtcgtcggccggctgctctctacatgtcgatgctggcgtcatccattcaccccgatgagcaaaccttcctgtcgctgctcaagtcggtggatgcggagcgccgctccgtcgggaagcaggtgcacgcgcacgtggtggtgactggcctgcattcgcgcgtgtacctccggaactcgctgatcaagatgtacctcgacgccggcgatgtggaggcggcggaggcgatgttccggtgtgcgccgacggcggacgcggtgtcctgcaacatcatgctgtccgggtacgtcaagggaggatgcagcgggaaggcgctgcggtttttccgcggcatggcgtcgagggggatcggtgttgatcagtacacggctgttgctctcctcgcttgctgcgggcggctgaagaaggcagttcttggtaggtccgtccatggcgtcgtcgtgcggaggatcggtgtcgcggataggggattgatcttgagcaatgctctcttggatatgtatgccaaatgcggggaaatgaacacggccatgagagtctttgatgaagctggtgagagggatggcatttcgtggaacactatggttgccggattcgctaatgctggcttgttggaccttgctagcaaatatttcggtgaggcgcctgccagggatataatatcctggaatgcgcttctggctggatatgctcgatatgaagaattctctgcaacaatgatactatttcatgatatgcttgctagtagtgtaatacctgataaggtgactgctgttactttgatctctgcggttgccggcaaggggactttaaattcagcaaggagtgtccatggttgggtggttaaggagcatggtactcaagattctttcttagcatccgctcttgttgatatgtattgcaaatgtggaagtatcaagctagcgtatgccgtatttgagaaggccgtggacaaagatgttaccttatggacagctatgatatctggccttgcattccatggccatggagatgtagcattggatcttttttggaagatgcaagctgagggtacagaacctaatggggtaactttggttgctgttctcagtgcttgtagtcatgctggcctgtttgatgaagggtgcaagatttttgataccttgaagcaaaggttcaacattgaaccaggagtagaacactttggctgtatggttgatctccttgcacgatcaggtaggctgtctgatgcagtagatttggccaggaggatgccaatgaagccaagtcggtctatatggggttccattttaagtgcgagttcagcttgtcagaatactgaagtagcagagattgcttcaaaggaactcctctgtcttgaacccgcagaggagggtggatatgttttgctttccaacatgtatgctgctgaaggtcagtggaactacagcaatgaagtaagggagaatatggaaaggaaaggagtgagaaaatcagcaggtgctagtacttttggcagctgattctgttgcttcatatgctaggtaggagtatgtttcaattgtgtaggcagtactaattttcaattgcacacttctttctcccaataaacacatttactggtgcacatgtcatttactcatcctcttctaacctggaagaatgcagttttcaatctggggaataaagtattattcataaaccactagctataagttattggtgaaaactttgatgctaaaacagtatctgggcttacccgctccctttaattgatttcttctaattctttattcacacaacatattctgaatacatattgatttttctcttcttccagcatgcaggaattgaagcagacatttttattcataaaagatcaaatttcagggcatgatctagattcattaagaacaattttgcacttctccagtaaaaaaaaaatcctgcacttctatgtaagctatacctctagtcataaattctgtatgcactagagattgcttctacaattatcgctggttattatttttttataagtgagtcatcgctaattatttgagtgaagcctgcaatgtttgcactagcatttaagtgtttactgatcaaaagaaacttgatatcaaaatctaccagatctatgagataatcccataatcccattgagtcttttgatttcaaatgttattatgattctaccagacactgagactgcaaagtacaaaggtaaaagtatggaagaaattccacacaatgtttaacacgaatataatgtatagccatgatatccaagctttctctgataaaatctcttaactctttgaactgtagctagccaattggcccagaataaattcgataggaagccccatatctttgttagatgctgatcaagtacggcaacaaagaaagtatactcgtaaaccttattttgagaaactgcaaacggaattttctaaatgcccgaaggttcggaactggaaacaaaatcttgtagatgcctgagggggttgtcttaagtgggaatcttcctcagcagtgcaaaattgaagataccgaactagaagattcaggaattttctcttcttgcatagtaaaataaactaatgatgtttttactacaaacaaaccttgcaacttatgtaacgtgtaaatgcatcttttggcaggtgcagtttcatgaacgttgacaagattgggggtgattgggtgacaatggccggcaacaataccacattcttatcaagctacaatcagcaagattactagtcccagtgcagcaatggataatgtgctggtaactgtccatcaggtttcaggtagtgtttatttgttccagtatttttttttcagaacaagaattccatacaagcaaatttattccagctctcatagatgattttttttcctgctgctattttattatatttaagcagaattgtcaatggtcaccaatttcccctatttttcatcaccacctgagcatattaaatgcatttctgctctcaccatctgtaagtatagtttcaccattcgctaatattatgaataacaatatttaattgttacctcatttcctccttgagccatgccatcccttctcgttcaccacgcttcaccatatggcatatgaaaggagtgcctgcacggctgcaccccatagtcaatggtttccccgattcaagcatttacacacaatccttgtttcggattatccatttttaaccacaggtccactgcaccaactgtgcacattcttgtgccatgacaactagtgcacactcatccccagccttgctgagctcacacatgtacagtaggcaccacaaacatcaatgccagattattaacagtgcatgtaagctgcattttgagggtggaattacttcacagtatgctgttgcttgggtggggtagctgatttatgttccaacatgttcctctgtctgttgcaggtatcatcatgctggcatcgcctcttgggaaatgcatccgtgcagttgaaaaaacggatgtcctgctgaattttcattctttgcataccactccctccatcctcgacaaatacaagcactcctgaaagttttaagataaattatggttgggataaaaatattttcatgcctccggttgaatccctcaaccatcacctgattgtttgggatggggagtaggtgaggaaattgaacgaggggtagctggacaaatttcaaacgctataattgctttatatttgtagaggaggattctctcagggccctgattggacaaaaccaagagttctagaaattgacagtacttcaaaggtgccaacttccaaggttaggagaaactgctttactgctgaaagcctgaaacatgtgcgccgggagcccctggaagtattgccatgccaatgcaaaacaatagaagttctgttcacctatattgatgaggacggggctgcgattaactgctacccgtataattgtacgagcttggtatgaatacgatgggtccactcagtgtatgtacacatagcccttgctcgaggagtttcaggaaactgcaacttttcaaatattctatacttttatacaagttacagaatttagaaaataaattgaaagtgaaaggttagaaaatgtatctttcctatattctcgtcggctatttttttttcgcgaacacgcaaaaggattgcacgtcaatatattagattctcgtcagctaatcaccgtaagtttctcatgtatcttgtgtttccaccagtagttctagcgcttcacacatggattattttggacatacgccccatttgaatttgatgaaaataaagattaattatagacatgtaaaacgagaaagttatctatcctatagttgtaacaaatggtttcactcattcactcgttctttcattcctcatggaacggtccagatcatctgtgtgtaaaatcgaacggtctagatcgatcccccgcctcccacctccatcaatcgcgtgattgcgtgggccccactctgattcgccgcccccaacctgcgcgcaaccctctcacttctctctcgcacacggacgccgccgccgccaccatgccgctgcccccaaaaaccggacgccgccacgccaaccactacgctgcctcacgccaatcgcgatctcctccccatcccgtcgctcccacctcccccctcgcgtgatctcctcatccgtgatttcgcgatttcccctcactcccatctctttgcaggatcgctcccctctctcccatcgcgcctcagcccttctgccaccgccgatggtccaacgcctcttcctcagccgctccccctcaacagcagccacacccagccacccacgatccacgccgacgccgccgtcgccgcagtcctcatccgctccgcacgttctcctacgctggtcgggatctccgtccccgtcgccataccctgcacatgagtcaccgaggtccgtgccgccaagacaccatcgcgccaaccctacatccgccatccccgtcgctgtcggccgtctcctctacgcccgtcccaccacgtagaccgcctccttgcctgcatcgtacacttgaaggtctccatccccgatctcctaaattcctatccctaactctttgaattttaacggagaagcccagacttcctggtcctttctttttttttttatctccattccttgactccaatcccccttctctgattttttttctttgttatttgcgtgtgtgtgcaggacagcgggagcgagaacgtcacaatggtagagagcaccttgcagattggatggatcgatggtaatgcctcgtcaaataattagtacatctttattcacagcaaaatccaaatctatattccggttcctcccctcccaaacgcgaatgcactgaaatccccatctctttataggttacactatcatgagcaggcattttaacgataatgtacattttctaccgttgtgttgaatagtattgccttcagcagttacgatccaatccagatataagttagttttaggtccttcagtatttaagatttgatattggttgtggtctttttattactgtgatatgagtttagataattttatttgtcagagaagaaacttgctgtgaggtggaaactcaaattttacgcatatgttttcttggatcttcttctttaattgtatagcagttggtagagcataagcatgaacagtctgaacatttcaggcctgattgtttagttctattttttttattttttttcattggatcaacgtggcgagcttcatcattagggagcggctccgttctactatgaatcatcctaatattaaattatcaatggctattatgcatctgttcaaagttactgaaatagagataaaatagtgaatacaaatgaatatgtacttgctgtttaattttcctccctcccactatagaatacatcagtgagataattgaaattaaattattatgtgcgtttatgacacaaaaagttattatctgcatgtgtttctcattcgattcctgcctccaaattgactcacactgtcgccgccgctgccacacaaagcgccgactcggccgtagctccgtcgctgattcactgccgctaggttgcgtccatcatctacccgattcaccggcggtctacctgatcagtgtcatcggccctctctgcctggtacatggagatccttttctcttatttcatttgctctttcctcttcttgatttttcctcgattggtccaaaatttaataagcaatggcaattcatttacttgcggattgacagtgccatgtttctgatgtgtgtgcacatatcccactaaattatcaatgatgacgtcatgttttaaacaatttgattagcatctgcaactttttatataatgcaaatgatttaatttctcttatgatcaggatgtttatgtctgtaattcagatgaagcgctttaattagtagcgtgcatatacaaccttcaagtattatatcgttcaactgctgcaacaatggaattaatccaactttcagagtggcttctggtacttttaggttatatccaagttctgctttgtgcagtgataattttttcccttgaaaatgtaacatgacaatgagatggtatgatgtcatgatgatgggattcgttctttccttgagctaattccagccacataaaatttacatgagctaaactatgtactttctgaaaattccataatgcttttgtctatttgtttaaagaaatatccagggtgggtctattatccgtgtggcagtggattcaatgagttacgtcataatattgcttttcaaataatgacacctgaatatgtaaaatgtgctgcattggttatgtgcaagcactgatgtattgcctaaactgattttattgactactatacattgttatgttactctattgagaagatggttctataggtgccatcactctcatccggcctctcagccgctgccgcattccctgattcctgtcgcggtatcgagcaaagcctcatcgccgtccagtcagggacgcagcctcatcgtggccaacctccccttccattggaagcgccgttgccggttcaaactcattcgtcaggttacataggccggctccaatcaggtacaatatacatgctccaaagaaataaatgtctttgatattgtccaattgattgacacatgtatatttacaaataaaatttattgtgtactatatcagtgaaatgtatatttagacccttgtatatttggagtacatgcacccgtgattgatggcgtgcatgtgtgatatgtttccttggattcaaatccaatgtgttctttattatagtcaattatgctaggaggatttgatctgtcagtaagcggattcgtggctatagttccacatgtcaaatactaaaatatatatggcacttaactgcaagagatcaggccaataaactgaaaataatctatgcgtcttatcttatgaaaatagtttatgtccacttccttgtatccgacgttaacagttttgcatgaatcaggaaaaatctgctctgctgttgactacttcactccagttattcaagctatcaaagttactctagagatactccggttactcaattgtatacatctctgtttcacacatgatctatttctgcatgtgtgtcacatttactctaaaaagatgctgtcaaattttaaaagaacactgctttactaaattgtggtgtatgtagcgttagcatgccacccatatggcaaataactgaagagtgatgtatttgagttaacccttttatacgagcctaacctacggtactttcatagccatggatttaaatagattgttcatgtagttcctaatttcatttttgtttcaactaggctggtcctactacatttgcatgtggtagagggcaaggaggaagatattataaagtagaccaatgaatctattgtgatcgggagttttgcaacatttcattgggagtttatttatatattgttttatgctctggatttttggattcaagcccaaccaattccaaggggtataaacagaatgccttgagggaacagaaagaatcaccttgcctgtgcctaattgctccaaagtaaaaggtaagcacatatggaatgattaattcttgttttcaagaaagtttcaccatctaaattaggaatgaatagctctcatagcattaggtatatttctagggacctgaaacaatacactgttgtgtggatgtaatatgcccgcttgtcaatgtttgtagctgtatttgagacgttttactttagaatatcttgataagaagtattgcgtgcataacttatgccatatagcaccctaattttattagtgcaatcagaggataaattattaagaggacatgggtaagtgattccacactaattaacatagtggtattgtataataataaccagtgttgatgcagaactgcttaacagtaccaattgtggtatacatggttttgaaatctgcattaaaatagcagcggaccagcggttacacctattgagttttacaaataaaaatgacagacctagctacagtgtacatctactgtaaactaaaatgcaatcttgaaaataaaatcatgtttactttcaagccagggcagatgtattgaaattcattttttaagcttcataaaagtattgcccctcaaagggtggcaaatacactctgtatacagaactaactaactggagtcattgcctcacatctttttggagacagttgaaccaacttaggagcaatttaagtaaacaatattcattcaaactcattttattttctgaatctatgaccaaaataaacttacacagtccacaataattggattgtcacatgctatagctaacatattcaggggagtgtacatcttattagacaaagggtctatgggaacactattcgttacatggtacagtcgacacgtaatataaaagttgtgatgtaatgaccttatgatactaatgaaaaacagacacatactttaatgaaaaaatcatgggcaagtataataattaatagcaacaaatgcatcagtccataaaattcctcaatttctcatctctcccgcagtgtgtcggaattagttttgcttatagattgtagtgttggttatgggacctggcaataaaatatcgtgtataaagacgttctcgactggtgagcaaaggtaggttctcatgattaaaattaattcgaaaacataatctagaagatagtaaattgatgatccgaatgttactcaccaatgtccacttactttgtacaacacgacatcaccattcagttggaatatcgtgtaattatgttctccataccataccatgatacatgcttcagtttacaccaggctgataacatgactatacgttaacacgtctttctgaacatatacttttgccatcaataaatttcagtacagatatctttttagtattcgggtcatgaaagaagatgttagcgagatgacaaccacttgttatcttgttatacatggtaaaactattaattttatatctacttcttattaaactgttatttgggtttatattcacgccatcatgctatgtgatcaaagggtagcggtcggcgtgtgtcttatgtgacgaatagaaaaatcaagattttaaaagttattaaagagaaatagaattgtaccgtagcgtttagcacgggcatattactagttagatacgattaattaagtttcagttattccaaacttgagaaaaatagttttatctgatattttaaaataatttttatacagaaagttttcgcacaaaatatatcgtttagcattttgaaaactaagctaacgaaaactgaggcaaatctacatcttaatcataaaagaacatgtgtaaggccctgtttagattttctggcaaattttttcatcctatcacatcgaatgtttgaacatatgtatggagtattaaatataaacgaaaaaaataactaataagacatattgcgtgtaaattgcgagacgaatcttttaagtctaattgctccagatctgacaatgtggtgctacagtaaacatttgctaatgacggattaattaggcttataaatttgtcttgcagtttacatgcggattatgtaatttgtttttgttacatgcggtgttacagacatattatgtaatttgttttgttattagtctacgtttaatacttaaaatatgtatccgtatatttgatgtgacacgtcaaaactttacacccatgaatctaaacacagcctaagataacaatttgatcatacgaatagagtaattttgtacgaatttgtactacaaggtgaaaatataaaagacaaaagaaaagcgtggcggcgtgccatccaaaaagcatttggccatttgcaccaccacaccagtcacaccggcacaactcgactggagtccttcaagttacaggtcaacgacccctctggcaagggcagtttggtaactgcaccccaaaacgcacgacatcccggcatcccgccaccgctccaccttcccaaaaataccctcaccgagatgcccctccgtctcccgtctcagctgctgatttctcccacccatccgcgtaattatccgcagcgtcgagggcatatatggaaaccggcacgccatttcgaaatatttcgccaagtggcgcacggctggtagtttcccacataccaccctaccctattccccaaatcccccaaagactccctatacacagagtctctctctccccaacgccccccattatatgtaataataatatcattattatttgaggggttaagtgaaaagcgcactttttcctatatcatccctagctagccctttcgtgggagtaaagaaaggaagagaagaggaaaaaaaaaatctcgctttcgtccgcgtcgcgtcagggggtaggagaggaggaagccgaggctccgcgagctcgcgaaaggtaagggtttccgccttatccgaatcccgaatccgcccccaaattcctccgcttcccgcgcggatttcgccgccgggcggcgagatccgcacgattcgcgccccgatctgctctgacccggcgctcgcctcgccggattcggcccccgttttgcagggtttccgccgccggggtcgcgcgggcgttcgagcggagcggaaggggaggagacaggagagggagagggagagggagagagagcgatggcgggaaaaggaggtaagggcttgctcgccgcgaagacgacggccgccaagtcggcggagaaggacaaggggaagaaggcccccgtctcccgctcgtcccgcgctggtctccaggtgatctctcgtcttcctctgctttcgctttgttcgcttcgtgggggagcgatggataggtcaggtttagacacgtttgtatcgagaggttgcttcttctgccagtatgtgtgtttagtttagttttgatatacatgcattgattagatttgtgtaggtatggcgcgtgttgttagtattttgtagaaggttttgcacgctagcgaggttgggttttagatgtttggaaactcgtcgtgttcggaggaggttttggtagatctatggaagcatttggtctatctggttgtgttatgttgattggtttatacgatttagtttgtttggtcaggcggtgttagcacaatgaagattggctgattttgctgtggagatatgctttagaattcgtgatgctaacatgctaacattacagaagaggatgattgcaggacatcgtttgtttgtattgcctaaacgatctagagtgtactgatactttgtttcaataagaattgaagctgggggattctctttcttttttaataaagaggagagaacaatatacgtttggagattttagttaaatgagagaacaatatacgtttggagattttagtttatgtgatgatacattttatttttttgctattctggtcgtgatggatggttggaaaatggaaactagatgcatgtggccatagtgtggacaatttgaggtggctgttgaggtagcaaacaagattagtgcaatttacacatttactccctctatcccagaaaaaaacaattcctagctttgcatttggataaacaattgttcagatttaaagttaggaattgttttttttctaggacagagggagtagatgtgtaatttgtgcatctaggaaggtggtagtatgccagtggcaccaactgtggtggtttcagctaccatggaagccaaccatgataggactctggtaggcaggggcaaatctatgtcgggctacacaccactggcagaggatactgggtttgattttgctttttagtttttcctctgggtctgccactgcggtatgttgcatgtgtgtgcctttcaaagtagtttttcttgttgattcttttttcctgaggggatggggatacaatgacaatcaagcacctgacttattacctcttgatagataagataaacatgcacctgatttatacacattattttttttcgtgcaaactatttccagcatctagaacgttatgttgctttgttatattgttgtcacttgtcag

SEQ ID NO: 59549 - DNA, 2815 bp, Oryza sativa
ctgagaggctggagtatgatgccgacttctctggtgctaagctggatcggggtagaggccggatcccgcctagatctacggggagaagatgcccttgtggtgaagacagcagccaaatcatcggggagtttcatcaggattggcggataggccccatcgtcttgatcgagtcgtgttggagtagattggatctcgttcgagtggtttgaagccgactcggtggagacgatcttggggtagatcttggccgagtttgggataccgaacggggcggagatctggcttcttcccgactggttcgaatccgagtcgaggagagaaatcttgacgaggtcgttggtgatgaagtcgaggctgccgaaccggaacgcctgcctaggagggaagacgaagtcgtcgatgtcggaaacgaaacccatcgcattagtcggcgaagtacttgacactacccctacttggcgcgccaactgtcaaaacaagatttcgacaatactaaagggggtggctatcaaactggaaaagtggatggtttaagagacaaggaattttatacaggttcaggcctttttaatcaagaagtagtaccctactcatgtccggggattgatctgccgagtatattattgatcgtatgatctgggtgaaaaaacgtgcccctagaggcacctggaccctttcttatataaaagaaggggtccgtattacaaaatacagtccatatccctaacggaataggtagttacaaataaaatacaatcgtaaccgactaggatcttgggtattaccttgacatacaagtttagaatttaacccaagtcattttaaagatattctatctatatatagcactccatacccagtcaaactatacatgccgtgtatgtatggggtatccatgatctccacaattcatttgtcaagtaagtacttcaatagtacaattctgatagtgcgagcatagtcgtgaaatacgacattcacaaaaccgatgataactgctcgaaaaccacaggtatcatcagctttattgctccggctcaagctaaaagttcactaaaatccggtcaagtatataaaaactcaagctaaaacttaaattttgcattaaactgtcatctccgagctgttaacatcaaaaccgacaaatccaaatcctcgaatccttatgggaagcccatttcaactcaccttaaacagtcaatgggcccagccatctatcataaagcccaacaaggcccatgaaagcccatctcaactcagcctagggtttttttccactccgcggcgtctcgctgtctctctctcctctatatataagccttcgccgccgccttctcacctttttcccttcctagcaccggcgacgtcgtcgccgccgccgtcgtccggcgtgccgccttcgtcgccatgggtaagctacaacattccgttcttctctcctcccgctcgcctgcggatctaaccgtgcgtgtgtggtgcaacccggatcaaggtcgacgagctacgggggaagaacaaggcggagctgcaggcccagctcaaggaccttaaggcggatgctctcctcctccgcgtcgccaaggtcaccggcggcgcccccaacaagctctccaagatgtacgcgcttcgcgctcgcgctcgcgctcattctctcctctttctgtgtgcccttgtgattgattgaatctctgtggttttgcagcaaggtggtgcgcacgtcgatcgcgcgggtgctgacggtgatctcgcagaaccagagggcggcgctgcgtgaggcgtacaagaagaagagcctcctccccctcgacctccgccccaagaagacccgcgccatccgccgccgcctcaccaagcaccaggtataagatttcataaaaccgtgcacacctactactgatatctaaaactcatgctgatagagattcacatggtgtcatcttccttcaaacttttagcttaacttgggctgttttgttttttttgcatgaaatgtgtacttactaccattgcagtagataacttagttaatgcagtgaattgttctgtactgctacatctgcatgctacaccattttgttaattctattagcaacgccattttgttaactgcgtggggtttcatcattgttggttgcttttaattgttagattgtacatgtaattgtagatttttattatattacttgctataaaattgcttttcttaacaaaattgtgagaaatacaatcagttttgtcagattgtatgcatccctcatcgtcaatcacttcacagcaactactaggaaacagataaaaaaatggggcatcattttttcccatgtagaatgtggaatacatgagccctgggatgaatacatattgctcacgcaatatcaagatatatgtagttactttttttgtttgttttggcagttggtacttggctgtgcttgtctgcatatgatatataggaagatattaagagagaagggtagataaaggacttgtttgctgcattctttgaaaaatgaaggctcacctttttcaattcttatagaaacatgaagtcatttgtcatcctaaacttatgttcaattttctagtgtcttgtaatgaatctagttatgttatacttgcatccgtcttctgacattttccatggttgccatatcacagctttcgctgaagacggagagggaaaagaagcgcgagaagtatttccccatgaggaagtatgccatcaaggcgtaggtcagggaacatgagagaatgttatgtttagcacatcactcagtcaatttatctgccctcgagttccttgaattttgatgtt

SEQ ID NO: 59550 - DNA, 20502 bp, Oryza sativa
gtgtttgcatttgacatgcaaaaaacaactatcttgtctatcgggagtttaggttttcctaaaggtacatctactctgggtttctcttcttatctgtatcaggcaataatagagccgacaaacataatatgaagattgaaattagatagaagtaaggtagattcaatgctttgtggtacctagcactgattaagacgacgaaaggggaacaaagaagatgttgcccctgtcttgtaagtaggaatccgcaaagaagagttgaagatgagggaacaatcagagaaaaaataggtggagatgaaaaatggactgaagaagatgaaagaagagaaggatggtttctcagaaacgaaagagggggagagctagggagagagaacttgctagagaaatggatagtgatagagcaggattagagtatgggggtctggaaagaataggggaatagcttgccatgctgctacctgtgttgtcttttccaagtcttttcgagggcaggtggcagctgagcataattatgtttattgttttcatactgtgtaggttgggtgatgttggttacggtttggagaacgaatcaattttgtttgccatgtgaattgtgtggtttaagatttgggttgttatgtctatctaaaacgctggagctgataagttttttgcacgcttctatgtgagaaatagcacacatgttacgatagtttaatagcagtcaataccagctatgcgaggcaatgctaacatgcgaggagatataatatttgccaccatctgttagcatccaacatcattacgactgatcatgataatctagccatacagagttatgttgccattgcaaaagctacagtttgttaccatctgacagcattcagcattatcacgatgaatcatgataatgtggaatcccagccacatagataatggatgttcacctaaaagtctgtttgcaaaaggagtaagtctagcttaattggtttgacatgcactcatgcaacacggcaacaacgcagtctctagaattatcataataacattagccatagattccttttgatcggtgtgaagaaaagccttttagtaatgctgggcttctcaggatcaaggctaacagagcaaaaaacaatagccattctgcttgatgtatcaggccttgctgatggcactgcaagtatgtaggaaacatcatgttagagatgcagaagatctttcatataccgtcagagacaaccactatcattatacctgccaccagtggcaccatcagtatcatcagcagcatcatctttgaacagtttcttagcagcaccagttccaggagatggcctaggcctgtttttgtgtgtttcggtttccagttagcttggcagaaaggtttgcacccggtactctgatggataaagaaatgaagtgatgtacctttttttgtacgcctttgaggtgctgttcttagttgcaggggcagaagccacttgtgtaaggctgactgcctcatcatcctatttgacagtagatagagttagcaaatatgatatgcaatatatatatgctacaaagtcaggcataaaacaaactgacctcataacaatcttcattatcaccagcatcctgtgcaggactcttggatgcatattcatttcctgtgttcttatccttttctgtattgattggtgggctactcagagtgcgttgagcatcactgaacccagctgatgggctggctgctatgggctggccaatggaagtatcctgagatgcaaccggcgatagagccatgcaaggcatcagagaagatgtctgggatccagatggagattgcaagagagcaagggaatgactctgagcacccttaacaactctgttcacttgaaaagcaacaatgccgctagagaccgtgttctctgtgaaactcacattccacacaaattctttctcaagcagatcagtgatctctctggatatgcagcccttgccagttggattttccagcatcagtgcctcaactgaacgaccaatcagcctctgcgctaaatgcccaaagataataaatgtagtatctcctgtgtcatctcctgctatcacactgagtttgaacctacagaatgtaatgtagcattagctgtaatgtatcggtgtctgtattgcttcaattgctttatcacgactcacctaggtgaagctgagccagttggggggcatgtgctgtttccacacctatatagatttccatatggctttgctgtcttcttgcatatatcgcatgcagtataccaccaagaatactccatgttaagtttctttatcacgacagtcactgagaattcatgtttctattaacatcagacggaaacagttaacacagttcatggcataatgcagattataagttcatgaagtgactatagcaaggtcacaccttgaacttaaaagggtgcgggtctcttatctcagcgattgtcttctgttcacagttgttctgaagaataggtgcagctgggagatcaatccatttgattgcctcgtaattcccttcaacactgcacaaaaagaatcagtttagctcaaaaaatcaggacaaagtaagctaagagaacattgtctgatagcgaagtgtagagaataaacctagcagcgagggtgttgacctctggcacatcaatatttatgtaccatttgcaagcagagttacccgacaacgaaacattccctataacaacagtgtcccacgctatgagaacaacagctgaaaacataggacaaaatgcaagcaaggaagctaattgacttacatccatgtcccctgacaagtgtgccaacaaagataactatctgtggcttctccttgccagcactgagaatttcatctgcaggaaagcttgtagctctttctccccataacacaatatttgttgtctcatttctatgttgtgtatgtttaaaagaaatcaaagaggaattgtggtatggtaagtagttagtctcaaacccaaaacagtggtgtgttggaataaaagcagttgtcagggcaaggcaatatgcccagtatgaaagaaaaatgttatgacagtgattgtctgatgtagatgacagattatttgagaggggttagaaaacatcagaaaatgcattaataatatggagtagtaaataagggatgagtgctaactcagcattgcgcatgtagacattcctttttaaactgtcactgtctctaacacgtgtccgaacagttgtcacagatgatatgtcagtgatcactccaatcacatctgttattttgagagcaagaacaaaacacatgtgtgagcaaaccagaggtagtaatataatagataaccaattatagaaccatatctgcagtacctgtgaaagagtctttcctgtcgacacgagagcggagctcttggtaaggtgtgagagtataagcatagtgaccaaagccagcttgtacgtcaacatattcttctataccagtccatctggtgaaattgatcatcatcttgttgtcaactggcctgtaatgtttggtgcatggcttgacccgatagtaggtaagcaagtagaccttgccttcgctgatcagtggtttgaatttcttgccccatggaggataaatcatagcagcaatggcatatccctaatgaaacaatactgtcagtaaaacaaatgacatattgctcaggttttacagcagataaagttcgcaaagcaatcaccttctcaccaaccaaaacaagaccaatatggcgtaagtcgccttcatcgtcctggtcatgatattcccataaccttgatacacgtaccaatagagttggattcccatcaccgagctcaaggttaggaatctgtacttcacccatatgtaaacatagcaaaaaaaacatttggtttgagagatcagcgcacattgaaattttgaagaagctaagtgtgcaagttaagaggtcattagatgaatatacggaaaaaaattcacatggacaatgaagagcagaaaaacagaggcgcacaacagcatcaaacatgggtagtgcgagtgatagctaggtacaaacatcctgcaattgtaaagatttaatatattagtgcatggtatggcatcctggtaatttagctagggatcatccaggaaaaccagacatcaaagtataccatagatgtgactgcttgcagtacttcttggtaaacaacatttttggttttcgtacaacatgcctcgtcctcatcctctatgagaatcctaagaccttctcttgatgttgatctagaaacagcaacataaagttgcccatgtgtgaacacaggttttttcaagtacacgctgactcgtgaaagggtttgtccttggctcttgttaatcgtcattgcataacaaacacgaacagggaactgtcttctctaaagcgtaaaaggccacttaggacttgtggtggtaagtgcaattcgtggtatgaatgttgtctcgccaatatttgtcccagttaaaattacacactctaacaacctattaccaagagaagtgaccaataaccttgtcccattgcatagacccatagattgatttaggtttcgtagtagcataatcgtcacaccttttttgagcacaagcttgtgcgatgggaagttgttgacattaattgaattcaaaaattcagggggtaaaggatgtcaaagtcaggtaaatgatctcttgattttgaaattgtatcacatattaaatactcctttgcgtcgctgggtatcatgtcaacaatacaatcatttatttcatcaactgttgagttattcgggcaaacaattgcccgacatgcaaggtaagaatgatctgtatagcaatttgcaaagtgtggaaagatctcatctactatagcccttattttgtcaccgcatgtcttgatcaaaaggtcatcagggatatcaatccatgttggctcaaattcgtcaagcttttttgttgcaggcaacctaccgtcaccaagtgctaggacccaatcgccaaagttgctaagatcgacacggttttggtcagtaacgttaccatgaagaagtctcatgtttattgtcagtctaagaagaacaacatgccgccaaagaggagagttcgtgatggatgcatcgactatagaagcacgtgaaccttttcttatgaccggcaatatttgacggaaatcacctccaagaacaacaactttaccaccgaacggaacaatgctgttagaaggcgtgtgctcagaaagcaaatcacgtaacgttcgatctaaggcctcaaagcatcgtctatgagtcatgggagcctcatcccagattataagagacgttttctgaatcaaatctgcaagcatagttcctcttttaatggtgcaaatgttgttttcatctatgtcgatcgggattttaaatctagaatgagcagtgcgccctctaggtaggagtagagaggcaacccctgaggaggcaaccgctagaacaatttttttctcggatcttattttagaaatcagtgtattccacaaaaatgttttgcctgtcccaccatggccatagacaaagaataacccaggcctgttttcgttcacccgttgcatgattgtgttgaaaacatttctttgatcagtatttagcctaggtatattcaaattagcttctgcagttagggccgcaacatcaagagcaagttcttcgtcaaccatcctatttcctgtaatgtcatctgaataaattgccggctgcggtaagtcgtaatcatcaatgctaccaccactgtttgaaaacacaatgtgaagttctttcattaatagagacaggagcctatcaggaggtattacgtacgaaggattcgataaagcagttctgacacgtcgctgaatgtcatcggtaaaatatgtccaatatttttcaaagagcgagcgcacatatccaacagaacaaaacattacaacgggagcaaacaactgtctcaattggcccgaagacgcagatactatagcctcatcaaatagcaagtgccattcgttatcgctttcaagtaggcctcttgcctcgcatgcttgcctaaaggtcggataaacgataccatcataggtcctaacatcagcatagcacgttgcacctttcactatcattaatagcattcgtaggtagtagagctcaccgctaactgggctgacatagtatatcctgcctattttttcacatggtgttctaggacgccaactacgtgagatgctgtcccatgtccactctctcggaaaatcacagtaagtaagcgttcgtgcactgttatgttttctgttagcctcgaaccactcggttagcatcgtttttttggctacagggctggatagcaaggactttaggtcagaaccttttttgtatcggacaaagttcatgtttggaaggtgcacagctaggcgttctacagaaggcactctgtagtgaatgtcaaattcaaatgcatgccaaagggactcacaggtggacagaaatcttgcatcgatatattcttgtatttcatttcgtggagcagtacagttttcagctggtttgttcggtgcatttccagaaatctcaaagaatgcttttgttctatccgcccctttagtgacatatttgaagagatatttaatcatattagatttattgcaccattctacattaatctgagcctggtattttttcagaagttccatgttgtagggaacaacccatctgttgtcaagtttaataccatttttgagaacataccgaccatcattgctacgtttgtaaacagtgaatacaaattcatccatgatggtctcttcttgaaaagatttagggaaatgcttagagcactctcccttcttcatacaggagcatgttttgttcacatcgccacaagggccatggatcataaattcatcaaccaaggcatagcctaaagggtcggttagcacatcaggtatttcagcggaaataaaaccatcgacaataggagcactaaactcaatatttcctgcagcaagccaaaccaggcaatggatatgaggaaggccacgcttttggaactcaactgtatataacactacatatagggatagccaatgttaggacctatacagaacataaaaatggaacttagaaactaggtaaacatcctactagcaaggactggaccaaatgtctttccttctctaatatctgaaatgaattcattcactttcatgttaaacaccctcacaatcatatcggaacgatcgcttggcacctggcctggctcaaacagcaaagcatcatatatttcttgccactttgagttgcatgtaaaggtcacaaaaagatcaggtgaaccaaaaacccgacaaatagccatcgcatcttggtaattttgaaccatgtaacgacgccctccagtaaaactggagggcagcacatatcattggccgacagaatccccggaatcaagaccatgatcaatcgcatcagctattccctggacagattcagaacgcaggtcgggctggttgtcgaaaatgtacttaagcctagattactcaacagttgagtatgagtcaacacataaggaatcgctaagacgaccacagcaagtatatggatttggtttgttcaatcggtaatgtaaacgatagtggtagtactcaagcatggtaacatagcgtctggaggcaccagtgatgctaggaaagtcagtgtactttatacctagatggaatcctcgttcaccataaggaaagagcaaagggtactgaagagccatataggatgggtgcaaagctgagacacgtcgcaatctagcatcgcaagactaaaccatcacatcatacatgtattcgccagctgagtaatctccagctactataccagcaatatcaccactcgttggcaaattgtactggatttcatctcttgaatcacaaccaagcaatctaagtgcaatcttttgatcaccattatcttttagccgatctctagcaaagcggaatgccttaaccaaatcattatgctcatcaagcatagaactaagcccattaacaatgtctgggtctggttcatcagaaggattgtctttttcgtaaatattcattctgtttgcagtttcattttcagtgtcatatatgtaaagttgtgcaaatttaggtcgtgagccttgctgtggcagcaggctgccaataccttggtggacaaccccattaattttgaacacacaaggtgcggtcccattgtttatcgtcttatcaatgttggctcctgaggaagtaaacgcaaaaagagagttatatgatcggatctggcgtaagaatctttttgatcgcacactaccatcaaattttaacagttctgctagcaaagaaggtggttttttcaattcaggcagactaatcttaccacctctacagcataggttgtacagaatcttgcgctgcgagactacagatcctttctttaccctctcctggtaccagaaaacggcaccgcagtgtggacattcatgagatggaccaccatagtaggactgatgagggtacaaagctgcacagcattgatatgagagtacgacagacagtaaagctgaagaaattggtgtagtatgcaacacaacaaacctttcaaggacgcaatatagtcttttggcaaaggcaagatgtcatcagcactgggcgtgggacctatgcgaaccaaaattgtgtgcaaaataagcagtatgcggtgagtcaacccttttttaccccgcagggacacatggaaggcataaccaaggtaagggacaccgaaaaatcgtaccgttaagaataccatcgagagaatggtttgtctgaccaccagatattttcatacgccgcctttccctattaacggcagcagcacttcgtggtatatctagcaatgaacttttccctatgtgttcaaaaatacttagagcactatccgagcctcgcttcgtttgtttggtcaaaatagtttttcggtttattttatcaaaatctggcttacttttggcatttcctaccaaaggctcactgtcaatgggctgttccatggatggtcctgcaccagcactggtaccctgctgcccaacatgtacagattgaaccaggacagaacacatggaatggttgactgactgtgaggagctagaacctacggcagcaaaaatgggagcctgcaagtagcctattggaccaaaccaatatgtttacttacctgtcccagaaaccaaaagcaaacatatatcagaaacgcatggacaacagaccctggcctatggaagcatgccgccttagccggctttcacgtgcgcgctgaacacgcaatgctgcacgacctgacatctgccacaaatcctaaatcacaaaacactgttccctgcaacgtttcttgaaagacaaatgcatcaaacaatccagctcagaacacaatctcaacgcaagcatgtatacacaaaagaatgaatgcacggaacagaaatagctaaattaactgcaaggatcctggcaatacaaaccaactcagcattacaaagtaaacccaaactctgctctaaggttgttgtgtgctatagaagaagtgttcttccctaagaaaactaaaccaaagtgatttgcactggcccagcacaccctcacacggcagatctagcgccccatagcgtgactggagcctagcaagacatgaagccgctgtgagagcagcatccactgcagaggatgcaatctttctataggaaagcagcatgtgaaaattgtagtcatgaacagcgaaccggtactttgcttgcatgaacctaacaacctgctgagcaaccatctcgtgtgaaacaattagcggatctgttgcagcaacccaaaagaacttcctagccagattgttggatgggtgagcctgaccactggcagggtcttcaggcggaaggataagctctacaccagctaacagcgtaccatgcccatcaagctcccaaaggtatgacaccaagggcaaccggcaatgagaagctgcagcattcaacaacgaaacgaacgaaaccccaacaacggccatcccaccaacagcactgcgaattgcagagagagttttcaaacaggagataaaccacccttaaacagtactttaaaggatgaaggtgaggaaggaggcagtgtgcaagaagaaatcgtcaagaagcaacatatagggcaagtatacagggccaagaccaggagacactatatctgtccctttcgtcaagcgtgggaaaaaaagcgctgacgatgcgtcagccccaccaacggttagcgccccccccactccccggcccctctcacccaccaaacatataatgcaatagagcaaggaataaaggtgcgcaaaaaaaaatgcaagcacccaaaaattttaaataacagccagagcaagaaagcaccttcgccgccacgcaccggaactgtcacagcacccgccacaaggaggaagaaaaccagaggaaagaaaggacctcagccggttcggacggaaagaagccctccctgcacagcacacaaacaaaagatgaagcaagcataagatggatcaagaaaaagaagaaacaaaggtgtcgctgacctggccaaaacgcgaaatcacacaagaaggtgtcctcctatcaatcggcagtgaggtcgctgcaagaagcacacacgaagtaagcacaaggaactccgccaccaagcacagtcgatgcgaggatagcacatacctcgccatagccacgaacagcaacagagaggccggagaagaagcggaacaaaagggacagcaagacggaagagcagtacagtcgaagcaaagaggattaggctggagaagaagcggaagaaaagaagaggagaaaaatatggcgcctttcttgcgtgggacgccgtctcgggcagatctgtaccacgttgtctaacaccgattggccaagcagtacatttgtggggcccacccctctgtccacaaccaccctcgccataaaaaatgggacccacacgtctgcccaccaccacacgcgcgatcaaaaaacgcacacctgggcaattttcacagggcaacatctacccaccccaactatagcagcagggccacccaccgtacacagcggcagggccacccatcagcgaccgagctgcccgttcccgtcgaatgcgcgcataaggaagagggaaaaaagggggcgaggagggggcgaacatgggggcagcagaaagagcagcatgcagcaagaatggtgggagcccacaggacagaggcacatagaaaaaacggtgcagccccacaggacagagacacaaaaaatttaccgaacgacgtggatgcaagtgcaaacgaacacgctagtgcaaataccgcgcaaatcgctccgggaggtgcagatcgcccttacctttaattactctgattatttaaaaggaagagaagggatctttacaaaaatgcaaacacccaacaacatgcattgaggtattttatatctcactgacaaatggcccaaactaaaaaccaactgaattttgctttgcacataacagcttgcctcttgtatcactgatgattggtccaacctatggtggaccccttgtacagtctatggagccatgcaacaaccaaagagtttgcatctatggagagggtaaagcgaacggtaaagtaaagcatgtactactactactactaaccatgaacagtgcaacagtagaagtagctacgtggatggctgtggcagctcaggctgtacctctctaggaatatagatataggtagatgagcccctagtaaaataaggcctatttaatttgaaatacgcgtgcaacaaataacacaacattctctaagtcattctttaaaatacacgtcaacaaataacaaaatattcaatttaaaacacatttccaagaaacaacacaactttgttcatgtggaggaggaggtcgatagggtacacacaatacataaattgatgacattgcacaacttcattccacaaacaaacataaccctaatagtagacacatgaatgagagcacacacttgtctaaaagaaaacacgctctaagaagaaacaacatgtgattcttcttctcttccatgtcaggacaggaactgcatgcattggaactaactgaggaatggaagaatgatgatgggaaacatagcgtgacaaacaatatatgagcatacataaacatgctcttacgccaagacatgtggttggacggccggttgttgctgtatcagagagggcaactcaagccaaggtcctccttatcagctgcatattgtcccctgcttgccgcaacgatgccaggtgcacctagctgccatatggcctacatgaccacaaatccaacaatggcgagggcattccttgtagttatgcatcccttacagaaagagcacttctcccagcttgcgcttgatgacattgttttgtattgttcgagtttcttctttgactgtatgattatgagtttggcaatagactttgtgattatggatttgagactttatatacgagccacaccagatcaccacgggcatatttagtatatgacaagcgggggccttggccccttgtcaaatttaactttatattgtatcccacatgtgtctgttatatgggccccaaatcacatgaggtatattcaatttaaaatacatgtgcaccaaacaagccattgatattcaatttaaaacacatgtccaacaaataacacaatatttattcatcgaggagtaggtcaatagggtatacacattacagaaattggtgacacgacacaacttttttgcataaacaaacataacccaaaaaatacacacttgaagcatagcatagcacaaacttaattaaaatgaaacacactctaaaaagaaactaacacatgatcttgtccttctcacatgtcagggtcgacatctcgcttgtgcatgagaattaattgaggaatgaaagaatgatgatgagaaacattatacatgcatacacaaacaggctcttaccaccaagacatgttatagagagggaacctcaggcctcgtcccctacttgccacaacgagaaaaatgtcaagtgcacctagctgccttgtggcctacatggctgcaaatccaacaatgacaggggcactccttgtagctatgcatcccgcacaaaaggagcacttctctctcttgcgcttcatgaaatttttgtgttttttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaagctctaaaaagtcttttttcccccccccccttccccctcttgggccggctcggcccatctccctccctctctctcctcctccccgcggcccactcggcctctccccgcgcgcgcgccgctgacgggcgggcccgcccgccaccctcgctgacgggtggggcccacctgtcatccctatcctcccgccgctcccgccgcctcgcccgtgccctagcgccgccgccgccgcgaatcccgccgcctcccgccgtccccgcgcgcaataaagagggggaaatcactccccgtgattccctctctctttccccccatttttctctccctctctccctcggattcggttggaaaccgctcccgcaaacctcgctggcgccattgatggagcccgagatcgccgcgccggttttcttcccctccggccgttctctccccctcccaacactatataaacgctccccgtgcctcttccgtccggttccgcctctcgccacccttcctcttcgccggatttgagctcgcgacgtcgctctctctctccgccgtcgccgccgagctccggtccaccgccgtcgtcgccccggacctcctcccgtttcggcgtcgccttcttcgggttcgccgcaacctcgccgacctcgtccacccctccgtttcgcccgccgaccgccggaacgccgccgtcctcgtcgacccgagccgcgccgccgccttcctccgctccggtcgtcgttcccgtcgccaccgtcgacccggggtgagccgtggaccgccgtttcgcttcccccttccctcccctctctcgggcgccgctccgccgcgccggtggtcaccggcggcgaccatcggggcgcgggtgcgccgcctcccgtcggctatgccggcgtggccgccttcgggtgcgccccgcggctgccatgtggggcccggccgtcagccgcccgcgccctcgggtgcggctgacgcgtgggacccacggcgccggccggtgtgagccgggtgcacccggtccaccgtggaccgagaggctgccgcgtgggccccactcccgtggacccggtccgcgcgctcctctctcccggctgacgcaataaatctattttaaattaaattttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttagtagagtaaaagccgtttcttttccgttggtcgtgtagacgctgcagcttcggaagatccgctcttcgtggaagttgaagctgacgtttgggaaagcgagcaaggcaagtcacatcatccttgagcatattgaatcccagtttataaaattattttgatttaaattaatgcattatcgctttatttaaattcccgcgttatcactgttttatttagccttgcctatttacctttgttatggccttattattattgctattgttattattaccttgttcactctagaataaacaaaaccccaactagtgggtactctattcatggttccactagtataaatttaggtagatgcttcgctgattaattaggcaacattaggtgattttataactttagactttgggaattctcatatcatttggacactatggaatggttggcttatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaataaaggctacacgagctgcggcccggtagtcgagatgtcatggcacagggctggtgtcctgctgctagggggctcaatcctgcctgcctgtcccgggggttccggccgtaggtggggttgggtcggtactcttatttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttctacccccttacattaattatgcatctccggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctatttatttttgattgccaggcctgaagtgcctttgtaataatgtaaatattatcgatataataaagatgtgtcttttatatcatgtttgtgtggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttcctctttttcttcttcccctaatgctatttgcaaaaggtttacccttttcttccttcttcaaatttcaactagtactagatggtcaggtcagtgaagaagaagacatcgtcagttgttcgccgaagctccggaagactgcaggatccgctagcgaagtggaggaagcagtgaagccagctgtgaaggagtgaagatcttggagaacccgtcgcagaacctaagccaccctatagggtagtgttgttagtcgtgtgttccttgcttgtgtgtgtagcgcgtgctttgcatcggtgggtggtgatgtaaccatgctaggttgtttgcttaatcaacttgcagaataagtgaaacaaacaacacatcaacaagaagagttagttcctttaaggtcttatctctagttctggtctattctttcctagcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccgagcatgctgcttggttcacagctaccattggttggaagtcaagaccaaaatcagtatgtgtttgatcgagcatttgccacccaggtcgatgagcttccaatgccagaagaggatgtccccttttgtcacgattgtagagagcaaggacactatgccctgaattgtccatgggtatatgccaaagaagctccttcctttggtttagcagggcaggcatcgctaaaccagcctcctcgcaccaagtcaagcttgcagcctagtgtgccaagtagagagcccaatggagagaatccattgaatcccgagaattgctttcctcctagcctttcgtaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacatcaaagaggaaataccttccgaggtgcacgacagttgacccagcacctcctaagccatggtggcagagtatctgatagtgaagggtcagatcaagtctcctcggatgatgaagatgagtctccccgacatctcggcgaggaagaaatggaatcaaaggcatgcacccgttgtggagaaattggacacgttgctagcatgtgtcttacactctgccctcattgtgaggaagaccatccaccaggtgaatgtcccacccgcaaggtgacatgttttctgtgcgaaggtacaaaccatgtgcccaaggattgccaactcagtgtgttgttgaccaagaccgcagaaatccaacgaacaaccctacggttgtctcatcagctagtcagctccaatagcaacatcgacaatatcatccacaacaccaatgctcctcctgctccacctgactctgcaataaatcatagcaataataccttcagcaccaaccattctctgcaccgacagcctcagcaaagaattgttgtcgatggaagaagttgtgtctctccccgacctactccaggccgagcaaagggcaatcaatctcaggagggcgataccaagcagaagaccgttctctgcttcaaatagcaatcagaaggaagcttctcctgtgaatgatagcaatatgcagtcctaacacatcatcacagaaccaatcaaggatgcagtcactagaacaatgccagctatatctctccagaatcaaaatgagcagccacgtttgtggttttcagttcgctacttatcattgtgtaatcgggagtttgcagcaatcatgtaataaataaatacattcatgattataaacaatgagtttgttatgtttatggatgattcatgttgaggatacaatgtaccgatgataagcaccttccctttttgtttaaggcagtgccttgtattcgtgtaataagggagaaatgtgtaatacagacaagttttaagaggattctattggaagatgcggatatgtgatcatgtgtataattgtttactgataaaggagacctagggtctcatttcagaggaatcatattctaacctcgagttaataaccaacctgttgatggaaaagaaaaccaattaaactgtgttgggttaaaaagccaatgagacagtagttggggataggagtttggatacgccttttacagatcaagataaggattgttggatgaaacccataagggtacccgccatgcctctacattgataagttcgggtatacctacaaacagttaagaagatccaggggacatcaatatttgagaacatagtagtcgatggttggtaattagtctatcaggtatcagaaaagggtcaaaggtgatatggcagaagaacaatttggatgctccccatctcgaggaagcactaaagaggatcatcggcaattaaaccctagtggcatagatacagatagcaagcaatgtatttccctgaaggtagtcagtgcagctttttgacgaaccacatcaaggtttcactgaaaggcagcaagccaaaggacttcatcgtcaccagaagcgtccgcaatccacattaaagagtaccacctgttagagataagccgaaagaagattgataaaagagattggcaaagatgttctctagcaggaaagaagtaggccgaaaggtgattgataaaggataaacagaaacatgctctgcatcgctcaaggaagacccctgatagtaattgccccgcaacagtcacctggtcattgaggcatcatgaagtaagcaagacgacctaggtaaaagtatttctttgaaggcaaggaatgaaatctttaactcggtatcagatgctacacggagtgaaaagtgcaagcaccggttaccaggcaatgccatgtcttgggagatgatccaatgggaaagagcacatcaaggttaaaggtgtaaaggaatacgttgaatgctaactaaggacaacctgaagataatagtgggaaataaactgaatgtaaagaaagtgaatccgagttgtctgttcatgggaactattcccagttatgaaccaagtgatatgttcgaagatagtctacagaggtcagacaacgaagcttcagatttggcaggataacgatcaaacaataagaaatccagcaataaagccatttgggaagacgtcaaagtatgtcaagtgggataagttggttctcttgggaagcataattcaaaggcaacgttatcgacccttgcatcaaatagcagaagtagctattacccggagaccgggaaagctaatatgaggcagctggtggcaagttagaagtgaatgacaagcatgatattcttatgatgacaaacatggtatcctagtaatgacaagctagtgttgacgcatgacatgaagtggtaacttccatgaggttgacgccaaaaatatggactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatacgtacaagaaaaattcaaatgcggcccggagaatttttgttaaattctccttggtctaaaaggagccctcaaattttacttgaattttcagagcacaaataataattattaagaaataaacaaagttaaaaaggttttataaaaagaaaagctctaaaaagtctttttcc

SEQ ID NO: 59551 - DNA, 5098 bp, Oryza sativa
caatagcagcatgactgactccatggtgttatgtcattacaggttgatggtggtgtcactcattgcaatgacactcttcttccgtacgaaaatgaaacgtgattctgtgaccagcgggggcatctacatgggcgcactcttctttggtgtgcttatgatcatgttcaatggtttctcagagcttgcgctcactgtctttaagttgcctgttttcttcaagcagagggatctccttttttatcctgcatggtcgtacactataccctcatggattctcaagatcccaatcacgtttattgaggttggtgggtatgtgttcttaacatactacgtcattgggtttgactcaaacgtgggcaggtgagatttattgagattatatatttcacaggtgtataatcagctatatcttactatagtgctgctctgcattgttctgagagtatttgtcttttttttgtttaccccagcttcttcaagcagtatttgctcatgttagcaatcaatcagatggcgggatcacttttccgattcattggtggggcagcgaggaacatgattgttgcaaatgtctttgcatcattcatgctgctaatttttatggtattgggtggattcattctagcaagaggtaaatgctcaccattatctgtctgagaagtgcttggtttgcactttttatcaaaagctaagtgttccattctgttcgacttgcagagcaagtgaagaaatggtggatttggggctactggatatccccgatgatgtacgcccagaatgccatctcagttaatgaactcatggggcacagctggaacaaaattgtgaatagctctgcctccaatgagacccttggtgtgcaagtcctcaagtcccgtggagtattccctgaagccaggtggtattggattgggtttggtgcaatgatcggcttcaccatccttttcaatgctctcttcacccttgcccttacatacctcaggcgtgagtataccttgagaactgatttgctctttttcctagagttggctatatccaaacatgagaatgatttcatcttgtgatttacagcatatggaaattcccgtcagtcagtatcagaagaggaactgaaagagaagcgtgccaatctgaatggtgagattgtgggtgacgttcacttgtcatctggaagtacgcgtaggccaatgggaaacggcactgaaaatgattcaacaattgttgatgatgatactgaggttactcaaagggggatggttctcccatttactccgctttcactcagctttgacaatgtcagatattctgttgacatgccacaggtaaaatatggaagaactcctaccaaatcaggaattgatcattagtttgcatttttctaactttcagcgtgaaattaatttcaggaaatgaaagcacaaggtgtagctgatgaccggttggagctcctcaaaggtgttagtggttcattcaggccaggggtgttgactgcactaatgggtgtcagtggtgctggcaagacaacactgatggatgtattggctgggagaaagacaggtgggtacattgaaggaagcatcaacatttcaggatatccaaagaaacaagagacttttgcacgtgtgtctggatactgtgagcagaacgatatccactcaccgcaggtcacagtctatgagtcgctacttttctcagcatggctccgtcttcctgaggatgtagattccaacactagaaaggtccgtcaaacatttttttttgctattcctacctatacttgatatagatagatagtagcttacctttgtgtatgcagatgttcattgaggaggtgatggagcttgtggagctcaagtcactgagagatgctttggttgggcttcctggagtgaatggtctgtccactgaacaaagaaagaggctaacaatcgcagtggagcttgtgcaaacccttcgattatattcatggacgagccaacctcagggcttgatgcacgagcagctgcaattgtgatgaggacagtgaggaacactgttaatactggcagaactgtggtgtgcacaattcatcagcctagcattgacatatttgaagcatttgatgaggtgagtgtgattctactttggagattcgtaccattttctcctcagatattaggatacattgcggaaagcccaaaaatcaattgattatggctgtgtttctaaactacctggatgatttgactaatatattttttgcttgcagcttttcctgatgaagcgaggtggtgaagagatctatgctggtccactaggccatcattcttcggagctgatcaagtattttgaggtaagtgatattacactaattctaatatacctcaatgacatttcttcaaaattactgattcaatcgcatctttgtgtatcatccagagtatcccaggggtcagcaaaatcaaagatggctataacccagcaacatggatgttggaggtgacaacaattggtcaagagcaggcacttggtgttgattttagtgatatatacaagaagtctgaactttaccagtgagtaacttgcttttaatcctaattgttgtttcatctttctgcaaagcaatttttttttgcaatatgccatgtaacactgattgctaccttattcaggaggaacaaggccttgataaaggacctgagccaaccagcccccgattcaagtgacctgtatttccctacccaatattctcagtcttctttaacacaatgcatggcttgcctgtggaagcaaaacctgtcatactggaggaaccctccttacaatgccgttaggttctttttcactactgtcattgctcttctctttggtaccatcttctgggaccttggcggcaaagtgtaagtaaaatgccactttctatatgcaaagagggtgtaccttagaaatcttattcatttcgtgcttcttaatccaggacgaagtcacaagacttgttcaatgccatggggtcaatgtatgcagcagtgctgttcatcggtgtcatgaactgtacatctgttcagccagtggtggccgtggagcggacagtcttttaccgtgaaagggctgccggcatgtactcggcgtttccatatgcatttggccaggtgaatggtcctcctgcaactgacattgagtcctggttgttgcatccttgagatccagatactgattaattcctctttcaggttgtcattgagatcccatacacactggttcaggctactgtatacgggatcatagtgtatgcgatgattgggttcgagtggacggctgccaagttcttctggtacctcttcttcatggtcttcacgctcctctacttcacattctacggcatgatggcggtcggcctgacaccgaactaccacattgcctcgatcgtctcatcggcgttctacgccatctggaatctcttctccggcttcgtcatcccccgacctgtaagtttcgcattcccaattgcccctcattcttccatacacttccaactccattgggtgctcatctctgtttgtgcctgatgatgtttcagagagtcccaatctggtggagatggtattgctgggcgtgccccgtcgcgtggacgctgtacggcctcgtcgtctcccagttcggtgacatcgagacgccgatggaagacggcacccctgtgaaggtgtttgtggagaactacttcggcttcaagcacagctggttgggctgggtggccaccgtggtcgctgccttcgctttcctcttcgcttccttgtttggcttcgctatcatgaagttcaacttccagaagagatgatgatgacaagggatattacattcattgagttgcaaacgctacctgaaatttgtgcatatcattggatctaaagaatttttttttgttgccattagaatattgtaaatcataccagcctttcccccttatttttatagaaagattgtactactgttacacctagtaattttgttattagtacccttctttttatagaaagatggtactacttttatttttaatttttatatggggttgtctagtgttcagttgactgaactcacattttgctcgatgtaaatgaagaacagttctgctgttcgtcactactatttttgttaattgtattgcccagttttcctcaacaactctgccctacaaaattgtgaaatagtgatacatagcctgtatatatacatccgtaagcatttaagctcacagagctcacacgtaaccggagaaattcggccgccgattagatgatcctaaaatcgttttttcttttgcggcacctaaaatcgtatttaacgtcgtgggttttggaccctgtttagaagattagcctcatgaaaacaaacagtgcccaaatataatgatttaatgatcctagagtgatatgtttggatttatgggctaattgagggctaaaagatagagagagagtagagagagaggggctaatgtttttgaggggggctaattcacttaagtcccaaattagcttacttgtttggattcttaaggactaatttatggctaaaaggttagggctaataattatcccacaaaaacaaacaggcccaaatataatgatttaatatgctgggctaatctgccttttaactttgtaggctattttcaaatctcatcaaacctacctccaggctccagccgcagtagtcattcatatacgatctggatcccataaattcgaggagcagacttgatttctgattttgctcggcaccgtgaattacttgctgaggttttgcttttgcctattggatggtttggtatactgtagtgcgaaccagcgtgtgattcaatatgaatactccctccgaaaatttgaccctaaaaatgaattaaattttcgaagcaggtcaacacattccacacgtgtcaaggaatgtaacagcaaccctggtacacgaccaaataaattaacatgagaaaaacagtgcatcaaacacccagagaccttctagaatcggcactgtacatgaaagccattagttctaaaaaataaatacatgaactgatgaaagctcattcagaccccacctgtcagtctcaccccagccc

SEQ ID NO: 59552 - DNA, 50171 bp, Oryza sativa
  unsure (1)..(50171): unsure at all n locations
tcgatcgacggcgacggctcgtcgacctcgaactgcagcgtgacgcacggctgctgctcgtcgtggcccatgatctgggccttcagctcctcgttcctcctctgcagctggtccctcgcgaccttcagctcgtggatgtagatcgccgccgactgcacgatcgagttcttgtccccctgcagtgacacgaacggttttttgtcagcccgattttggtaaacactccatttaagaggtattaaagggggatttcgaacattctgaagctgaacagaattggtttgagctgaagatgctctgaatttcagattaacattggggaaatcaagaagaggcaaattgaagccaatgaaatgggacaatgcgatggtaaacgaaaatctgagcttaaagaaggccaaattagcagtctacattaggcatttctcgatggaatctaggtgaaagatgaaatggagcttgaaatgaagtgagcggcgaagtgaagtagagtactaagtgagagtgataagcttaggctgtgagcagaggaggccgacgaaccttggagcgagaggagaccatggcgtagaggtcggcgtagctctggctgagcttctcgcggcgctggcgctcgcgcatcatgtggcggaaaccgcggctgctctccacgtcggcgccctgcccgcgccgccgccgctgcggcacctcctcctcctcctccatctcctcaccctcccccttctcccccccgccgccgccgccgcccatcctgcccagcacgtccatcaccctccggtggatgttcgtcccaccggtggtgacagcccccgccgccgccggcgctccggcgtgcaccgcgccgccgtactcctggaacgcgctctgcctcgcctccgccgccgcctgctccggctccggctccggctccggcgacgcaatgaggccgaacggcagctccggcgacgccggcacgtggtgggggaagaagaacgcggcctcgtcggcgtggaacgcgccgtagtacgactccatttgcatctcttcctcttgctgttcttgcttcttcttcttcttcttcttgttctcgatcagatgtgatggttggcgatggtttcccgggaaatattcgaacgcgggatataaataggcgggggcggaaaatggaagaacaagttcacgtgtggtttttttgggtcacgtggtcaaaatagccgtgtgcgcaaatgtgaggcgagtgggattggctactaaaaccgggcggtcaaatgatgaaaaaatgattaataaataaataagttattattcggaggaggaggggttgggatgcaaaagagcacgtgggattagaaacggaggggggtacggctacgcggtttgaagggggtgtgacgtcagcttgcggctgtacacgtcggcaggcagagaaggttccacgtaggaggccgattgattgggaagttttgcgttgattgctttttcgcggattagacccttacagattcggtatttacatgatggatttacagtatgtatatagagtaacacacattttctctatgctaattctgaaacttaattttaaacttgattttaagatatttttaacatagtttctttttcattgccttttaagtcgctaagtacatatgtattagagatttaaaaaatatttttttaatcgctaataagttcataataagctcttgggcaatcaatgaggcctctgctttgcaaccacacgaataccgtggatgacagctaaaattatggtagcaaaatgccatgcatttaaatgtataaatacagtaaattgacaaaccattatctttttcttaagaaaaaaaagaaaatttggcaggctagtgctctaatcctggttttgcaatgaaataggataacaaagtacttttttctcggaaaaaaaatcaaaaagtaaacagaaggaagaaattgtttttttttcttttgcggggacataaggaaaaataattgttggtatatactttcaacagaaggaagaaagttaaggtataccaccaaacttttagctaagcaaacacttattgagatctaattgaaccttattgttgattttatacattttcaaatttactttaaagttcaagggacttgttcggcactgtacttcaagtttagagggattcctgcaattttcctcaacaacaattaacaattctctgatgaaagggatcccaaattttcaaggcatcattgcaactaatcaacatgattatcttattagcatgttggcgtatttttctcccttcaatacacttaaaatagtatttctccgactgtcgaacaaaagggggaaaaattcaagcaacgagtagattgaacaggagacgctcacacaaatgtgaacttgaatcagcatcccaactattaatcaacacgtcaaatgattttaccacacgctgtcgctagtgcgatgtttgaagagctaatgacgagtaaagacttctcctggaccagctgaatcttctccttccggcacaccattttttttggcggcacagaaacctatggaaacttctaaattgttcatagagtggttactgtgctgttttttttttgggggttctattggaagtggttagtttactgttgacaaggtgtacctttcaatttactaattaattaggacctttataaaataccttgaggatgtttttagcatgtgcatggatgcatgcatggaggagttatggactgatactctgataatgctgtttatataaatcaaggcttaattaaatggtcaaggcaaagtcatgagtgatgagtgattccaattattcagttattacaatgtgttccccgtgatagcctcctcgtgtgttaacttgtcgtagtctctcagttgtttatcatgtgctcaaaaaaattgtataacaatttcctccttctgtgctgtaatttctatcgcaatttgtctatcaggcaaatgaaattcctctatactaccggaccggagactaaaaaactcacaggcacatgtttaataatgatatagaaaattagagattgaaaacagcatatagtaaagccacgtgaattgagaatcgtcataagaagaggttatgaacttaaaataacacgacaacttggcaaaccccccaaagaagtcgtaagacacaaacaggataaattatgagatcgtatatatttccaatggaattaatataattgttgaaaatgactttatatatagaagattttcatgtagcattcaaattttcaaaactcctttcaactacgaatttcccggtttatttctaaaaagactatattccaaaaaaaagggagagaagaattccaagccccttttgaacttagcaatttcccgatttattactagaaattaatttattccccctccccacaccccaccaaaaaaaaatcgtacagaatacttttctgttccaaacagggctaataaaaagctatccactatccctctgttgatcaaatgagtaaacgacggttgagccagtaagcagcttcgctagagaaaccggtgctcacctgcaactaataccagccgcatgataaaaaagcagagaaggtgctcttgcaaattccaggggacagagcaaacgtgccaacaatgcagcgtcgaccggtggtcgcggggaggaaaaatagcttctgctatttcatgtagtagcttctacaagaccacatgtgccaagacgacgacccaagaccagcaggcgacgcgattaattaaggattaatcaattaacccgtgcgaaagctactatatgcgcgtgcatacgtgttggtgttgctagctatagtgagctcatcaagcagtcgtacatgtaggttagtcgacacgagcggtacacaggcgtacagtactagaatggagtgcagtacgtagccaggtacgaacgactggtcgcggtcagagctagcggagtgtgccgtccaagcgactcggtcgttcgatggttgggtggaggagaggtgagctgaaaagctaagcgtcgccgcgcggtacgccgaggaagctaggtaggccgcggccctccttccttctcgtgcaaaaaacgaaaggatatgatgggtttttcacgtacgcgatccgcgctgcgtttcaccgtgacgcgcgtgtgccgaccggggggatacccacccggcaaacggccaccgcgcggccggagctacgcggtcacgaggcctgcgacccctgcaaggcggggatccggccgtcttgtgcgcggtgcatgctgcgccgcctcagctggtgagagatctaaggttcatgtcagctgaatttttctttaaggtcttcaccgtgtttagatccaaagtttttctttaaacttccaacttttccatcacattaaacttttctacacacataaacttcaaactttttcgtcacatcgttccaatttcaaccaaactttcaatttcggtgtgaactaaacacagcccttgtttagttgtgaaaattttttgggtttggttgtcacatcagatatacagagacatatttaaagtattaaacgcagtctaataacaaaacaaattacagattccaccaagaaactacgagacgaatttattaagcctaatcaatccatcattagcaaatgtttactatagcaccacattgttaaatcatggcgcaattaggcttaaaagattcgtctcgcaatttacacgcaatctgtgtaattgctttttttcctacatttaatactccatgcatgtgtccaaacattcgatgtgatagcatgaaaatttttgttttgggaactaatcagtgcctaacttttggtccttttaaaaatcttattctataaatagatcttaaaaaaattattctagaaaccaataccttgccggcaaattttgctacaggacactacttatgtgtggttttagccctaggacattgcccaaactcacttttgggggaaaacactccataaacgtggtaatttgccagtggacaccgcgccgattaaaataatactttccggttgaagaggagagagaaatcgcgtgaaatgtcaaaaatgcccttaggcccacatgtcagctctatctcctatctctcttctcatctctctctatattctctctcactctcataggcgcacgggggcggcgtcagtgccggcgaggctggtggtgcttgagcagatggagccgtgggtggagcagcatgtgctgttgctgctcaagccggcgaaggaggcatggcagccggaggacatggtgcccgacgcggcggcgctcggcgcggacgggttccacgcggcgtgccttgagctccgggagtgcgctgcgcggcgtgccttgagctccgggagtgcgctgcgcggcgtgcccgacgcgcacctagtgtgcctggtagggaacatggtgacggaggaggcgctgcccacgtaccaaagcatggtgaaccggttcgagtcggcgcgcgacgtcaccggcgccgacgggacggcatgggcgcgatggatctgcaggtggtccgccgaggagaaccaccacgacgacgtgctcaaccggtacatgtacctctccggccgccttgacatgcgccaggtggagcgcacggtgcaccggctgatcagctccggcatggccatgcacgcgctggtgagccccgaccacggcttcagctatgtcgccttccaggagcgcgccaccgcggcaacacggcacgcaacgtccgcgcccatggcgacgacgcgctcgcccgcatctgcggcgccatcgccgccgacaagagcgccacgaggccgcctacacccgcgtcgtcgagatgctcctcgccgctgtcctcgccatctccgccacgaccgatgccgcctcgtcctcctccgctggcttgagcaatggcagcaagtgctgctccacccatggctccatctgctcaagcacctccagcctcgccggcgccgatgccgccccgtgcgcctctggtagtgagagagaatagagagagagagagatgagaagagagataggagatagagctgacatgtgtgcccaagggtatttttgacatttcacgcgatttctctctcctcttcaaccagaaagtattattttaatcagcgcggtgtccactgtcaaattaccatgtttatggagtgttttctccaaaagtgggtttgagcagtgttctagggataaaaccacacataagcagtgtcctgtagcaaaatttgccataccttgccacatcatggttttcagccatgctgggaacatgattcagccacaccattagtttagccaaaagatttagatctaaaattaaaattataagatgatttattttaaattatattgaaatagttttttctttgaaaagtaaaaggtatgtggccatttgtccatcaaacaagttatatttttttttgaaagaaatcaatcaaataagtttttgttactatatttatatgtcggcaattatctgaccagcttttcagtcgacagaatttgcagttgaccatcggctgcagctcgcaaatttttgcggcgccgccggcgcgcatcggcttcacatacatagtcagcaacacggcgtcctccggttgagttcttggcgtcctccagttgagttcttgggtgaactcgttataaatcgaaatggctgtggcctatgccgctagttgtgcagtgttcagtgagcttcgaaaataaaaatccctgcctttcacggccaagaatgctgttcagtgttcagcggtcaagggctagtgatttcttggttagctctcgtcgattaagttcttaagcacgcggcttaaaagcatttaaggcttcgttttggtttgcggtgggttacgataacctcgtttggtgtagttggagatggtaaggggtgtgtgtggttgtaattttaaggtaccgtgttcaatccttaactcactcacaattttctctccctccaaatcttgtttttgtttggtgtagttgctctaagattttgtgtgatgaattgcttttcttttaatctatgttgcaaaacgacaataatattatgttgaacgatgttgatatttgatctgttagacaaactataaccattataactttgtattcccacatcaacttaaaaataagcaaaacacaataaccagaagtgtcaagtgcaactaaataaatggcctaaaccattctttttttttaaaaaaaagggggggggggctagtctagtgcataaaacaggatgagtttaagcacagcaatatccaagcaagcatcaatccaagagggaaaatgggaatattttcagaaaaaaccagtgtcagggtcagaaaatacctcaacagtagggactcagcaattccatctctgacgaaccgtctgaggcctggttggtctggtttagtttccaactttttcttcaaacttttaacttttccatcacatcaaaatttttctacacacataaacttccaacttttccgtcacatcgttccaatttcaactaaacttccaattttagcgtgcactaaacacaccctccatgtctcccctcctgtaacagggtttcctccaagaaattctgtaaaaaaatcagcggtaagccatcacataaatcgtaacaaatggaaaggcatcttcacatcgcaaagtgaaagataaagcagagtgatacagaaaagaaaaaccatgggatatccaaagataaaaggaaaaataataataatctgcccatggccatggagccaataagcttcttctgatgtttggactcgagagctgttggttttgatgcaaaataacttaattccttctaacgatgtgtgtcgtcgattaccaatttggtgatgcaaatcaggagaataagatgatagaaatcttcttccaagcaatatgccttgaatattcttatgaaatctcagaaaatgatccaaagattcagtaaacgatccaaaactttatgcttcagtattcatgtgttattggttttcaaaactcactattttgcattatttggatcgttctctcttctgaatgcaaacaagaaaccaaaagttgcattttgtgtggttaacataaaatccctgccgacctgcgaggaaaactatccaaacaaaaacccaagagataaattaaaggtagcagataaatcccctgataagacatattgaaggttcttcaattcacccttctttttctctctgaacaatcttaaattctcaatcttgatatgtccaagacagaaggtcttcatccatagttttacatgtcaatcttcctctcttctcacaagaactctggttctcagaagcgatcgatgaatgaaaccaaaattctctcgggaaaattcgattcaagctgatcaagaatgaaaccatgctagtcttcccaactcccaagcaaaaactcatgcagctgaagtgcccaatcaggaaagctcaaaagtcaaaaataacatcagctagaacacaagaaacaatcgagaaaaccaaaccaaaatcaccagaagaaactgaaacccagcagcaaaaccaacctgctaaatcagagctcgtagaggaaaagaaaagaccgaatcaagcaacaaaccacagcaaatcagcaggaaatttcttacctcgtcgtctctgtttcttgatccgtttctcctccatttccgccccctcttgctcagctcggcttctccgcttcttcccccatccgatgggaggagaggtggtggtcaacagcaggaagtgttttgccgcgtggattccagaatgcaaacgcttatttggtccacaaaactgcaaagcagggaaaagtctcaaactttgactggaaaacgcggacctgactgcccctgaaatgcataatttacacgtgattaaacgaacattcctttttctttgtttgttttttttccaagcatgaaaaggacgtgcaaaaggtgtgacttgtttcaagagaaaaaaaggctgagattttttttttgttcatggaaaacaaaaggtggatgaagaacagtagctctggtgcaagctgaagaactgcgaatttgcgatatttttaagattaaactgcggttgaaagaatggttttcgtgacatcaaaaatcgtatcggcagcaacttatgtacaattttatcaacacgttctcatccaaggcctgcaccgctgcatgaacagtaaggatggctccatcgcatgatcaggcagaaaacgagtaagagcagagtaacacaccagaaatcataatcttctatacattttcgactcccaacttttagctgaagttaagtacaaaaaaaggagccaaactagtggactaatctggttgatgatgcttcttttctaacccagaaaaggcacatgattttgagctcattgtgcaatgcaaaacacatgcttgcattgacttcaaatagtccccgagcaaaaggaggagaagtgcaggggcaaaaaatcatggtatgggagcaaagcacatgctgccttgtgcatagattcttcattaacatattaaactataggagtacagccaccatcagtattatcaccatcctcagccaaaaacacgtgaagaacattgaagacaagcttggcaattataggactcaaggtttagctccacatgcacttaaatgttcacaaggtacatgattgacacacttgacgaaatgaaaattagttgcatgacagatgcatcacatggattaagtgttaaggatatcacatggattaagtgttaaggatattaagaactcccatgtaggtcctgttgatatccttaacattaagaattcgcatgtaggtcttgttatactgtcatattcagtctagcagttaggttgcttgttcaggctattttctagtcctcttgcgacccctcccccctctggaggtggctgcagttttctcaggagagctatgaagatcgccgccaccagtctcagagggttcatcattaacgcttgcatctttgtcacttgcttcctcaaaaagctctgtcttatcagtggagttctcatcctcctcctttggagccttgtcagcagattcaaattctgtgagtttgtccttgagttgtctgagcttggctttcttcgaatttaagacagccacaaactagagacatgacacaacagtgagtagagaactactatggtaagctcaatatacagttttcttgagttccagtcaactaataactgaatgagaaaatcactaaatgccaaagtcaaaatatgaccacgagagggaacaaaatatcaaagctaactaattggggagaatgtgaatatcatcatatagtgttcaccgtgagaatagtttgtgatgatgcaaacaagcaaggctaaaggatgaaattttttgaactgcaagaaatgttcgtctttcacaaacaccagggaatgtacctttgaaaatgtggattgttcgaactcagctttctcaatgttaaatctttcactttgttgcaagcacttctcagattcttgtttcaacttgtcaaaggattgtgttttcctaacaacctcttcctgaaaaatgaagggaaggcaacagtttagtcattcaggtcaagtaaatcatatatgaagatgacttggtggtaggttgcagtgaggtcgaatcaagttcatcggaatcttgacaacaattcactacttccatagaaaatattatagcattatatccatggaatggaaaaggaaagtgacatacgctcaagcgtatatttgcatccataagaaaatccaagatctcagctatagtctgctgagtgttaggtgcaggctgcagtttccatcgccattctaacttggtgccttgtttctcaaatgtccatgacagctacatggaaaaataaataatcaataactcgggaaacaaaaggagaaaaacgtgtttggtacaaaacaagcaaggacatgaaatggtctcctcataaaccaagacatgcctgtaaagcagtactacttgtgtttaacataatttcatcaccatttgaaaatcatgtatcatatcgtcaatggtgctcatatttaggatattatgacatcaagggaatccatgttgtccctaacagatagtgactttaagtaatcagggtctagtaaatcgtcgaggcgcaagggctaaccctcaaacaattaagaggtcttaaaaacattatgtattaatataagagaaggaagcattctgagtcctacatgatgtgatcattatacaataacttgatagactgatcctggtttatatgcaaagtttgagatgaggcaccattccaacgctagaaacagttagcacaaaaattagataacacgtgtatattcgtatccgacttaaataaaatgtcaaacaggaatttcttcgcattttagttcatctatgcataaaagcatactcttcgtcaaaattgggtgtgtacaatttaatccatataactaattggtaggagtatatccttaaggccaaaatccaaaaacagaagagattgtaagcaacttgcattgtgaaaaaaaaaataaaagagagtggggaaatattatctttacgccgcagtcaacgtgctcagaaattacttcccagattgagcgcaaaagaggagatagagatcagatacttcacaaaacttcgtaaaagaatcaacattaactactgaatgcattactcgtggatgagtgaaggtgaactacaatcgggagctaaatgcagtctccagctacaaaattaccagcaaactgcgtcgtttcgcccctaaacaaacattgctggaccttgcagtatacacatgtaagcgagagagaaatgtgacactgtgagcatcaaataacaatcctaccatacagttacaaagatgatatcgattgctctacttccaacttgccctaaaagcagtagcattcttccatatatagataaaaaaagaaagggataagaaagaacgaacccttcgattgccgttggcggcgtcgtggaaggagtaggtggaggagggctgctggaaggcgaggtagcgctcggcgagggcgaggtagtcggcgacgggctggtcccactgctcggcgcggaggcgcacctcggcgtcggaggcctgggcgacccacgcggcgccgccgtcggtgacggcgagggagaagcgcgtggggtgccacgtggccttcacgaagacggctccgccgccgcccgccttggggtcctccaccgccaccgagagcttcgcgcagctgtgcctgggcgccgccgtcgaggtcgccatggatcggcggcggcggcggcggcggtggctgttcgggagaacacgcgggctttgaattcgtatgggccgtccgattgctactgttggttcaaatcaagggcccaggtgcgagccctcacaaaattcatcgaaaagtcaaaaaaatacgtgcctgccatactgccaatagtaatagtagtaaccttattttcattttcttttgggcctgtgtaagttggcgaaaagaaaatttttgggtgtcacatccgatgtttgaccggatgtcggaaggggttttcggagacgaatgaaaaaactaacttcataattcgactgaaaatcacgagacgaatcttttaagcctaattataatccatcattagtacatgtgagctactgtaatacttatggctaatcatggactaattaggctcaaaagattcgtctcgcgatttcccccctaactgtgcaattagtttttttaatctatatttaatgctccatacatgtgtccaaagtttcgatgtgatgttttttggaaaaaaatttgggaactaaaccaggccaaccaggcctttgttacccaataccaactgtttaattcattccgttagtttatttttagagtaaatttcgtgaaacctcacctattatgatctgagttgtataaaaccataggtattttggcaagtgggacataatctcagatattatggtactaacttttcacaaagccttgctattgatcattttgtctttgatctaccataattttaagttctataatcgcatctcaaatttatgaaaactttatccatcatatatcctgtaaatattatattcttttttatttgatagataggtatatcaaaatgattaacggtgttgttttgtggaactttaagatcataatactcggggttatgtgtcatgtgccaaaatccttatggtttcgtgtaacctagatcataataggaattttatgaaatttactcttatttttatattaaagaaaatccttcggtgggattacttttgagttttgactcgtaatgatgggagaaaactcatttactccctccatttttaataagtgacgatttgtattttcttatttaaactttgactattaattgtgcttgaattacaagatcaaagttttatgtttatgtcttagagtatacccacgttaataacatagaacatctctagtgcttataaatattgataaaacaagtggtcaaagttaaaaggtaaatagtgccccgtatcagttattatgaaatggagtgggtagtacttaagggaatgtccccctcataacccaaaataatgcttaatataaaagatcataaaaaaaactcaggcatttatgaaaaaaaaaatcaatgtttcgaccttagatataaaacacccccacaaaatttcaaatataaactcgaccaacatatctaagcgaggatataaagctagattatgatcagtacgtcgattctctgccatattatatcagtcttgtttctttccaccgccatgtagattgatctttattgtcaaatagacatcatggcactatattgtcaaagatctttctacagttctttacaaatatgtgcattaatctaaaaaccaaaagcatggtctaagttgacagtttgacacactattttttaaaaaaaaactgtagttgacactctcagctcatcaagacctcaagcaacaagaatcctataattccataatagtgccctttctttcacaagtagctaaaaagctctctctctctctctctctctctctctctctctctctctctctctctctctctctctctctctctaaagaatctcaagatttgaccacttgccccgttctaaactttacccatttttcatcgattttcattagcacgtttttcaaatgctaaactgtgtattttgtgtgaaaactttctacataaaagttgttataaaaaatcaaataaatctatttttcaagttttagtaattaaaattcaattaatcaatatggtaatgacttgtgtcgtttgcgtgcgcatttaatccttatcttgtttgagaatcgaaggaccacaccacgcatcgatcgatcgaacgtactccctccgtcccataaaaaaccaacctaggactagatgtgacacatcctattacaacgaatctggacatagaatatgtcatatctagtcctagatttattttttaggggacggagggagtaagtcgtgtcgtggccgcctctttagcctgtagcttcaaccctaagcttggaatcgaaaccatttccatgatcatttcatcatcatcaattcacaagtggagtcacaaagttgccacgctttgcaggagaatcacttcgcatttcaacgtcatggacctgattactaacagacaggctatggttctctctccctctgttgctttaattttgttgttgtcgctgccacgaggaatatatataaaacagccatcatgattcatcgactgatcttccactgcttttttttttcacggtcaccggcgaagaaggctggatcgccaatctcaaaagaaagtgacgcgaatagcatctgatcgggcgctgctgctgctgatgctgcttttgtttgttttttgtgctcaactaaaaagattttgtgtcgcgttcagttctccacataatatcgcatctgatctttttgttctgctggtgctaagcatataatactcgccttaggcgagtgagtcccctcttctggcatgctatggcaaacgaaacatacagaaagacagaaagagatgatcaatttgtcagggatatgattttttttttggatcttctgaagttctgagatgatgatccatggctgttgagaggaatgacgtccggtctgaagatcgccgtccccaggcggtggcttcggaccaggcttcattccccatgactcatggaacccacacgtgtgtactgatcctgtgagcttcagcttcgtatgaattatgatcagcaaccaaccaagattgcagggaaggcaggtaggcaggtaggcagatgtccattcaattctgttgagatttctgaaggttttcatgtttgggattttgcagaatcgcagtgccactaggcactggctgcttgttttggatgaactttgctagcttggattggatgcacaggttggtactacctacctacttgctgttgctggcatggcatgctgatgctggcatgctgcacctacttgcttttcgtgcttcgctcgaacataaggcaacaaaagattaggtgcagatttcaggacaggatcaacaagaatgaaaagttcatatagcaaataggatttccagtttgaatgaaatgcgaaactgaatagtgacattacaaggacaaaacaccggaaaaaatattctggtcttctaagtactgatgaattattctggtcttctgaatactgatgaatcgtatgtagtagtagcctatagcgtcaaccctagacaagcaagtaatgcattcagtccaaactgtcaacgtcagactaactagaatgaaaagccgctcaaaccagcttgttgcgatcaagtaccagcctcgcaccttccttattacaatctccggttttttagcatacggtaccatctaattttaaaaattgtttattttattgtgacttattttagaactacaatctaaacctaaacttttacatatttatactaaattttaaataaaacgaatgatcaaatgttttaatggcgttatggccggggttgatgtcaatttcgaaattatagatttaagctacattcagtatcaggtgaagaaacaaatgtgttaacatgaatacaggacatgacatttcctacaaaaattcgtcgtacaatttccagaaggctgttcttacagaggttctggtgactgtatttacatctaatcaagctgtttggtccaatcaaagggttcccagtccttcatgaaattagcaacagcttgtttctgattatccatcgattcatgccttcggcgcctgtgcatgtcctcttcccgcaactggagcatccctctgatgacattcaacccaaaacctgcactgaatttgctctcatcgtctatgacatgggcaaatccacggtcgagcccgaactctacatgaaagtaggcaaagttctctgggatgacttggtgcaggtttccctttgttggaataagtttcttcatgtcatgctgggtccattcttcttccgcttcatcaattgcctgaagtaaataggttggattttgttagaacctgaagcacataagaaataaattgttctcaatcatggacaaagcaacagacaaccgaccttcttgaagtacatgggagcattgtttgaaacttcggaggggatagggatgcattcaatcatgcagtgcctgcgttgtttggccaagcttataacagtctccatgaaaacaatatccttgtcctgctgcgcgaacattttcaggaggcacttcttaaagttgcggatctcctcccagacacttctatcaactgttcttgttgcagactcatgctgcaaccataaaaaagaacatatcataaggtagatgatgaatagtgcataagagttgtaatgaaggtcgggtttacatatgactattcaaaattacaagaagctgaagttagcttgttgttatgaaagcacatcataaaatgattttctcacctgcaatggcagaataatgcagtgcccagggacaacaggctcaagctgtggcagcatcaagtaagtgaagtttcctatagcaacaaccagatgctttggccgtgatgggttctcgaagcaatacatacagcgctctttctgagttgtgagccaatgagtgcttctcctctcctcatgtgcatctttgttcctccttttgcctttcttactgggggcatcaccaaaatcatattcatcctctatacttttagacatgttgtactgtttattgtgcataattttatttgcaagatgccggtcagcatcctcttctcttttcctgcgatcagctgcactaggctttattgtgttcctacagattagaaaaacaatagtttgttcagcaagcagataaacaatacgagtatatatatgctgatacaacattgaaatagaaaggtcatttctgtaatgcttatgtttgtaataaattggatgtctacattaaaatatttgaatatccctatgcaaaacaggtgcaccctgtgttttgcacttttttttttgtcatagtatgccaaaatggcatacatatggccaccaaaatatttcagaggagcagatcaagtgcatgctgtatccattccccttcttatctatacaactatgcctcatacgcacatgctctagaaactagacattaagaatatgaaactgagagtatttcaatatgagagaacgattactgttagaacatttcagcatagctttacagttgcagacatatttcttttcaagtcctcagatattgtgggagaataacaaggtaccaatactaaggcgtttacaagtttttagccttacaaagtgacatcatacgacagtgtgtgaaagcaggcatctgtaatgtgctaactcagaataacaacgtcatggactaacctggttgaactcctcacttcatgcctaggttcttcaacagcagtatcctcattctccagcaccgcctccatttctcgctgagcaagaatagttagcagttacaaagtcttgtcacctctaattcaagtatattcaagcatatggaaattcaatttcttaatcatgccctatttcagatataaaagaaattgtgcttcggcatcctaaattgtatattgatcataaagcgataaacatagtgcaaattcttgagcatggattgatgcggatccgaccatggttacatgctactataagagtatgttaaattaggggtcaaagccattattcaatagcaatatgttagctcaggggtctaagccattactgaaaagcaatgaacagcatgtattttctgttacttcaaatgaataaatgaaaccatgtgcaaaactgcactttcattactatattgtaataagtatagttattttccaaacaaattatatacactaataatgaatcaagaaggtaagcctgttaatgttatcacaataacaataatgcaatacttaccgaaagttgttcagcttcttcatgcttgcctttcattcggagctgcagaatctttgctgctaactggttcgcatttagcttttgagtgctaactgaaggtgctttctttgagctacccttatcagacttgagctcatcaacctctgcagtcaaaacatttacagtcttgctttcaagattattaatcttttccaaaaagcttccatcattagagaacttattgattcctgctatcgctgaagagataagtgcctgatcctcagaagaaatattctgcctattccttttccatggtacagaatcaggtttaggttttctcattgcatgatgccgagaggaaacatcttttaagtattcacgtctaccactgtctccaccttgctgaccctcctttggattttctttggaatgttcttctgagctgcctgcttgcccagcttttctgcctctaatggcatgtaaatgagcatgcgaaggggcagctctagatgctgacactgatgcagctaagtggcctaacgagccccatctctcaccaacaacctatattgaatagtaatagaagttaggggaataaactacctaatgtcagtcacttccaataataatatgtggcgacggacatacctcctcaagttgttttccttcacgagctgcttgctcttttgcacgcttcaaagctttgagcctccagctagcacctccatcaccaaccacagaggaagcaagcaactggttgcctgcatttgaagggctagattcatcagggtacccactgccattatccctcaggtatggattcaattcctttggattggctttcttcacctgtcagtacccaagaagttgatgtaagcaaagcaggagagatatcccagtttagagtttagaatcactaaacaaaacatttattccatacatcttatacagatccgtagatataaatatagggtgtgttcgctacagccggctcccaacgtgcacagtacgcacggaaaacggagcagcccattagaacgtgattaattaagtatttgctaaatttttttcaaaaatggatcaatatgattttttaagcaacttttgtatataaacttttttgcaaaaaaagcaccgtttagcagtttgaaaagcgtgcgagcggaaaacgaaggaggggtttggaaaagggggtgccgaacacacccataggccgtgtttagattccaacttttttcttcaaacttctaacttttccgtcaaatcaaatgtttggacacatacatggagcatcaaatgtggacaaaaaaaaaaccaattgcacagtccgactataaattgcgagacgaatcttttgagcctaattacgccatgatttgataatgtggtactacagtaaacatttgctaataacggattaattaggcttaatagattcgtctcgtagtttacatgcggaatctgtaatttgttttgttattagtctatgtttaatacttcaaatgtgtgtccgtatacttcaaaaaaaattttggcgcaccaactaaacacagccatagtattcctgcactgaacaactgaatgttccaggggtttattaaaatatgagttaacgtacaggacaaaacatactcatccatcgtcatgaagaaaattatacagcagttacttgactaaatgtcattgctaacgaaagaaaccaaatctaaatctaagtatgaacatcataactaaatagcaacggtcactcactgaattgatcacaacaagcttagcattgaaccaactttcagctactatagcttagcataaaaccataagcagaatagcattctaccatgggaatattgttcataatttgagtagataggatgcaagtgcctaataccatctgaagactactgttcagctaccaacaattaaaacatggcatcttcactgcaagtggtgaatcatatacaatattaatgcagtacctagcttatggaaatattaccatcacaaacatggcctcagctccacaaagaactacaataagctaccctgaattgcaattatatggcaaaaggtagctactaggacacaagcattgaaccataagcatatctcacatgagatgtggtaatcattacctcctcgggtgcaacctcctcctcatctttgtcagccccgccagcttggctgctctccgcccgaccactgcttgccgacttgagcatccattcgaggcccatctccttcctgacaatatcactagctctcaactcctcacctccaattccctcatcctcctcctcctcatcatcatcatcacctgcggcacctccaagcttgctcttgcgactgcctgtaacaagaggtcagcaataccaggtgatcagaaacacaactcacaaaaatcctaccaaaaagcaccatcctaacctaacctaaacaagtttagggctacttgcctcttctcttatcagattcaccactggactcctcgtcatcatcatcgtcgtcatcggagaactcatggcgccgcctctgatgcttcctccggtgcttgctccggctcaaccctttctcctcctcctcttcgatcgagtctccgctatcggacccctcctcggagtccgagccgtacttgctccgcctccgccggcgcctccggtcccgcctctcctccttgtccctccccttcctgccccgcttcttccgccgccgcctatcctcggagctgtcggaccccgccgagccggcgccgcctagggcatcctcgccgatctgctcccgggggataaacttgacgccggagagcatcgccggtgggcggcgaggcgaacgcgctagggcttcgttggttgggggagagaagcggcgaacgcgagggcttcaacggcggcggaggtggcgcgccggcgacgagccgacgagagagaggaagaggtagcgagaccgcaagggggatccagccatccagggagagagagagcctttccgtgatgtgtaggctggatgggccgggccttaacaagtgacgggtaccgatacaatcggcccatcggcccgtgttgattcaattggcccaatactcaacggttttcagcccaattacaaagcaacaccagtagcctttactacttcctccgtctcataataaattctatttttttagtaatcattatttcattggagtctgtaaaagtagaaaataattatattagaagtacataaagtaagaaataattgtattagggtttgataaaataagtgtattatagtcttttgggttgtttttttatgtgtgtgggatgggagagaaataaacttattttggatggaggaagtaaatataaatcctcgccaaatattgaaggtatgaatttgtttatctctgttccaagacttgtttgttcctcggatagttgggaagaggattagaaagataatgatctcacgatgctgacaatagggtgtgtaaatatcactttgaggtcaaaaccaaatttatgtataattctgatatattatgtacgagtattctatttgatagtttgacacccgtatcccaacttttcctgtaccgaagaaaatctgcttggactcctgtttttcattttccctcctttcctgtttcctagcaaaacaattgatacggaattcaaattacatatacccatttgttctcgctgaatgcgtacatatccaaaacggtctgtgagataaatatccttttccctcttgcactagtcagaaatcatccgaacagcggatgaacaaagcgaacaatgtcttaacttccatgaagtgtcccctgcaacacgcaagcaaaatgctactacagcctcagtggtgtaccacgaagaaagatgatcgaatgtgcacaatgaagaaagatgatcaagcatggccgtacagttcgtgagtaagtaccattttactaccaacaaaaccttcctgctccatccctgagaagggatgtacaagccgtgctccgaggtctgaacactcaacttggggagacgaattcgacaggaatcggtttagctcaaacccagaaattcagttcgcttgtttcgcaccgtgaaacttgcgtgcgaatgttgcagccacaattaatgggaaagcgatcgtagcgtcacaatgcacctgcatttcaaaaggttgaggacttgaggtatcaagattataggtttatagtgcgacaaacatccatggtgtatgagttaacgatgctccaactatctcttggtatcataatttctcgttcagatcttctatatcaggcaaagcagaatcatgtcaaccatcatcgcataaatcattgaacaaagtaaaattgatgcatgcttcaaagctaaaatgcatcaaaagatataggtgcaatacagagcaaaactgtgaaatgaatataagatggattagaattaggatctagtccaagatcattgatgcaatctctttggcataccttgttcaagcgaagctgacaaaaatgttcatatatgcagcatatgatgtttaacaaaaggcacttttagctagctaggcgcacatcaaatattaaaaataatcatgtgaaaattgctcaaggtacagaaatataccttgacgggtttggctgaacctttaatctttccccatgaaactgcttcatcaggttgtgctccagaatcactgccatcaaactcttgggctgtgttgatatagactgcataatctgcaccattgcgaaacatattggcgttgcatatatgatgcttgggtagacctccaccaagaactatgatccctgtcttccttggggttgcatgaatggcttccccattcatcaatcttatatctgccacattttcgagcataatatgagaaaaaaaattgaatgcaaaagcaagaaaaccaagcacacaaacttgccttgtacaatgtcaataattaggccaggattgcggactgcatgacagaatagcatgtctccaagcgatccatcagtcaatgctgggcagtatacaggaatattgttctgatcaagttttggaaagtcagtactatctcgtttcagtcttttgattaacagatcataacattgcacttgggcataagaacttaaaacccacacaagaatatcgaatatcgatgctggtttacgtgtcgtattctccacagatgcttaaagtatatggtctattgcaacatcatgagagagaaaaaaaacaagtgtcttgaccaaatccactcaactataagtctataactcattctaaaaagtcaaataaaggttaaaatttggatatcatgtacattatatcaacatcaataagccaacatccaggatataggaaggcggtgccctagttccaggaggaaaatatggtcccatgccattattgtgaagagtttacagctacnccacattagatacagacaaaaaataactcaaatattttttcaaggaacaaagaaaaattttgaatcagactacctagtatctcattgtgtactaaggatagagatgcatggactttataaacagaattgatggtgtggtccccctcttgtgctattattttgcactttgtaaggatattcaggtgtagttaataaacatgtgttaccttatacgcccaataaaggtaggaactttcatcatttatttctttgccaagacaagctatgaccttcgatggtgtccaaacattctgcaggtaagtaaaattgatcgtacttcatgaacaggagagagagcacaaaagtagttggaagagttgcttctgagagaaaagatgtatctgataattgatagttggaaaacaagggcacagcagtaaagctacagaaattcatagttggtgtcctcatatgtcagttttatttggatttgtgcgtgtatcattactaggttaataaaacacggaccaatttgaaagggagctaatgaaggctggttcaaataatgtgcatagatcctttttattcctgtagcattgaaattcaacatattttaatttattatttgggagtacttgtggggcagattatagctgctttccatttaagttttttctctcatgtttcttatttttgaacattctgtaccataatactagtggagttctaagcactctaagctaggtcattttatattactgcccaatacatgattcctcctctatacagctaatgaatcataagcacatgtgcattatatagtgttgaacacattgctgcaagttatctgcgcttcagccagaagaaaaatgtaacagtacctcagtggattgctcttgtagcatctgatcaaaaagtggcatgatccagttctcaaacttgcaatagttatcattgggaaccaaaagatttccaatccgattcaatccctttgaccgcaacagtgttccaggtaaagaaaattctcctctataagtgggagcaagacatttgatgagatcctcctctataccaccagcagttgtaacaataacatccacctaaataacacatttttcaagggggattagctacatcatagggataagatatcaatgcttttgataatgctagtatgttaccaaaagcatgtaaaaccatctctaccaaaccaggtcataaaaggaaattacagcaacgcgattctcaccatgtgatgctgaactagaaaacggactacatctcgaatgccagaagagacaaggtttgaagtgaatcccaggaatattttgcactttacagattctctatatgtaggatcaagctcagcttcatcacagtcctcacgtggcttctcgtgagacagcctccaatctaacttcagtgcattcaagaacagaatagaaagggttagggagtatcagaacatcttaaaggtgttaaaaaatatcatggaaatgttaaagtggaaaatcgtggaacacacatgtaagatggtaacagagagttttttttcataatttttcatctggattacctccagatcacttacgaggaagttcaagtgtacatttggagttgtccaataaattcacaatgtaaataagtaaatttggtagcattttttatacacctacaccatttcaaatttgctaactgtttcatctgacaggaattatcgagataatcatcagtagagtgtcaaccctagcatgaataataagctgcaagtttccgattttatagcaaccacatctatcgcatcattcagcacatgacttcacctcttcagctccaattacaccaacacagctacagcaatgggcctcgtctaaattgcaattcctaagaaactccaaggatctagaaacacaacaatttcaagctacagtaacccccaaatccgcttcgcctccctcacgggcatgcaaaaggcaggaaggctgcaaagggtgcagtaattagtaacgtaccatctggttgacgacgtcgacggcgtcgccgaggttggaggcctggaatccggtggtggcgagcgacgcgagcagcccggggaggccgaggccggcgtcgttgaagtcggcgccggcgatcctcgtgaaccgcccctcgtcgagggactccgagggcttcaacacgattgagcgcacgccctccagcgcgtccatgtcgcgcactccccctcctcctgcccccgccatcgcccacgaagtcggagcccgagccgccgccgccgccgccgcgagctactgtgagcttcgaattgattttttttttccgagaaaaaaaaaagaatcagattccgcgcggctgtagtttgggtggaggtgttgctttcaacgatgcagatgggccgggcttttcgtcgacccagcagagcgagccggagggcaaggagaaagacggggcggcggcggcggcggcgctgccgcgcttggagaaagcgggaggcaaaggcggcggaaggtgaggtgggggcggccggcggcgccgccacgctgggtctgggagaaggggggagggcggcgacgcgaccgcgcaacatgggccaccgggcgtcgatccatgctgggccatcaaattttgtggcccacgtgcatcctggcttgggctaagaataaccatggaccttacatggcctagctatatgaactaggggtatgaagctaaggttaggtctgacggcccaacatggttatgatcgtttttgcagcaggatggaggagctgaaaaccgaacatgcctgaaatttatctctttttttcctcttcgatgaagtcggacttgtgatttggtggtaatatcatgcccataatgatagggatcggtcgaccgggtgggggagcaaaaatcggacgctccccccgcccccggccccgccccccgcacggccgcccgtgcatgccgctgggcccaccacagtccctgcccctacctgcaacaaatcacccacatattttgaaaaccctctattaagagaatttagtttattttttgttttaaaaaaatatttcatctagtgcactcacaatgtttcactatgtatggatctaatgatgcagtgaactgaaatattccattgcaacaaatcacccacatattttgaaaaccctctattaagggaattcattttattttttatttcaccaaaaatgtttcacctagtgtactcacaatgtttcactatgtatggatctaatgttgcagtgaattgaaacattctttgttatttgctgaaacattgttttatataaggtgaaacaacacccgatttaaacgtgtgaaacattttcgatctacttagtgaaacaactccgatatacctggtggaacatcgtgcaacatttaaaaataattcaataataagctaatttttttgtcggaatatatccatgtgtggtcttgttttgaaacgaattcaaatggagcaatcggatcatgatttggataagtaatttaagagaaaaaaaatagtttaaagtagttttgcacgtaaatcgggagctgacgtcagcgcccgattttaatctcctcccatcggacgcccgagccggagtcacgtccatatcatgtttatacataattttttttataaatgtataaaatttttagatctaattttcataggttaattttcacgtttccgccggatattttccttaaatttgtataaaaagtattatcacaatatcataacttattagattttacaaattcatttcttacataaaattacatgtcagaagtttataagtctaaccaaatcttgttctaatcaacaaaaagtcgtccactgtctgtagcgtacaccctacgtccaaaaaaaatcaattctagctatctacgtgaacaagtgcatgtctagattcatagctaagattcgttttgcactattcatttccaacgtttgaccgttcgtcttatttgaaaaatttttatgattactatttttattgttattagatgataaaacatgaatagtattttatgtgtgactaatttttttaaaatttttcataaatttttcaaataagacggatggtcaaacgttggacacggatttccacagctgcacttattttgagacggatgtagtacttccttagccgttggatcaagtatgcatcgcacgcctgatgattaaacatgttcttttccaattaattaagatatattttaactttgttttcattggcatgttttttcaaactactaaatagtgtattttgcatgaaatctttgtatatgaaagttgctttaaaatattagataaatatattttcaagtttataataattaaaaataaaataattatatgctaattgttttcttgtttctcgtaccctaacctcatcaacagtagaaataaacaacaaaccattcaggtttccgtcatgatatgattagtctattctcaagctagtgttgtaatagtgtatactatgctcttcatataaaaaagaataagtttttaggatgaaaatctggataatcatatattcattcatagaaattagtttttttttcctttttaagaacggagagactatgctgtagtacattatagtatggcaaattggcaatggttgtgaacatgcatgcgctttcgtagagattgtataggagtatgtgatagggtccaataaactcacatttccggcccaacttcaagtcaaacccaagcatacccgtaatagcaccattcagaaaactgtgactgatcgaccgtcccctgtcagaatcgacaaatgcataatctgagcacatttgcacagttgcacccaccccgcgtgtgtgtgaaacttaccattgttcacaatttcacatcacatgttaagtagtacctctgatgttgactcacaagtctgaactgattgacaatgtggtgcgtccgccatacctgggacgtgtacgcttggcatgcgacacactagctagccaaagtagtagtcgtacattctgagtgaacacgtttgttcgacgatgttggatactccctttcacctttcaccttacaccttcccattcagttatagtagtataccagtatctttctcgatcacattacgtcttccctaaagatgtttaggagtactccctctgctcgaaaagactaacttttgaaaataaatttttggtttttccaccgtaaaataatctcggaaaattaaacagggtatactcttgccgatccatgcagatgcaagcagggtagtagtagtattcaactagagtactcgctagctagccacctgaatcatgtcatcctcccgtcgaggcatcgctctctcggcggagtggtgagatagatgaggtcaacatctgcaacgctgtccaccactaacaccgtaccctgtgcatggccaagctaagcttggacggcgcgcgttacagtatgcatgcagcgtgcgttccgcagttcatcatctctgcatgctaggccgaaaaggacccctgatctaacgtgtatatattcatgtagcagtagaagtctaacaacaaaccagcatggtaaaaataaacctgctgttagctaattaagcatccggattgcatctggtgctgtgaaaaatgcagaggtataaagtgcaggggacctgggagctagggagggggagtccaggagcagtagaaacggccagggtgggggtgggggcaaggaaaccggttgcaggaaggcgtacaggaggttgatatgctgctccactgccggtgaattgggttccaggtcgcaagcagctggccgaggacgacgccagccaagccctgccccgtctgcactgcagcctctctctccccttttgttgaattgatcaagcaggaacaagtgacgagaccgctcccgatttcacgcaccgatcctcgtggcgcgcccgccgccggcaacaatcccgaacgggggaccactcactcgcaacctccattccttcacgtttacgtttacaccgtagcagcacgtacgggcaaatgccaagcaggccaaccaaagagatggctcggactaaactgtaatgtacttccttcgttcattaaaaaaaaactaacttccacacgtaaaattagatagatactcatccagatttattttcagaaattgattattttcagagtaactacgaatcatcacttgaacaacgtcacgtatggctcgacaattaatgggaggttttagccggattccggggagcaaatcctaccacatgttgaggggcaaatctcgcaaataccgcgcgacggcatgggcgatgatggacgatcgacgccgcagccggccaaaatcatgtcgagcccgagtccgaacccaatgggtcgcactgcacacggtcccccacacgggcgggtgggatggagaccggaggcgaaggggaacgagactgtgggtggggggggggccactagtcagcgacggtgaaatatatcatgaacagcgcggagaggtccatcgcctcgtcacccaacgatgctattccgagctttaacctcgagttaatgacgaccccccaggcgtccacgtcacgtccttgtccgtcattagtacacctttttcatgtcactgtggccaagtggccaacctgatcgatgccaaacaagtatccatccaatccaacagtactaatgttgcaatttgtggtgtctccctccagaaaaatcccacgtaaacctagagacctatccggaagaagccaaacgaaaaataatttataaataaaacttttatatatatatatatatatatatatatatatatatatatatatatatatatatatatatatgacactcatatggggcaccatggtgcccgggcaccatggtatctaatgcacaaaatcactcaaatttttcaaaatttttaaattgtgagtatatacctaattataataatttgattcatacctatacttatcaacaaaacaactcaaatttaactttatttcacaatccatgattacatacctaactaattatatgtatggatgctatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatggtgcccgggcaccatggagcaccaaacaaatttactatatatatatatatatatatatatatatatatatatatatatatatatatatatatgttcgttcttagcgatctaaaagcaaaggctgaaaaataaacttcgataaaaaaccctcaaaattaactccaaatttaaagttgaaaacgctggaggcggccgagggttgccggatggtcgctccacgcaggaacgacgacggggacgacgacgacagagctggttgcgccccacgacgccgatcttggcgtgcggctctcctgggccagagcaggtcgtcagggcagggggaacctgatggggctcgccacaggagccgcaccccccacccttcccgccgccgccgtggatgcgctgccgacgcggtggacggggacgatgacgggagcccacctgccggccgggatcgtggctgccgctcgtgttcgacgagccgccgccgctcagcaagccgtcgttgttcccgccggagatctccatcgccgcaagccaggacttcacgccaccgtcgccgcagcggcacaaacgacaaggcggtgggcctggtcgcgcttctcgaggggggggaccgacgacactgacagctacaccactaaccctaaccctctctgtgctctctgacctctcgctgcaactttgctcacagatgttggcagagactactgcggcgatggatggcatgcgcctgggcagcattgacccgatgacgatggaggtggcgattggggtagaggaagctacccagaagcttcctccaatcccactcagcgcccctacggcccatcctctgctggaggcccagtccgggtttgaggcccaggaggagctggcggcacaggaggagatggcggcccaagccagcaaggaggtggtgcccgacgtggtgggctacctggacgagggcgacggcctggcccacatcgcccctccaggcgcacctgcgccacctcgcctgttcgagcctctacccgagccgcttctccctcagccgccgccccccgctccagcacgccgtggccgctccaaggtgaagatggtgccctctaggcacagtgcgagacaggcagcacgccccttctcggtgcccgtctccaagcacaccgaaggccgcctcctcaaggagatggggttcattgacaaagaggaggacctcaacgacgaggcgattgcggcgttcgtcaaggctttcgacaagccactgccgccacatgtcatcgccggcctccgctgcctcacccgcctcgacgacccagcttccattccgtcggacttcgccggacaggatggcatcaccaccggcacggcttaggcgtgcgtctcaccatcaccatgcaggagcgcgaccatccccatattagtcagtcactgtccgtgttgtaagagattagcgctgggctgtcaggggtgcttcacaccctttgctcccccctagtagttgctctattagccggctcgggccttaagcccccgggctaataagaaataagcagtgcattcctctagtctgtgtgaggctcaggatagtaactagtatttggctactgctgtggcaatgtattggttcaaatgctgagattataagacgctgcctttttagaatggttgtctcgttgtgcaatgattagtgaacatatcatgtgttggaatgtgcggggtctaaactacccggcaaaaagagaagcaatccgcgaagtggcaaccaccaaccgcatatccatcatgtgcctccaacatacaaaattggcaatcatggaccaaagaatgtgttcggaaattgggggtccaagactgaataatttcagctaccttcctgctgatgggagccgtggaggagcagctaccttttgggatggatgatatcctccagcacagtgatatcaacatcagaaatttctccctctcagtccgtctcacccaacggtcctcaaacacggcattcctcctcaccaacgtctatggaccgacggatgacgctgataaggaaaacttcctccaggaaatgtgcgaagtggcaccatcaggacagaccccctggctgattatgggggacttcaacctgatttatgaggcaagagacaagaataacctcaaccttgatcgtcgattgatggggcggttcaaggctgcgataaatagatgtgaactccgtgaattaagactgcaaaatagacgattcacttggagtaacgagagagatgccccaaccctcgagaagttggatcggattttttgtaacccagatggcgatatgctcttctctaaccacaacctacaagctctctcttcctccaactctgaccactgccccctgttgctctcaccaacacaccagctgctgcgaaaaccaactttcagatttgaaaacttttggccaagaccgccgggcttccttgacaccgtccagacggcttggtcccagccagttagcgcttctcaccctgtcaagcgcttgagttccaagctgaaagctacagccaaggctctacggtcctggagcaatcgcatcctaagtgacagtcgcatccaattccatctcgtaaatgagctaatcctccgtttggacattgcacaagaaaacagagcattgtcgcccttggagatctccctcagaaaagatctaaagctacagattcttggtcttgctgctgtagagaaggcaaggagaagacagcgatccacactaacatggctgaaagagggtgatgcaaacactaagtttttccacttgaaagtcaatgcgtgccatcggaagaacttcattcacaaactccaccgtggcaacgtcatcccagaaactcatgaagccaaagagcgtgccctacacgaacacttctcctctctgatgggccagcgactccctcgctcttgcaccctaaactgggaggagcttcacctaccccaggtgacgccagaagatcttgactcccccttcaccgaggaggatgtttgggaagctatcaaacggatgcttgctgagaaggcacctgggccagacggcttcacaggcaccttcttcagatgttgctgggaggttatcaagtcagacatcatggaattgcttgacaaattccactccttatcgggaggaaatttcgggagtataaacagagcgacactcatcctcatccccaaaaagaatgatgcttgcactatgggcgactatagaccaatcagcttaattcactccttagcgaagctccttgcaaagattttggcaatccgcctatccagacaaattaacaaagtgatatcacaagctcagagtgcgttcatcataacaaggtgcatccaggacaatttcctctatgtctccaacctggctaagaagatgcacaggtccaagcagcccaccctattcttcaagctcgatattgccaaggccttcgactcggtctcatgggagtacctcctaacgctgcttgaaaaaatggggttcagtactagatggcgagactgggtggctttaatcctctcaacctcctcttccagggttgcactaaatgggattgagggagaaagaattgatcaccatagagggctaaggcaaggggatcccctatccccatacctttttattcttgcgatggaccccctacatagactactcaagattgcaactgatgagggcctcctcagtgacctagcggaccgcagtgcacgcttcagatgctccctatatgctgatgacacggcaatcttcatcaaaccatcacgacaagatgtggacagcctgatttcgatcttgaataacttcgggagtgctactggacttctggttaaccttcacaaaagctcagtgatcccaatcagctgtggtgaaattgaccttgatgaaatgctacacaactttactggcccccgcgggacattcccaatgcgatacctagggatgccactcatgataagcaggctccgaaaggtccatcgccaatacctaattgacaaaatcaaggcacgattagccagttggaagaaaaagctcctctcggcaggaggaagaagagagttagtactatcagtaccaagctccatgccaatctatgccatgacagctctgaaaataccaaagcaaatcattcaagaaattgacaaagtaagaagaaaattcctctgggacggtggcgatgaagtcaatggcggaaagtgtaaagtgaactgacagcgcgtttgcaggcccctaaagtatgacggtctgggggtctcgaatctcaccaagatgggaagggcgcttcgcctgcgatggctatggtatgaatggacctcccccgacaagccatggatcggcatgccaacaccctgtgatgaacaggacaacgagctctttgcagcatccacgtcagtgacaatcggagatggtaggaaggcgctcttctgggaatccccatgggcttgcagctccaccttgaaagcaatggcacccaatctcttccaccacgctagaaaaaagaaaaggacggtcgcagaagccctacaagataacaagtggatcgatgacatccgatacaacttgacaactgtcctcgtcaccgatttcttcaaggtcttcgagataatctggacctcaggcatcacactaacccaagacattgaagacaacatacgatggaaatggacaacaagtggagtctacacaacaaaatcagcttaccaaatgtagttcctagggggcataccgtcggtatcagcaaatatgatatggaaatgttgggcaccatcgaagtgcaaattctttgcctggctactcctccaaaacagaatttggacggccgatcgacttcagcagagggagtggccaaataactacttctgtcagctctgcttcagaaacctcgagacggcacaccacctcttttatgaatgcccgatcacaaggaaaatctgggatgccatagcaacaaggctcggcatgcctcagctaagaccacagaactggtctaaaacgacaatccttgaggaccggtggacacaaaccgttagtacaatgcctaaggagaaaaggaagggtgccaaatcgatccttatcctactatcctgggaaatctggaaagagagaaataacatggttttcaagaacatagagacagcgacgcagggaatcgttgagaaagcgatcgacgagatctggctctagcgtgtaagcggggcaaagggcatccaatgtctaacgacccacaaccatggaagcataaccgacattacgtaaattagactcatcagctgcacccctcctttgtagctgcacctccctccacctgctttctttttcctttcttattgtaatctcctagccccctgggctattgtacagtttttccctctactttaatacaaatacaccccgcggggtttaaaaaaagaaaaattaaattttgaccgctaagcataagcctgagtgaaagacgaggcttttttagcttagcaaagtgagttcattagagcttaacagtagctacatcattggattttattttattattttgcgaaattttccctgccaagtgccgaccacaattctgtgtgctactgtggcgtcaaggttcgagatcgattcgaaccgtcaagtccacgaaaaaagatttgggaatagaatgtattccgacaaaaccccgcgctgaaactcgcttccgccaatggatatatgtgatacgcctgcgtggcgatcaggacgtgacggagtaaaaaaaagggcatgcgtaagaagcaaacacaagtctagctatgtaatctattttgagaacactagctacgtaatctcgttcgaatatataaagctcagcaaagaacgaaggcatatatgcactgcacttatctcagttttatctctgcagcaccaacatgcaggttaacccacttgactcgatcagattcgttggcttatctaatttgctaagaattctaaagaattcggatgttgtagagtcctaacaaattgagtcaagtctcatcagatgtataacacatttagtcaacatcttcagtcgtttattggacaagtctaaggctgaagttgactgacatactgagtcctgtcctagcaatatcttttttgctttttatttagcattacaggatttatattgaaagatgttaatggcatgtcattgtctgtccgtaagcttatcaactagtagaaatttaaattttgcagttaaggttttgtatttaaaccacaaattacataaatataaaagttttacctgtaaatatttgctttttgtttgattaatttttctatatatgactaggttgcgttcgtttgtagtagttgataactcattctctatgcacgaaaacaaagtagtggattaacacatatttaacaaagtattgactttttttctaaaaaaattggattagtatgatattttaaaccaacttttctatagaaaaatttcgtaaaacacacaagcttatgaagtatgcgcgtgggaaccaacgaaggaaaggttggatggtctgtttgttaaagctccaagctacttcaagctaaaatgctttaacaaaatgaattagaaaagtagagctatattcttcatatgtcttcttcaaactctaatttcttacagttagatttgtaagttagaatcgtgacccttaacagctagccttaacatgtacacacgtacgccacagaagtacagaacgcgtatctcccttggcccagttggggaatgagttaggcgcgcccacccgatcggatcgatcaaccgaagcaccgagctcgatcgatcatttagctgcctcgcaaaataagctgcaagttgccgctcgtcgcgcgcgcgcggcgcggcgaaccacccatccatcaaccgcggatcccatccccatcccagtgggcgcgcgcgcgcgcgcggccgagaaaaaggtctccccgtgtcgggccgcctccgcctctcctcgtcgtcggctatgtctccatttccgagtcattaacaaatccaaaccacacgctagatagatacagattgatgatcgtatcaccgtctcgatcgtccaagggtgactcacatcacatgccgacgcgatcagcacagtagttatcctgttaattgggtcttgctgaatgctgacactgacgatgtgggccccacgagtcagggatccaggcttgaggcgtcggattgttgggtcgggaaaatcaagtgcagatttttttttttttttggctttctcaaccaccgtggcgagccacatgtacatacgtggttgtgcatgtacacgtagtgtatatacacttggtgcgtgcttacctacagctacaggctacagcatgacagctaagctacactcctctcctcctagctaaattaacttaatttggtcaatggctcctccgatcaatcgatcagtttacacgtaactaatctaatgttttttttttcttcttcccgccgcggcgagctggctgggctagtttagctcgatcgatttctcttcgagacggcgggttcaagtgctactcggcaatggcgccgagatcgggcacgaagtcgcggccacggctgtgccgcctcgtcctcgaccggcggcaccccttcccggcggcgcggggatcggcggcggaggcggcggcctccgggaacacgaggggcccgtcgtggtcgcccaccagcgcggcgctggcgcggacagcgagcgccgccatctcctccgcctggagcggccgccgccgcatagcggcggggagcacgaagtaaagctgcccgggctggagctcctcgtcgtcgccgccgcccaccgccgccaccgcggccccgagctccagcccgtcggcgctgcacaggaaccacgacgacccgccgccgcctccgcccgccgccttcaccgcctgcgacgccctggtgccacccgggaaccgccgcagcgcgccgtccgccagcaccaccctcgccgccgtcgcctcccccgacgccgacctcccgttcaccgccgccaccgccgtcgcctcgcaggagttgcacgcccccatctcacagtttgaatgctcgtcgtcgtcgtcggacgcggcgcggcggtgggtgagccgagccgagcgcgcgccgcggtcggggactcgtggtcggggttgggcgtggagcgcggcgtgcggtcgcgcgtatatatacgcgagggggaggaggacgcgtcgcgtcgggtagtgtcgagaggaggaggaggaggcgatcgtgccaacctggaggttgttgaggacagcttgcaagggagcggggctatagtagttgtagtacgcgcgcgtaaatgtgtgtgacaccgtgcacgcatcctagggtgctacgagtctattttgctaccagtgcgcggtgagttgtgtgcacatccctgcttgcgtggcgcgatgccgtggtggggcccacttgtcagtgccgttttaggacattccttcgtttcaaaataagtttatttttagctcattttatttatcccaaaataagattatttttagagtgatcatcgcatcaaagtttataaaaatagagaataattgtatcggaagtagataaagtagatgtttttagtcttttttacttttgtattggtatatgtgtgtgacgggtgaaaaaatgaactaattttgtgatggaggtagtataagagcaggtacaatagcaggttataaacatattttaatgagataaaaaatgagagagaagaggagcggactacagatctgtagccagctgtagtacggactccaagacacagtgtgtgtatgacagatgggaacatatattaatagtatagtaagcaattattgtatgaattggctattagattagctatagataaattggagctagttgtgggttatactattaaacttgctcttaaaaaaccattaacgcatgattaataagttaaaattattataaattttaaaaatatatttatctaaggttttaaaataacttaatatataatgttttcgtacgaaatgcatcatttagcaaataaaacaccatgctaacagaaactgagataaaatatatatcataatcagaaaaagaatggcgcataagcttaactttggaattaatttagagttttttttccttttgtttttttaaccatcattttttgcgtgaaaaaacaaaagtccagtcctgctagctcctgctagctgcttcggtgcattaagccgtaccataaaaaattcctcctagctaatcagcgatacactgtacctattggtggtgcagcagcacgagttaatggttatggcgaaagcaattgaatcacgtgctgatgctgctgatcatgatcgtgcgaaagcggcgcttaatctaaccagagcttttggaagcggaggaaatggcgtcgaagcttagcagtagaatccttagctctcaaagggggcagcaaacaaatcagcagcaaaggtctaaaggagatgatgattgtagggacgggagagggagaggcatacatgatctatttagcaaagcttcaatttctaaatttaataccaagagttagttctgaagtgaagctgattaatcccagcttcacctgtctgcttcattttacggagctgaaattatttagctgggctatagcttttaagaggatagagcctgagctgaaactgtgacaaatgggtccaacgtcacaaaatcggcggaggatgaggagcagccaaagctgggcaacttcgcgccattttctccgcatgttggccgtggatcctccgcgccgacgccgagatctcgcttcgcattttttgcatgaggcgacaaatgctggtaagaatggaccttgattaataagcgtagcgcaagaaactttgattagcagggttattaagatgtgtttaaatgcgcgtgtaccgtactgttttgacataggattcttcctggttgaaagctcccatacagtcctactatatgctatgcatgggcgtttttactcgagagggatgtcgtaactatggtcacacacacaatgtcagagctgtacagccccagtcctgacgttagtacaggactgaccgtcgctcaagatctcgctccgacgcgacgacgctttcatggcgctttgtacagctggcgacatgcagccagccagccagccagtcctctcgcaacgcccatcaagcctagctcgtccatacaccattattcagacatactagatcggaatggatatacttctgtatagatgagagaaatggtttcggatcttgtagaggagaataggagaggaaaaaagaacaaaaaaaaaattaagatgaacttgaacaaggagatggagattcagggtttaactttttcgatttcgaattaaaaatcatatctcattggtttaccgaaatccgaaaaaaactagtaaaaaccgatggcttttagtcaacgccgtacgaaaaccgactaatattgaccggttttcataaactaacacctagcggtttcgtgaaaaccccccatggaatcatggaggtagcccatacatggtgatcattggcagtggcccctgcagctgcaggaaatgaatgataactgggacagtttttgttgcgtccgtgcggatcgcagcgtttcttcttcttccacctcctcccatctcccccactgacccacgcaccaatggcgccacaggtccacgtacccaaccactcctctcaaattaatctccaatcatccgagctcgacgcatccatggcttggtcctacatggagtgaatgcgagatgcgcccaagctagccattgaagacgtcgctgagctaagccatatacacttaagaggagcacttcagggattcaggctgaccatggcatgcatgcgtggcgactaatggatgaactgatcattcattcattcattcattcattcattcagcatagcggatagctgagcttgtgctcagcacggcaaaatgaattgtgtttcagattcagcccccagttcatcatcgttcatcacatattcacacgcacgccaccctggcttcacccattactctctgacaggatagtagatcaatcgatttactacaccgatataaaaactgacagactgttaggctattcccaacccaagacactagatatagtttccataaacttcacatcatcaagaaactagtactagacactactcttccaatgcaaacactactatttcatacttaaatttaatgctacttatctcacatgatgtcttggatgttgtgtagaaatcaagtctcatgcaagacatggttttcttctcttttctcatttattcacttgccacatcagtttttatcctaggtggcaacttatttaatgctatggacaccatcctagtcattgggttgggaatggccttagtgcttcattttgtgtcctagaatctgcatgctttcaatcgtccaatgaaaaaaaaaagatattcagtattactacgtaccaaaatataacaatttagaacatgatgggagacatcctaatattgctaatctagacagacgaatgtttagatttataatactaaaacgtgtcctgtcaaatcttatattgctatattttataacgaagggaatatatttttaactagacaggaaaattttcactcgattttattggcttgattagcagaacattgacaagcaagatgagattccaagtgcagaaatctcaatcccccaaacactggtaagatgatcagtacactgtaccagacgccagagacatttttgcaagcaccctgcactcctgcaggctgcagtgccaggctagccaaccccgtagtcaaacgaccagattatactattacaccagcacaacgacacttgtttatcggatccatcaccaatcaccctaatcaaactgccaatccgtcgacctgttccagcgtccaagtcttaagcacacgcattaagaaaatgtgaaatgttcctcctgttcagcgatgcagcatcaatcacacacagcacagaatctactgccagcatgtcgctgcatccggatgtaccgacaccggagggacacgcaaattctcagcttgttttcgtcatgtgccggatccaacttgccccttgactgactgtaaattcagagagtgttcagtgcttgtttcagaatcagaataacaattgatgcttagactaattctttgctgataaaaattagcctgtcagatactgtaagtactcaatcagatcaattacgctcagggataagaggtgcaggataaggtagaagataaaaaagcgaggttaaaagtgaaaatggttggttcatggacagtcgtgcaatgcaggatttgacaaagattggatcggctagctgctaccactaatattcttatgcaattgccgatgtctctccgtcatcagttcagacttcagagacgggagaatcgtttcgttttccatcatcatctcatctgcacgcgttggctggtgtccttttttctactatggaattctcggggttttgctgcggccatggggcgcagctgtacgagcaacgcgattgtcacagatagttacctgcatctgcatgaaagtagtaactgtgttgcgtgtcgacagtttttgtcgaggaagagaacaagaaatcaagatgtgattgctgaaatggtatgctgctggctagctagcatctggaagagggaaaaacataaagagcatttcttgtgtatggccttatgtggtgtagataatcagttcgatgatgtccattgagattgtctgttatccttcgttttgcacgaaataactagccacatagtcgctctttacgcaactgttgatcccatttaagaaattttatatatgtttttttagtttagcttagcttttatgagtgttttgacataagttaatttatttaaaaatatcgactggtctacccaactataaatttacttaagttatattatatgtttattagagaaatcaatggcagcttcttttttttttcttcattgtctttgccctcaatatataagaggaggcactagaaattgatctcccaaaattcccatatgtttagttcatttatgttttttattaatgaatgtaccattttgatttaacgactattgtttatccaaactctttatccttgtgaaaaaaccttgttgctttcactatatacaagatgtcatcgctgcaagttggcataccatatctgatgttcaaaattcagaactatttattcggcgaagatgattatacccaatctttctttctttcttttctggaaatgcaacggcagagttcctgttccagctatgcaaacccgagccgatctggtggtgcaatgcaaaatagtagcagcaggtaccacagctggctacatccagctagtcattatccaaataatgtgccttttcccccttttttgcgtaaaaattaagggcttttagtttaaggtccagctcccgttagatgcgactcataattaactcatggcatgtagtactacagcgtactgctcattgcagatctccctctctgataactctgatagtgatgatcctgaattcagaccactcatcaacagattcaacagttaattaagtatgtggtgtttgcaaagtgatgaagatgaggattaaataaggacatgtaaaatgataaagtcatcagcgtatgattgattaaattttaattagtataaacttataaaatgaattcatttgatattttaagcaacttctgtatagaaagttttcctataaaatacaccgtttatcagtttgaaaaacatgccttacaaaaattgagacagactatatcttaatcagaatggaacggagcctttgtaacaaagaaacctcggtcacaattatcaaaacttgctagataattaccggttggtaattaaacgtcagtttttcaaacatttctttgaatttgaccccatatgagagctgatgcaagagtagttctctgtctgttccaaaataaacgttgccatgagtttccgtgttcaactttgaccatccattttatttaattttttttataattaatatttttattgttattagattataaaatataaatagtattttatgtgtgactgatgctttttaggttttttaaaaaaaaattaaataagacgaacagtcagacacaaaaattcatgtctgcgcttattttggaacggagggaggagtagtggatggacgccattgtcattcctactggatcatctgagaataaacatcagaatcagcggtggaatgtctcactcaacatgcatgccatcacatcgcttattgtcacctgcagttgtccatgcaatttggtgttttcagtgctccagctcttcccgagcatacagtatggtcgcggagtgactagctgaccatgcacatcatgtcgatcgatggccaggcgaaaggtccagacggccacaatcacatggaaacatatcgtagatgatggcataaatatatgaccagcattagctgtgcaaaattttgatctcgcatggtctctattactccctccgtttcgaaatgtttgacaccgttgactttttagcacatgtttgaccgttcgtcttatttaaaaacttttgtgaaatatgtaaaattatatgcctacatagaaatatatttaacaatgaatcaaatgataggaaaataattaataattacttaaattttttgaataagacgaacggtcaaacatgtttaaaaaagtcaatggcgtcaaacatttcgaaacggaggaagtataaaattggcaccaaaactaccgtccacaaccaaacacaggaaaaataccatagaagattcaaatattatgacaacaacgatgcacaaagttactacgaaacctactccctccgtcccaaaaaaagacaaaccctggtttccgtgcccaacgtttgaccatctgtctgatttgaaaaaaaatatgaaaaaaattaaaaagacaagtcacgcataaaatattaatcatattttatcatctaacaacaatgaaaatacgaattataaaaaaatttcatataagatggacagtcaaagttagacacggaaactcagggtttgcctttttttgggacggaggaagtacatccgagagcactagttacggatgctcctcctctatccatggtaactataactatcaaggtatcaatgaccttccactgattacgttgctggccatttatttctttttcttacgctatcattatcatacgattacattatgtgtggtatgcgccactctatttaagagagagcttagggtaagagtcttaattctacttctatatctttaacactcaagtcctaatttatatctaattttgtatatatacatatctgatataaattctaacaatctcgccttgaatttccagttcgatgttgttgctgtcacagtactctcagttactctgtaagcagttatccagttgtagatttgaagctgactttaagacgagagagctacagagagcatgagcgctgtagtgtacagtaatacatacagcctggagatcacaaattaaaagcgatcgatcagcagagtcatcgtctggcactgtttgacaatcaaagcaagcacgacgtaaatgatggattgtgatcggcagaacatcccatcccagtgcccatcaagtcatcaagcttccccctttcaattcgtcttctcgctcaggaaaattccatgtcggaggaggcagcttgcaagtaggagggagagattggctagctagccaagtagccagcgaccagctctccatcggccagctgctagctgagtcttccaagtccaagtgtccaacggcgcgccgacgcaagatcctagcgggcgagtttgatgcgcgccacggtgtgggctcccgcccgcagccgccgcgcgagcagttgctagctttgtcttaaaactttcttccaaaaatctagcatgtaaggccctgtttagttctaaagtttttttttctaaactttcaactttccatcacatcaaacatttcatacacacacaatttttctatcacatcgtaccaatttcaatcaaactttcaaacttcagtgtgaactaaacacagcctaagtgtaattgtaaaataactactccctccgtttcaaaatgtttgacaccgtcgactttttagcatatgtttgaccattcgtcttgttcaaaaacttttgtgaaatatgtaaaattatatgcctacataaaaatatatttagcaatgaatcaaatgataggaaaataattaataattacttaaattttttgaataagacgaacggtcaaacatgtgataaaaagtcaacggtgtcaaacattttgaaacggagggagtatattgtagtttgtttgtaacttacaatacaattttttttaaaaaaattctatgataacacactatttccatgaagcggatgtctcatgacataatcccctcagctataagcacgctgtgattttttttcttcgattacatgaatcttgaagcaaatataacggttcaaaatttatttgaaagttacattacaattaagttacaatataattgcactacgattttactgtatttatatctataaaattttttagaaaaattttgatgacaaatatataacaaattcggtggtcaggtcctcaggccccgattctttttgcttctccactgaattattgttgtggattatttcttccacatcttcaaaattaagtttttcttaaaaatactttcttttaatgtgttgcaatgattccttaatctatgttatatattaattaatttattaaaatatttaatttacttcaataattattgactgaattattataatagattatctacatggcgtaaatatgtctcctctcttctctgtccactgaatttgttttgcattattttcttcagaattcagacggggtgggtcaactgaatagtgcattgctgatttgctggtaagatttgttattgcagatttataatagattaatcgaggctcataactttgctgtgacttgtgaccagctgccttgcaggagggaacgagcgaacgagcgagatcttgatgggatccactcgcacacagtgcagtgaacattgctcaatgatggtttgcttggtctgattggaccatggatcttgcatcttccctaccattcccaatcattgggacctttgttttggttctggggttcaattcaattttaggtggtgcattatttgggctaagaatttcaattggtggaaggatgtgagaccatccgagcctatgtgagacttctgaaccaaaaatagcatcatggtggtttctctaatgtatagtgaaatagacttttgtcccgttttggagagcttaaaattcggaggaacggttggttcgtagttaggtttaaaaaatatggaaaagccgggtttcccaacttttggcacgtagttcattgtcgcgcccaaaaatttcaccaattctcatactattctgtgtataaatctatgtccaggaatcaaactaggatacacaaaatgacaaattaatatacatattcaaacgtaaatacttacagaataaatacttagtcctcataaagaaaaaacaaagcaacagtgaaaaaggacgatcctactggaacttcacctccactccacaagtaaaacgcaactgaggtataaaccttggtcttttaactccgtctttagcataaaagcactaaacttttgaaatgtggaaaacaagatagaggagtatggcgaggctatttataccctcgagaaactggattggggcggggagaggcgataggtgagccaacgataggtacaacataggtgagatgcggctttgacgatgtatgatttgcgggagagtggtggggctaaaggtggacaagtggaggagacttgtaggatcgaatcataagaactaagccaaccagagggagggtgaatggttggtatacccaaaaaccgaaaacttttagcggaaataaaagttaccctcgaaattgatggaagtcggtctgaccgagattgatctgccggtctgaccgagtggatgccgccggtctgaccggtgatgaatctccggtctgaccgccgagatcacctgccgcgcctgtcgccgccgccggtctgaccgccatgctcccgccggtctgaccgccgcaatgccgccggtctgaccgtcggtgagttgccggttagaccgccgaaacccggtgaaacacaaatcaaagaactcttaaagttgatgacgactttattgattctttctgtgtttacaaagtgcaccaacagcactccttacaaaaatttcgactaaactcgaaaccctaactcaaaactcaactcaattgctctcaaaagcgataccgggaagcctcacgctccctctctatttatacccgaggtaggcagcctaaagccacgaaccaaactcatactaggagtcctaaacaccttaggaaaccctctagtacaagaaagaaactttacataaccaatcgtaccatatttggactccttctaaatttgactccgcatcccatacgcacacaataactccatcgtatgccatataaaatctccatcaaccacgtgcatcaactctagcctaagtatctcgcatgatctctgaccaccacggacgtcgtcttatccccaagccgactcccggtccatcaccgcaaatactcccctgagacatcgagtcacctacacatggaacaaacaaagaaaccatattccgagaccaagctatctccaagttgactcatcagcagcaaacaatagtattacatacgtatagtatccatctagaagtcataatcataaaataaattcggatatccaaataaacaacccaaaattgaaaccgacacagtgtcggccggtctgaccgcgcattacacgtcggtctgaccggctaccagagcccggtctgaccgatcacataaaatgacgaatcctgcgatcacatgtgaaatccaatcatcttcaaaaccacttcgtgaataaattccaaataacaaaaccaataatctccaatgcccaattgttcatcacaaaataataatcaaaaacacctttgattttacaagactgtgtccacgcacctggagacgcgagtgtggaagcggggaggcccaccggagaggtcgtgatgtgggaaacggttgctggctctcaagccgaagaaaaaggatgatgctaacaggtggaccccacattttggtggctcaaggcaggagggaggcgaagtggacttcggctgaaaggaggctgggccaagaaaggcctgcgcgcggggggggggggggggtg

SEQ ID NO: 59553 - DNA, 19392 bp, Oryza sativa
ccgccgccggcgaccactctccggcgccgaggcggcgaaccatgatcggcgtgctcctctccctgcagagcaaggaccccgacgcgtgccccgaccagctcatccgcgccctctgcatcgtgagtataccaaccagctgcatgccgcgacgtttgctcctctaacggacgaacacctgtgcgttcttcttcttcttcttctccggccagggatccctgcaagccgggacggagacgtcggcggcggtggtggagtgggcgatgtcgctgctgctgaacaaccccggcgcgatggcgagggctcgcggcgagatcgacgcgtgcgtggggcagccggcggcgcggctgctggaggcggccgacctccccaagctgcactacctccggtgcgtcgtgatggagacgctccggctgtacccgccggtgccgctcctcgcgcacgagtcgtccgccgactgcgacgtcgccggcttccacgtccgcaaggggacgatgctgctggtgaacacgtttgctattcacagagatccacaggtttgggatgaaccagaatccttcttcccagacaggtatccatcttcttagtgcttactctgttcatattataaataattgggaaaagtacgaattaccccctgaactattgcggtctaccgaattacacccttgaactcaaaaaccagacattgctcactccgaactttcaaaaccggacgaataacccccttgatccaatctaaagcggttttgtcctatgtggcaatccagtcagcaattcctattttaaaaaaatgtgggacccacatgcatacctccctttcccctcttcctctctctattctctctctctcacacacatatgcacctgatgcagggggcaggaagtgggcgcctgggcggcggcgtgagcggcggcggcgcgagcggctggcgactagcggacggcggcgcgagcggcagcggcagggcgcggctggtggtgagcggcggcggacgggtggacagtgtgcgggggcggacggtggacgacggtgcgcgacagcgaatgggcggtgcgcggcggcacgcggggtggacaggtggcggacgggctggcacacgcaatgagaggtgggggcggggactaaccgatgggcagtggcgcgcgcggacgagcggttggcggttgtgcactgtggcagatgagcagtcggtgcgcgggggcagcagcggaacgcggggagggcgctaggtgaggcggcgtcgccggaggtagcagcccgtggctcgcggtctgcttcccctcaccaggactccctctctctcgggcatgggcacatgtcgctcggcacgggaaacgaaggcggcgggcctgttcaagcttgttcgcgtcgtggcgagcgagcagcacgttcgccttcggcatgaatgctcggcttgtctccggttacatggcgcagttcgtggaagacagcgacgatgacgatgttgtcgaccatgaccgcatcaagcccgatgccctggacgacgagtcaagcagcctcgtgatgttgtaccgcgtgtggcggatggcggagcacgggaacgtcaacggcctcctcgccaagcggccctgttcgccgccgcccattccgccctcaccgccgtctcgagcgacagtggctgccggagccctttttgccgccgcccactccgcccacaccgccgtcccgagcgccggtggctgccggagccctcttcgtcgccacccactccgcccgccatcgtcctgagctcctctagccgtcccgagctccaccgccctcgtcgtcgtcctcgaggtgagggagggagaagagtgaggatttgggagagagatagagaggtgaggggtaaaagagagggtgagagactgacatgtggggcccgctgatttaaaaagaaaagaattgctgactgggctgccacgtagaccaaaaccgcttgtaaagctacttgggggggagggggtttcgtccggtatagatagttgagggtgaaaaatgactggtttttaggtttaggggggtaattcgtactcactcaatacttcagggggataattcgtactttttcctaaatcatttgatttttttctaagtcaaactttttaaatttagccaagtttgttaaaaatatatagtaacatctattatattattaaagcatacttgaaaggaggcaccacgttcgttgtgggggctagaaattccaagattaatcagagaaaaagaaaaaaggagagtccaagtagaaatacaatttaaaaatagcttaaattcggaattaaaaataaggaatattgaaagaagagtcgaaataaaaacccaatacgagattaattaaaattcggaataaaaataaaacccaaaattagaaaaaaaaacaaaagaagatttcaagtaggaatacaatttaaaattagctgaaattcagaattaaaaataagcaatattgaacgaagaatgcatataagaacccaatacaagattaattaaaatttagaataaaaaataaaataatatccaaaactagaaaaactaaaagagaattcaagtgggaatacaattttgaaacaactgaaattgaaaataaaaaataaaaatattaaaagaacacaatacggtattaattaaaatttttgaaaaaaaaataaattatgaaattagaaaaagaaaaataagatttcaattaggaatacgatttataaataactaattttggtgataaaaataaagattattgaaataaaaaaccatttaaaacacatgataagataaattaagtaacatgcctataaatgagtagggtggtggcggttgatacgacatataaaaactgttaataaaacaccaaataaaatcctaatgacgattaaaaggagggacgacaggcatgccgtgaagcaaacgtgcaaggcggttgccgggacttctagaaagtaaaaaaataaaccccattgataatcatattcgatttttaaaatctcaatgacaataaaaggagaaccagcgggcggggtgtataggagtatagttgcatagccgcggacggttggcgggatttctagaaaataaaaaataaattccaatgatagttatgttcgatttttaaaatcccaatgacaataagagtaggcgtcggatgggccgtagaggagtgtagtggcagcgtttgatgggacttctaaaaatcctaaaaaatgaaacccaacaagataataaaagataataaactctaaaaactatagtatccaatttttaaagattcgggacttcaaaaaatgaaaaaaaaacccagtgataatcatattcgatttttaaatctcaatgacaataaataaaggaggtggcggacgagccatagaggagtacactggcaaagccgctgacggtttggtgggacttttagaaagtaaaaaatgaactcaaacaatcactatgtttgatttttaaaatggcaatgataataaagagaagaaacagtggataggccgtagagaagtataatgttagcgtttgatgggtaaactctaaaagttataagatccaatttttaaaggttccaaggagaatgaatagaaatagtggtagatcgagcaagcaaataaagaatgagatgacggaagtaaggggtagtaactggtatgacttttaaaacctataaaattagaagcataaagatgataaggtttggactttcaaagtcttagtacaatgagatagctatttaagaaattttaagtaaaatcatattaaaaaatgtataattttgtatggtgctagccgcgcaattgtgcgggccatctagctagttttcaatataaaacaaatatatttgcaaaatatattcaatgttaaatttaattaaactaatttagtgttgaaaatgttactaatttttcctataacctggtcaaactaaaaaagtttaattaagaaaaaagtcatactaagaaaaaaagtcaaatgacttataatatgaaatggatagagtaatggatagagtagtatatatcaatatatgcatatacaaatgttcgtttcatcttactctttacatgtaacccattgtcaatatatttgtgtgtaagttgttactagtactaaaaaaagagcatcttaataggtttgcggatggacaaaacgaagcgaagatggtgatcccgtttggtatggggagaagggggtgcccgggagagaatttggcgatgcaaatggtcggacttacactagggacgctgatccagtgctttgattgggaaagggtgggggaagagctcgaggacatgggtgagtcctctgggattacaatgccaaagaagttgcctcttgaggcattctatcaacctagagcatgcatggttcatcttctttcgtcctaatatttaatcagcagttttccaaacataattggttgttgaactctgtaatcgaaagaaatgatgtagctcaatttggtgtgatttgcccatagtaattggtgcctctgttactctatatatgtatcctatgaaactttttatgaacctaactagttgagaactggtatgtgttttgataagaatatactagaaatattggcgtgctacgctgcgcccggttgacgttgccattgactttgaaggaatacccattataagtaatgggtctgacaaatgtctgaatttcattcacccgaatcacatcgatcgcacaagaacataaacatgtttgcttcggcatgtaatggttgaagtaggataaaagaacttctacagaatatctttacacaaagtggtgtctgaaatcaatgtcaacttgcaattacattggtattagaattaggcaaaattaactaatgtatggagagctcccgtgtttggccatggccaggacaccataaaaacaaaaggtaaatctttgctctattatccttccaatcgtgccaatatcattcagcaaggcatcacctatcatacaattcgatagaacatataccggtgttaccacactaatatattgaggatagtatcaatggagaaaagggaaagatgcaagtgcagtgactgattccgtaaagatgggtaaggtaaggtatatataaacagagaagatgttgacctagtgaataaagcaccaattattagtgcagtcaacaggagagaaataactcaacaaataaatgaattaatcagtgactaaatatagcagtttctttgtgtaagtcaaaactaaaacctatggatatgctatataacttatctatacaaagattaaatcatatgtaatcatgtaaggacttcacttgtcaaatgtcaatgcttagctaagttaatgtggcataaagatgtaaccaccatttgagagcatgaatacaacacaatagaacttgattacacatgctatttgggagctttgctcaacaactgattactaccaaacggttaaattctttatttgtactgtagtttggaataaactaatattaatatgaatatataatatggacatgtaactttataaagggtcgaaaaaatatgtttcaggttataacaaaatcctgaaatgcaataaaggtaactgagttttagtcaagcaaatatttagagtgaatttattttatttgaacactacaataaaaaatgtgtgtggtaagaaatatctacaactactgcttcaattggttgtgaccaaagcactgatgaagatgaattcagactttatgaattattgcatgtaaaggaattaagaccctattttatataacgtatttgaagaatacggtacatgcaaattgcgggtttaagtaagtatgttctctgaagtgatgtaccagttgtaagccttagttctggcaattcactgttaactgatcttgtcaagtaacaacaactttatagctaagttaatgaccatgtaggtaagcctaattacccacaagccatgtctaactgtactaatgcctatctttttactatttaggtcaaatgaaacacaccaattttggacatttgttatgagtccacatttttcctaccagcaggaaagaatgatgaaatgactgttgttgtttcatacagatgctgtaaaaaaagagtaagaaactataaccagaaatgtgataaattgacattaaagaatgctaagtataaccagaagaacatgagaacctgacactgttagatttgtgctgcagcagaacttgcttcagcaactgatacttgttgaatacatcaatgaggcttgacaaaaagaaattgcagttaggagcaactgcagagaaaaagcattgcagtcaacctaaaacttagtgccactgattgggataccacagttatagcgcgctcattggcaatgctctggccaatatgaaatgaagatgtaattatgagaaatcagttctgataaattgaaaattactttgtcaaatcctaaatcattgtacattgctccggaagaagaatgcacttctatgaacagttgctgaaggcgcttgtttgaatgaaacattgtgttgaatcctctcaaaagtgaaaatttttctctattgtgttaatgtaagataataattgacctaagaaaaatggttaacttaaattaataagcaacagactaactgagctttcaacgcattatctccatcatggattaatgataaatagttcatttaaatgtgcccatcttgtagagaaaaaggatgggcaaacaatcttgttatgaataaggacaaaccaaggacagtaatgagcatatacaaagaaaagcaattagaaaatctattatcttctacactgctattgggaagcaaaattcaatgtatatagtttagagtttacttaactttgtgcagaattggctacttgtgtagatcatgtgctcgagaagatggcgttctgagtctgtctgcatcctattttctctaacaaaaggaaatagtgtatgagaagctagaaccaaatgtattccatgccaaactaaacaatggagggggaagcagatctcactaaaagatatggctaactgagacagaaaaaagcaggaaacgcgaacacactatagaatcattgatttgaatattatacctgattaccagagcagttaccataccagaaaaggcaaggcagtaatgtattcagcagttacagctgcaattaagaataaaatcatgcacacacaaattagcatagtaaacatagaacattaaagataactatcaaagagatagaataggatgccaacaaaagtaggatgggtgagggtagcatacgaccaaaacagaacagagacctaatcagcatggcacaagcagaagggagagaagccccactcgtactgacctatggtcctctcgcataatagcagccatggctgttgcttcaccttagattgtgaggctaggtccccgtgccgtgatgcagaccctggttgtggctattggtcaaagatgcgaggatagcgtctaggaaggtacctaagggtggaggaggtgaggattaccatggtcaccaatggaagaaacgatttctagtgaggagggaggggaaaatcatatcagcggcacaccatattgtggattttggaggaggcgaaggctagatgagagaggtcggacggaaatagggattggagcgatgggatcggaggtaatctagaaggctttcattggatcaccttcgcagataaagtggaggccctagggcctcccgaccgagcgcacgcggccgaccaaaccgttgaggcaagtagctccgacgggaaggcaatgcgcagccgaacggtgaaggaaaccctggggaagaagaaaaaaaaagggagaaatcactggattagactgctactcagcaggaagaaagaggaaaaagaaaggaggagaaatcgccggcgacctcaccaagaaaaccgaagaggagagaatggggagaggagggatgtgcgcagcagccgagaagagacttcaccaagcatcctccactaccacgtacggcggcaggagacggtggccaatccggcgtgcgcttacacggcaagcggtgtttctagcgccgctccgtgtggaacagaagcacggaaacacggaaatagaacgtgggctgagcaatgagaaaggtaaaagcccatgtgtaaggaagggccggcacaggaaaatggcccaataggaacgcatctaatcctgtgctactaaaaccaattaaacagaatctaatatatcgctgcgcactatcgctgctaattgctaaatgcatatgcgctttaattatccgaaccaaactgatgacgtggcgcccctaatcttccaaagatcccacggggtttaagtaatctaatattagtataagttaaaactcgattggcaatggagcaacaacaagtattttgtactcgcgctggcttgacggttatccttgcctcattgtctaccatatttatggcttttacatcatgacaacatcatgacatgactgtgtttagtttctgaaattggggagaagtttagggaaagttggtagtttggaaaaaaagttgagagtttatatgagtaggaaaattttggatgtgatgtgatgaaaagttggaagtttaggagaagtttggtgtgaactaaacaagacctaaactatagtgcaaaaggttaaatgaattctgatcaaaattcgtccgttggcataccttcgcttcttcccaataaaaaaatttcgctgattaaattgtttagccaccaaatgttggtgataaacttcgaagacaattagtgacaattttgttaggagctagattttaaaaatagaattagttctaacacacaattgttacttctatttcgataaatacaaatatattttatctcaaactattgctctatttctgaaaaagtatatttattttatgtaaaattatatagatcagtttagatcgttcttatacttgtacccaccatatttcaccggtgcattttttttcttttttttcgatgaaagtggtaatttatatgccgcgatgaaaactgtaactcttttacatctttcgtataaaactaatatcacgtaacgtaataagaaacaccgagggatcttccggttagctacacaaggtggtgagctagacgacttggattcaaatgctcatccattataattatttgatattaggtaatttcttaatatttacgtctttacataatataatataataggtagatataatcggtaagaacaattcataatactgattaaatttcataaagctacatatacttatatgctatatgtttaacctaatacttttcataaaactacagacttaaagtatcgtatcatattagaaaaatacaaatttaacattagttttatcacaaaactacaacttttatagccttaaatatgatatggataaaaactctaaaatctatagatattttataatttcatcagtaaatctgtagttttggatatgatgccttaaatcagtaattatatgagaaatttgatacttcctccatttcatattataagactttctagcattgcccatattcatatactccctctgacggagcgtggggctcctcaccgggagaccgcgcaggcccccctttgccagttcggccgggggcgctaagtgaggttcttcaccctcgatctgtggaatgtacgcgagagagcaaacgcacaagacacgggcgatgtagacaggttcgggccgctgagaagcgtaataccctactcctgtgttctggtggatatgtgtgaggaagagttacagagagtcggggagcaagagagttcaagctctagaacccctctttttccttctcttctggttcttttttctctcgatctcctcccccagctcaagtcttctcagagttgtccccccttttctttgtgggcaaggtcctccttttatatctcaaggggataccacatgcaccacttctacctactcttcttttgggtggggacccaccctatcttgaccaaatcttgacacgcacctccgcctggaagctaaatcaacgcctgtccttgagtgatgcccagcgccgtcactcgtcagacacaggggatcaccctgtcatttcttcattaatgggcggagttttgcaatggccgctgtccgaatgaccctccgatgggatgggtcatacctgcctccactccgctggaagctgatgcaacatgagagcacggttgtctgccgatgacgtgaccggcgtcggaccagtgacagaccggtcattcttgtccaccacgtgtcagtttagcatgccacacatctgcccttcttcatacagtgacttccttgcaatggttgcgatgaagcctggcatgaatcgagccgggactgatgtgctaactccaggagttaccacgctggctccagctagggacgagtgccaagaggctctcatcattccgacgggacggggcgaggcgtgtgacagtccgcctgctgccacctaacccgcgatctgaccggtctgtgaccgatcacacactgcgaccggtcacggaccggatatgcgtgcgccgtgctgcattaaatgcggcgtggcgcgcttgtccattccgcaataaatgtggtttggtgagcgccgctgtgcccacctaacttacaaacatggcgccaataccacagggggtcggggcgccccagccctcggggccgaagcaggagcggcccgacccctcgggaagacagaggagggggtggccacgtctccctcgggcccgaccccccccccccccgagggggtcaggccacgtgggtgactgcggctgcccaagcctctagtcatgatacccccgatcccatgtcaccgacaccctccgtttctaaatatttaacaccgttgactttttagctcatgtttgaccattcgtcttatttaaaaacttttgtgaaatatgtaaaactacatgtatacataaaagtatatttaacaatgaatcaaatgatagaaaaagaattaataattacttaaattttttgaataagatgaactgtcaaatatatttaaaaaagtcaatgacgtcaaatatttagaaacggagagagtttatgttaatgaattcagacataacatctatatgaatatgagcaatgctagaaagtcttatatcctgaaacggagggagtattaaatatgtagtttcgtgttatatcctgaaacggagggagtattaaatatgtagtttcgtgatagtttagtcaaaatatatacgatatatacgtaggttttgtgaaatttattccaaaaatatgtatctaattgtttctctattttaaagtaggggaaaaaaatcctaaataaaaccctacggaattgtttattctcctgccttcagccgtctccacttctccacttgattggcagtcgccactgaccaactttccaaaacctcgtcgccggcggccatggcctacctcccgccgcacaagcgccactccaacgcctccacgcccgccccgaccccggcccctcctcctccctccctctcctcctccctccgctcgctctccctctcctcctccccacgcggccgccaccaccgcggcgccaccacccgcccttccagcaagatcgtccacgccgccggctgcgtctcccgctggtccacgctcccgcccttccccgacgacgacggcgacgacgacgggtcgctccgcctcgagcccttcccctgcgaccccatcgagcgcaggaccggcgccaagcccctcgccctcgtctcctcctccgccgccgaagcctcctccccctgctccgcggcggccgccgcatccaccgtcaccgagaggttcttgccggacctcctcgccgcggcttggagggcgaaggcgggcgatgtgcctgaggaggaggaggaggtgaagctgagcgtcgtggccagggtggggaaggtgctcttcgaatcgtcgtgagtctccttaatttctcccatcccatctaccatttctcgttggattcgtggaagaatgattgggtgttgatcacaaagagttgctgctgttattattgattgattttgtgtagcggcggcggatcacccgtctccatgaactcgctccgcgaagccgtgaaagcaggagaagagggctcgaggagcaatcttcataaatcgttctataccaatgtgcctagtgagtgcttggatgatatggagggatccgctgcggagaagatggggctggagtttgattcctccaaagagcactaccatgtgaaggtttgcgcgtctggtagcatgtcaattacgatgttttgggtttatagttgggtgaaattaactttggggcctgtaaatgaattgtaggtctttgacaagcgtcaaagtgattctacaataacgtgcaaatgcaccgtgcaagaagatggaaagcttgctatccataaggtgtgcttaactgcttatcgttctaaccttagcctcttaccttttgtcttattaatgttctgcatcatagattcatatgagtagtttgcacattgtattttaattttggctctacttgtgtagattatttttctgagtatgattgctgaatgcccgaaaatagagtgttgggattgttagcattttgacttgtacccatgagaaataggaacaatgaggcttcatctttgtgagatgtatggcataaatcatagctaccggtctatcatagggatcttgattcgtatgagttttttgataaagtgagaagctggctcatataaacttgtctacttcatttgtggtactagatgaagcctattagctactttgtccttccaggtgttgtgattcccaaaatatatgcctttaatcatttttgaggtcgctagttcttactgattggtcttgtggatgcaacattatagtaaatctactaatgatggattagctcgattagctacaaacttccaatactatagactggaagcctacactatcagtaagcaagataatatactatgtgcctctcaaaattccaatgatttgtcatctagcacttactcatagccttttttttttcctgtagtggaacttctttaggatagtaacttctcacaattgaaccttacattgtcagttcgcagtagcactatgcaactctttcatgctaactataattctgtgatgcaatatgtggttttgtttggttcattgagaataagtgccctgtagatgccaaggagttgctcaagtgggctttgaacgttccaaaaggttggaggcccatttacaatgcatacatgtgagaaggagagtacatattctggagtgtatcagtacagggatacttaggaagtttgtgtacagtgtacttacaatacatctgtatgtgcacttacaaagtatgtacagttgaagaggtttagatttgaatgaggctatctgtacatacacttgaagtatgtatatttgaagggatttctgaaatgttcgtgccataaaatctatctaatcatcaccaactttctgaacttaaatttttattttgaaaagctgaaatataaccagtaactagcaagtcctaattatgggccacattgcacagtaatattcaattttccatgttttgttgaattcgatagcctatggtacacagccaatgccaaacactatactccctccatccttaagagattctggccccttcatttggggacggagggaatattttggttgtcaattgtaagaaatttgtatctattagtagaaaaggtctggtgccttttttccttcattgaaagagtcatcttttgtgtcctttgctaggagtacagtagacctagcatatctttccttggatggttgtatctgagttctaatgtaatccgttcttgattcagccttgaactattaccaggttacattatattttgtttagatgacgattgaattgacagcaatcaaatcaggcctgtgttaatgtgatcatgtcctatgtctattctactgaagaaatttcatgacagtggtttttgtttcttcagtttttatgaactgcaaattttatgttaaaagcatctcatataattaattggtaagtttgttaaatgcaaattttacccgtgtaggataaataaaactttgtgtgcgttgctatatccttaaaatatatattattcaatagaagaacgaactctttggcttaacatgtttgtttacactgtcatacttttccatgcaggttcagttgaaccaggtacgccacttggtggaagatatatcctgtctgttcaaggatctggacctgaggctgatgttgtctaccaaaagaatccttaagaacttagatgtgagttgggttttgtttgaaaattctgatcctttatgttatgagacatttttggcaaagttatttggtttttgcaggctgaagtgaaaaatgcaataaattgcttggtatcttctgctgttattgatcctgatgtcaaaggtggacttagatggcctcttgggaaagaatcgattgatgagaggttcagcatagttggagtgtggcatacaaactacaaagctttcagaaatgagaagttgaggctcaagctaaggcatgctgaccggtttgaccatcgaagctcaactggagaggtttctaatgaagttacctttaaactaattggcatatctgcaagtctggaggtaagtaaaatctgctcgtaagttaatgcgtatgtgctgttcttcagcatttacacttcagtttacattcctaataaggctatgatccaaagtccgcctccgctgtgtactgcatatcaattatcatgttaatatctaagatcccattttaccgacatggggtcaaccagaattggaatatgtggctaataatttctggtcaactgtgcagcaaacggcattatgagttaatgacctttgtaagtcttgttgttttccaggctgttgatcaggaggcgaattctctgcaggagatgctggagtctgtggtaggaatgatctgggagagcggtttgagctacaagaaggcgccctgagcacagttatgccgagtggcgacaagtagacaatgctacaagagcttcttgccgatgttaccgtctgactaccttctaccctggagctaacgggcgttgatctcagcccaccccatcatgtacagtttcagttagcctgtctctactgtagtgtcagtgtgtcattctggttagcaggttaagtagtagtgagtagtctatgggcatggtcgcatggtatggtaggttttccacttacttccttgctccttggcgtcataggttgatcgaaccacctacatgagacgctaaattcaagtgaagttgaaatgactatgcaattatgcattcttctgttaaacgagaatggcatattttataatataactttgagtaaattgcactcaagatacaattgaacctacaaacaaatatctgttaaaaatctctgtgttatgtttagatcaaagaacaaccaaccaaattctaggtggtgcttaaaaaatatgtaaaaactcctacccattccatcgaaaaaaaaaatcctaggtgccagttttagatcagaatacaactcattgttttttactgttgcacaaggcttagattctgctaaaggcaggtcgagtcttatactgaaactgcaacatactcttgttgtaataacttgttgaagcctttttcaaataggggtgtgaatttgtgaaacaagatattcggattaaggctgcgtttagttcctgaaattgggaagaagtttgaggaaagttggtagtttggacagttggtagtttggacaaaaaaaattgggagtttacgtgagtaggaaagttttggatgtgatgtgatgcgacggaaaattgagagtttgggggaagtttggtgcgaaaatatggcctaaattgagtaaataccagtatattggttgatgggggcggcgggagcattaagtatatataaacactggaccgtcattgccgtcgcggcgtcgtcaacaaatgatgagtcatgctgcaagcctgcaaccctcgtcgtcgcatcgccctggcctccagtctatggatcgatcggctttgtacatcctggtccttttttaagattttacaaatacactgtcagcaaaacttatgcagagatggacatgacgctgatcgattgcagccgtagccccgtagcccgtagcgacggaccgcacggcgcgtgcttctcttcgcctcaaacctaccaggtgttcggcgaaatgccggagcgggcttcatgccgctcgctcaccaccacgccggcgaggcggcgaccgtcgggtgttgctcgagctcggccggatcaaccaagccaccgccgacatatggtgaatcttccgtgccggataacttgcgccgccacgccagtctggtacggttgagcttaattcctccttctgcgatactcttgtatgattgggaaataggaatagggtttgggatgttgcgttgttgcaacaaatatacaacgggatgggataatcagacctgcagtgccgtaatgcaatctttaacaccagccacagtcgaattcacagggtggaaaatttacccaactcgactagaatagaaggattctgttgcgaaaagtgtgattctttctttttcatccaaagttaaagaactgtttgtttggtgggtcacgaatgtgtcgatttagtcaatactcctgtcactaatcaagtactattagttgtggtaggagtactagtcaagctcaccacctgtgtggtttagcagcgttatcctctagtttgttagcaggatccacatgcgtttctaagtagatttctccatttctgcccaaaaaggccttcagcttgtgtgccaaagctttctttctttgatctctcaaggactcaaacatggctggtgttgctgcggtttttgcagggaaagctattgcaacatcagtcatcacctatgtcatcaacaaggcattcgactacttgaaggataacaaggaagctggagggctgaagcctactagagagaggctggagaaactcctccctcagatcaaggtggtcttggatgctgtggacatggagcatatcggagaccaaagtgatgcactggatgcgtggttgtggcagctcagagatgctgttgaattggctaaggatgcgcttgatgaactggagtactacaagcttgagagggaggccaaaaaaatacaagcgggtagcaaggtgagtggctctctgcatcagtataagggcaagattgttcagcgttttaatcacacatttaacactgggtcactgaagaggttgaaaaatgctgtcaaggctttagctgatgttgcctctggtgttgagcgatttatccaagttctgaatcagtttggcaataaggttaactttaaacaagaggtggaattcaagaatttgcgtgagacaagctcattgcctcatagcctagtacttggaagagaagaggagagcaatattgtagttcagtggctgaccaagcgtgaaaacagtgcatctgaacagattgttggcaacatccccatattttgtatagttggtttagggggtattgggaagacaacactagctcaagttatatgcaacgataacaaggtaaaagattattttgatttgttcgtctgggtttgtgtttctcacattttcgatgttgaaacactaacgagaaagatcctccaaggtgtgactagaacagaaataggtatgattggcctagatgctctccacaaggcacttcaggagaaactgagttccagaacctttctcttggtactggatgatgtgtggaatgatgagagtctgcgtggttgggagactttagtaagtccattaagatatgggaagaccggaagcaagatcttgctgacaactcgaatggaatcagtagctaatcttgctgcaagagcgatgcaaggagaatgccagtctttatcattgagtgggctaaaagaaactgaacttcttcttctgttagaaagacatgccttttttggagttaatcctgatgattatagaaacttgcaacacatcagcaagaaaatggtaagcaaactcagtggttctccattggcagcaaaggttctaggtggattgttgaacaacaaaagggatagtaacacttggaacagaatattggcatcaagtgttcataatatacaacagggcaaggaagggattatgacagtgttaaagttgagctatcagcatttaccaacccatttgcagtcatgtttcaggtattgcagcttatttcataaagactatgaattcacaaagaaagaattagtgtatttatggatgggctcaggactaatccaacaatcggtagatggcatgacaccagaggatgttggaatgggatatttagatgcactaaccagaaagtctttttttgagattaaatcaagacctcggtctagtcgtgatataaaatgtcgtttatttgaagaatattacgaggaacggtttgttgtgcatgatcttttgcatgaattggcacggtcagcttcagtgaacgaatgtgccagagttagtataagttctgaaaagattccaaatactattcgccatttatgccttgatgtgataagtctcactgttgttgaacagatctcccagtcaaagaaattacgcacacttatcatgcattttcaagagcaagatcaggcagaacaagaacacatgctcaaaaaagtgttggctgtcacaaaaagcttgagggtattatccctaaccgcaaattatccctttaagctgcctgatgcagtgggtgatctagtgcaccttcgctatttgtctctctctctcatgtggggcgaaggaaacacgacacattcctgttggttcccacaagttgtatacaatctatatcacttgcaaacaatgaagttcaataatccgagacccgcagtccctatggaaggacaaatggaaggaatgtgcaagctggttaatctgcgccatttgcatctaactcttgtaataaggcccatgattccttttataggaaagctgacttctcttcatgagctatatggtttcagcatccaacaaaaggttggttacactattgtcgaactgaagaatctgagagacattcatcatttacatgtttcaggtcttgagaatgtttgcaacatagaagaggctgctgaaatcatgttggaccagaaagagcatctatctgcagtaacattagtttgggctccaggatcatctgactcatgtgatccaagcaaagctgatgcaattctcgataagcttcaaccacactccaacacttttaaattgcaacttgaaggatatcctggttctcgacctccattttggctgcaagatctcatactcattaacttgacatacatctatctacgtgattgtcaaagcatgcagtgccttccatatcttgggcatttaccttctcttcaatttctg

SEQ ID NO: 59554 - DNA, 16836 bp, Oryza sativa
ggcaaacgaagcttccgggaagcttcccgccgcacgcagcagccaccagccaagccaaggccggcaacgctgcttgctgtttgcggccttccgtttcggccttgctccgtccactccacctgcgccgcacgaatgtcgtttggtgagatttggtgtttttttgcccgctttgcgtttggctgtttttttttatgtgatccgtcggatccttttcagagattggtacggtaaattggtttagagtaaatctggaccgttcattgttaataattccatggtcgacaactcgagatcggccaagattttcctagtggtaatattgacacaataaaaacttttagggctcctttgaatcgtaggaagaaaaaaacgaaggaatagaaaaaacataggattctgacaggaatgcaagtataaaacagaggattacaaaacacaggaatgatcgtttgattggaccacatgaaaaacacaggaatcggatgagagagatagactcaaaggatttttaccaagagattagacctcttgctaaatttcctccaaaatctatatgcaacaagccattccataggaattttgttggatttagaaaactttaatcctttgaatcaaagagctacgtaggaaaatttcctataggatttcaatcctatgaaattcctccataattcctttgattcaaaggggccagttagatagagttgaagtgtgtgccataggaatcggatgagagagatgcgcggtaagaaacggcgtcgaggcatgtggtactgtcgaatatctggccaattattggaagaaggtgagaattttgttttggatacacaagatgggtccgacgacgaccagattgagttcatccctgattctgatgatgaaggcatcgagtactgcttctccttagatcaggagtttgtgcccgaaactgagttctaggattgtagggaagttgaggagaagggtggtgggattcaggattgtggggaggtgaacgagaagggtggtgggattcaagattgtggggaagcgaaggagaatggtggtgagattcaggattgcggggaagtggagaagggtggtgggatttgtggcggcagcaacatagtgcactcaaatgatgaatgcaaacagcctgcccagatgtggtgcgggcagcgggttcgaggcaagtggtttcatcgtgaatctggccgatgtttagaagaaggcaagaacgtgatctttgatacccaggatgggcccgatatggatgagtatgagttctggcctgatttggatgatgaaggaggcgacttcgtatttgaagattggttcattgacgttgtgcccaagaaaaagattcacgatggtgttgaaatggagaagaagcgaggcggtaaaattggcaagctgatgagctccaatgtgacttatggcatgggacgacccagttctaccattaccaaggcctccttttcgtcgaatgcttcttatccgcagggaggtgacctgtggcaggggacaatggccaaccacagtgctgaaccgagcaagcacttcgtggtggagtcctccaatatcagcgagcagagcaaggtgtgtgctattaatttatttgagtcaactttgcataaaaaattgaagatatattatttaataactatggaaacttacagataaactcccgaggagcctgctatgtataatatatccatatacttctagctagtaacaattaggtaaccatagatatttaatcactctaactttaatgcattatgtaatgtgcaaccaaagccacaagttagtaagcagtatagtgccatatagctggaagacttgatctgttcaatggagagtcatgcaccatctaatgttctagccgttaccacacaggatctttattgcattccatttaatattgttttgccatgataagagtcctgcaacgcataacatctgttcgtaaggtagcattgatttgttgtcatgctaattcagttatgtatttaattctatctttagctctatttaagttctagtgctgtacaagtaatttttttcaggtacttaatacagttcttgcttattttcagtagcaggtcaacaggaatattgtgtctgggactgggatctggagttaaggatgcttcacaattcaaatttcacaagtatgtgaccatctaagcatgattcaatatttcgcatcataaacacgtgatttgttgatgaatattaaatactaaaatttggcaagacgtgtgggttcttggcaataaattggttctttgtactagcaattaacaaaatcagttagtaaatattgacatcgttctgctcaccaataggttgtgcctgttaattcttccaacatgctgtggccatgaccaaagttacttcctccctaattcgatgttaggtaacaatgtgctatttacagttcatttgttttctctatcttctgtaaagtccagatgctctaggattctgaaaagaaatggttaaatgtgaactaaaatttcatactaggctctgaaatctaatctatttgtttgccaatgctttaatctatttgaaaccatagtgacatgtcttgagttttactctctatgattactacacctgttgtctagtttctaaagtgtcttctgatacatgataatggaactagaagaactaaactctgcaaaactgtcacagtagcaaccttttgttcttttcagatcgtgtgtgtgtgtgtgtgtgagagagagagagagagatagagcatgtgtgctgatgagggggtataatctgctgttgcatgtcatacaacaccataggtttttagagctagatttactaatgcaatcaacatgtactgagaaagaacccattttatgcattgagaaagattagatgaagtaaaaaacctggatgcagttgttcttgttcttctgttgcttccaagttgagatcaaaagctcccaagttgagatcaaaagaatgtacaacttgatcatttccatggcaagcaactcgagcaatgtcatctacctagataacatgccttccaggaacttcttcttctagattggcttgtgcttcattgaggtcaggtaaagcccctccatcttcctcttcttctgctaatatgtttagatctatagccattgtgatgggtaggtgtggagttggtttgtaggatgatggatgaagtgataaaaggcttgtagctgcctcgctgcttgaggattatggagggtacccttgggcggcaaagcaccatccatggagtttttgaatttgattagaccagttggattattttaagcccttatgttttggcgccatatcactcgaattaggtgtataacaccaatctgtagtgttgatactagtagtagcacccaacattaattggatgcttcaaatattccttttgtacagatgtggcagtgtacttgtcgtactcctactaagcattcaaatgattagccccaatcctataaattgagggcaaaatggtcattttcacacaacactattttttcctaactaacctagaacgtcctcctttctgggacggagggagtaatttgctacaaaacacactaagactattaaattattatttccattaggatcggagagagaatttaactaaaatgactttggtgccccggatttcttccaaccatccattcctctcacgcgtagtaaggctgtgttcgctccagcgtgttcccaaccggaacagtgcgtacggaaaacggaacggtctattagcgcatgattaattaattattagctttttttaaaaaaaaatggatcaatgtgattttttaagcaacttttgtgtagaaactttttgtaaaaaatacactgtttagcagtttgaaaagcgtcacgcgaaaaacgagagagatgttttaggaaacctgggggtaagaacacagcctgagggtgtacggtgcgaggaccggcgatgcgactgtatggtgtggcggtagcgactttgtagcgggtggctagcggtgtagcggtgaggactacatagtaggccaacacgatggcagcggccttgagggagagggtcacatgagtggactgtgacatggagcacagcagggagtgagcacgtgaggagcagcatcacgactaggtggtgcggcgggggtagcgcgctgcgtgaggagaggcggcagtgacctcacggtgggggtggctgcaacagtgatgatagcgtgactgcagcgaccttgctatgagacatgggtgcacagcgcttgtgctcacacgaacgtgagtagtggttgcatgactgcacgggcggcagcggcaaataactcggtgccggagaaaaactgaaagaagggagaagaagataagggcaaaattcatattttatgtggtttctctcgtattaattggatggataatatattttaatgcgtccgatgttttgtgacaaattaacatattatcaaacagattcacattcttgtggtgtctattagcaaataccatacttctcgagtgttctgcaataaattttgtcataaattaaccagttgtcgagactcgccttaattatcgaccgaatgccggataaatcctatttttttgtcaaatttcgatttcaataaaatctattgtttgcaatatgatttctcaaaaatcctccgaatttttcaccttttttagaggttcaaaattttcacttggaatccactttcgtctatggcgtcgaaattaaaccttgaaattccatgaatttattttatcagttttcattgaaaatgtgtgcttactaccatcggatgaaatcatgtgacgtttcggatagtgaaaatggcttacacatagtattttagctctcagaagcatcagataaacctaactagagggagtaaagggcttaccttggctccgggctgggctgcagcatcaacaccaacaaagacgccatctgatgctttgtccaaagaggatcgagatgcaaaggtccggttcaagctggcacagatggtggagctggcggcttctactgcttcaaggccgatggctagtcatccccggttgcagttggcggcgaggacgcagctggaaacttcgtcaggttctcgtttttcagttttgtagggtgtttctgaagatgaagatcatttacacttggagccggctacgaagccttggagtggtcctcttcctgcgcctcgtcgatcgccgccaagaacgattggaggtattatcaaagcagcgattcagggtaaagtttttttgtcgtttccttctacaattcagagtaatagatgttctccggtagtctcttccgttccggcgagatctcggtctcctccggcggtgagtccggttcctcgatccgatttggatgcgtttccaaaactttcgggtgattcatctatttcgaattgtgaggttttggatgagtttttgccgcaattgccacataggcccagtattccttttaggcccacacctggtcttgtctctctattcgcaaaaacggggacagtgcgccagaaggttaggtttacggatcgatctgtgccgcctccttcgtacgccgctgtagttcgtcgttcaatggagagaaagaaccagcgtcctgttcatggagggggaggacaaggcagctttgctgctcgtgcaaactttcatccaggtcatggcgagggaggttttcaaggtgctcgaggccggtttggcagaaatcgctttggagctcggaattttggtggaggccggcaggggcaaggtggaagaggttggaacggcaatggtgggcaaccaaatgctggttcccatggcggaggagatggctggtttggacaggaaaaatttagaaataccgaaggtggttttggtctgcaagctaggccaatttttgggcataatcctgggctaaggtttgggcaatctccaacctttagctttggattgcagccggtcccgttgccgtttggtcagtttcctccggtgccggctggtggtggcgacgcatctctattggctgccggcagtggcttggcacaatttggaggagcggctgcacagtttggtggcgggatgattgcgggtggtgttgcgcagggatcgacagcagctcaacatggtgccgggttgacgggcgccggtgcacagactagtagcaactctggaggcaatggttctgtactggctgggattgctccttttggtgataatgtgcatcttcctggcggggtagctggtgatcggcatttgaccgctgtaggagaatctggtgcctcggctggagtggttgcagtatagacgatggttgggacttcacaaccaaccgttacgccatctactcaagagaatgcaggtagaggtttaattatgggggacaagagctctggtaaagcaaaggtggataatcagctgagtgtgcatgtaggtggcaaaggtattaacaagaatccatattgttatagatgctatactaaaggccatacgttgcaggaatgtacatctaaattttactgtgaggtttgtgaaagtgaggaccatataggatccaggtgtcctatttttaggtctaataataaaccctcagctgagttgtgtgggtatgcagtggatggtcttggtttttttcatatccctctttcagctggccagagaataaaacatgattctaaggctgccctagttaaagtaactagaggacaaatgacggtgcagaccgttgtttctgaattggagagattgattcctggaaattggaagtgggtggtggaagataatggagataacacttttcgtactatttttccttctgctgcggaactgaaacgcatggtagaatggggaatagtacatactaaggttagtgatgcagaaatgaagataattgaaaggggagttagtaatgaggtgaaatatgtgttgccaaaggtatgggttcaatgcaaaggcttaccttctgagttaagggagtttttaattatttgggcggttggttcaatgttaggtattacaaaaatggttgatatgaattttactagaagatatgacattgctcgtttacaagttctggttttagatccctctcttatccctgatgtggtggatgtggttattggggataatttgtatgagctgtgttttaaggtggagccagaaaatgggcttgatgtgcctgaacccatggacatggataatagtggtgatagagaagatggtaaaaatatggatgggagtgatgtgcaagataagggtaagggatcagatggaagtaattttaaggatggttccctactgcaaggtggtggccagtttagtggttctgtttcaggaaaaggaacgtcttctgagccatctactcaggttttgtcacctattattaaaggattctcaggttttgtcacctattattaaaggattgacagtatctgatgaggagtttgatgggcttgtggaggaatctgttggggcaggatcagttaagtctcatgaaagtctagctgttaagttagcggcagtacctgacacgattctctcccctactagacaaagcaagagaagagcaagtgatagtgatcaactcactttgcagagggctgaaaagattaaagctgggaggaatttggaggttcagaatgttaaaggtaatttgcattttaatgattccttttttacatttgtcagataaagttatttcgtcctctctttctaaactgggttttatcgatgcaaacaatgatagtaattttgtgaatgctattaaggatataaggagtttggaagaagctaggttaagtgattgtattagtttgaaagacaagcataattctactgtttttcctgaaaatgaattgaccgacgatcagttggaggataattcagttttggaaaaactttgtagtgaaatcatggaggaggtaatggatacgggtggtgattatgattataatttgtatatcacctctgattctatgatatctccttcgataaaaaagagaagtgacaagaaagttaggtgtaagaaataattttacaatagtcttaatgaaaggagtttttttggaacagtgatgggttcaaggacccaaattatttctgatcttacaaaggaacaacaactagatttcattgctttatcggagactgttaagagagattttacatctagtgcccttaaaaatctttgtggcgggaaagattttttgtggcattgtaaacctcccagggggtgttctggtggtatgttattagggattaatttacaaacttttgatattggttcaattgatgagggcgatttttatattaagtttcatctttgtaacaaaattgagaagtttaaatgggctttagtcttggtgtatggacctgcacaaaatgatttaaaggaacattttctttctggattagttcatatgtgtagccatgaaaccttaccaattattgttggtggtgatttcaatattttacgaagcactatggaaaagaataatgacaattttgataatagatggccttttctttttaatgctatcatagacggtcttagcctcaaagaactctcaatgtctggaaagaattatacttgggctaataatctttcagtacctacttatgagaagttagacagagtattaatgtcgacggagtgggaacaaaaattcccactttccacgatatttgctcttaatcgagatatttctgatcatactcctctactcctgaatacaaactcatcttctgtatgtaatagtcaatataactttaaatttgagttaggttggctgttaagggatggttttgttgatatggtaaaggaaatttggttaagtgttgatgaaggaaatacttctctagagaggtggcaagcaaagattcgcagactaagacaatttttaagaggttgggctaaacaaactagtggtacctataaaaaggagaagaaagccctgttagaaaaacttgatttacttgataaaaaagctgaatcaaccttgttaactcaggaagagcttaatgctaaacattatatgaggaataggttagcttgtttgcttagagaagaggaaattaaatggtatcagcgggctaagaccaaagatattttggaaggtgactcaaatactaagtattttcatttggtagcaaatggtaagcataggaaaacaagaatttatcaattacaagatggtgaccacatcataaatggtgatgcaaacttaaaagcacatattaccacatattataaaggtctatttggtccacctgatgagtcttctttaactttggatgaaagtcttataggtgatattccccaggtgtcttctctagaaaataatcgttagttgatgaatttactgagaaagaaattaaagatgcagtttttcagatggaacataataaagctccgggtccggatggatttccggttgagttttaccaagtgttctgggacgtaattaaaacagacctggttgagttatttaaagattttcatagtggaagcttaaatctttactctcttaactttggtactattattttgctgcctaagtgcaaagaggctataaagattcaacaatataggcctatttgtttacttaatgtcagttttaaaatttttactaaagttgctacaaatagaatcactggggtagctcagaaagtaattagtcccacacagacagcttttatacctgggaggaatattatggagggggttgtcattcttcatgaaactattcatgagttgcatcggaaaaaaaatgagtggtgtcatttttaagattgattttgagaaagcttatgataaagttaaatggtcttttgttcaacaatccttgagaatgaagggcttttcccaaaaatggtgtgattggattgcttcttttatctaaggtggtcatgtgggcattaaagtgaatgatcaggtgggatcaaattttcaaacttacaagggtttaaggcaaggggatccattatctccaattctttttaatatagttgttgatatgttaactatattaattaagagagcaaaagatgatggtcagagatctctggcttggtcccacatttagtggacgatggtttatctattttacaatatgctgatgatactattatttttctagagcatgatttagagaaatcaaaaaatatgaagctgttattaactgcgtttgaaaaactttctggccttaagataaattttcataagagtgaattattttgctttggtcaagcaaaggagtgtcatgagcaatattcaaatatttttggatgtaagctaggtgattttactgttagatatctcggcattccaatgcattttagaaatcttagtaataaagattggataacaattgaagaaagaattgaaaaaaaactcagtagttggaagggtaaacatatgtctgttggtgggagattggttttgattaattctgttttgtcaagtctagctatgtttatgatatcgttttttgagattcctaaaggggttcttcaaaaaattgattattatagatcccgtttcttttggcaaggggatgaacataaaaaaaagtatagattgacaagatgggatattatttgtcaaccaaaagatcagggtggacttggagttcacaatttagaaatacaaaaccaatgtcttttaagtaaatggttatttaaattaataaatgagcaaggtgtgtggcaagatttactgaaacaaaaatatcttactggtaaatcaattactcaggttgagaggaaacaaggggattcccatttttggtcaggtctgatgaaggttaagaattcctttttaaatatgggttcctggattattaataatggtgaacaagtaagattctgggaggataagtggctagggaactattctttgaaggaaaagtacccctcgttgttttctatagttagaaggaaaaatgcctcaattgctaatgttatgggttctgttccgcttaatgtttcttttagaagagctttagttggtcagaatctaattagatggcataatttgtgtgcttccattgtgcatattaacttaacatacgaggatgacatttttagatggaattttcatcaaaatggccaattttctgttcgatctatgtacttagctttaattaataatggttacatagaaagaaataaaattatttggaaacttaaaatgcctcttaagattaagatttttatgtggtatctccttaaagggattgttttaactaaagataatttggctagaaggaattggaatggtagtttgagatgttgcttttgtatgaaaaatgaatcaattcaccatctattctttcagtgccatttttctaaatttctttggagagctatacaattctcttttggactttatcctccacatagtatatctcatatgtttgggaattggcttgtgggtgttagtaaaaaaatcaaaaaacttattcttgttggagcttccgctatatgttgggctctttggcttagtagaaatgatatggtttttgataaaacaccatcaaaatcctatttgcaggtgcttttcagggcaacgtattggcttcggggttgggctcagttgcaaaggcatgatgaagatatcaagctaataaatgatgaatgtcgtaaacttgagacgacaattatgcatctatttgccaacttcgggtggaggttctctattagaattcagtagttaggggatctttttcttttgttggtgtctattagtttgcttagctttgtttctgctatcgtgaactttctgtgtgagttccataataattggctgtaactcttagagtaaaggccggaatgttacattccattatctaaaaaaaactagagggagtaactgggaagatcaacagcataccgtacgcttaattactctacacgcatgtaacccagctggtatatagcttttccacatttccagttactcgattggaatgcaatgcttttgagtaaaggccggatattatatttcattatctaaaaaaaatttaattatgtctattcttaagctatgattgagcttgtcttacgggaatattttttcccatgaatagctaaatgattttatgataactatttatgtacgagtacaaataaaataaattaactattataagattttaaaaatagattaaaaaacaatattactaagtcgtatatatttttatgcgaaaatcacatcgtttaattaggagtcggaaaacacatgccatagtttttataattccatcattatatacagagatgcaaaattatatgaatcaaatggtcaatttttcgtctacggctattaaaaacctcgaacgaaagtcaaatcaagaaagaatggggatttatcattggttagaggatggggtgtcgattgaccgtgatggctgtccacaacagattgtcgtatatgtgcatgcttgcatactcgggcgtacggtacgggtaagctaaggctgcgtggaatcacgctgtacacacatacgtagtatagagtaggatttggatggccattttcatgaacaagtagagagatatagatagatgtggcgaccattaattcattccttctgtggctttagcagtgtgcacggatcgcccttataagtgacactactttaaaaaatatatttttcatagcaccactcttttatttttttttcctcaagtttaataaacacacgcttgtaaagataattaagagggattccgatcaccaactgccagtgaaaattagttttcgttggttgtcgcttaagatatctgcttgcaaaaatagaggtatttttacaaacggttcctttaagcgacaaatttcgctagtagcggctaaggagtaccaactgaaaaaaaaagcaaaaaaaaaataagttctctatattaaaatttccactgatcttatatccccttctctcactcagactctccctcctagctcttccccccacctctccctctccctcccccacccctggctctcctcctctcggcaaccacggcaggctagcaacggctgacgcggagcacctgatgcagacttggcacctgacgtggggctgcattggctttcgatctccggcgaaggggtaagtcctacgttcggccggccctaccaattgtatcgactacattggtattgttcaaagctacatcgcttcgacctcttggatcgctctggtttggttggtatacttgcatacatatttatcatatatcttagtaatctagttagcatcttaatttacttttgtatcagctgagattcgttttagggtttatgctgtatcggctaaattatcttgctaaattatattagctaagatatcaccaccctaaaaattagtcaaaatagactttatacttctttgcatactttgcgatgcatcatccatcgccaaagttgggcagagcaaggcgatcagtgtgtgttgggtcgtctcctatatatacagctaggcaggtgattgacaaatagctaatccttgttacatcgagaaagccagtccaattaagggggaaaaacacgaatattagagaaggatgtaatatcaaataaataaaatggatgaggcttcgaaaccaggctagctagcccaccatcttattaattaagctagccggaagacccctgcgtgtttctcaattaaggagagaaaaatgctacttcttcagttaactgtttttcctactctcttgcaaatttagtttataagccaactatttttctttttctctgttttctccgtgatcagagaatcattcaatcattcattttcgatgtgcatgttccattgttcctagatcttgatccacggatgaatgatccatactgttactgatcagtagggctttctgcatgtgtcgcgccctttcgaaccgtcgaaccgtccaattaatgtgctccaaggctgacaaatggtgtcttttgccgagctgcatagtctcgactggacacatatatattcatcagtatgttacatacatcattggattagtggtttcgggaatgtttttgcaaatacacatttcgccaaattctgatctgacgatccagcagcgcagatagatccacggatgcttccacaaaatattccattcctgcagtatatccagatctcaacaaaacgcaggtcgatcatcagtgtccactgaacaaaagcacatgccatgcatatacttgcttcatcgtaggcttagcagctcgctacagtgttgaccctacaatttttagaatcatgggttttcgcagcaacgttaattaagggcttcttggcagtagcagaggtagcaccgccgttgagtagaggtgataatagcattgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggcatgagacaacctgatcgtcagatctatactacacccggcggattcaaatccccaaacaggagtagggtattacctctcatcgagagggcctgaacctgtctaaatcctttgtctccacatccatccacttttaggtctcgtgcgctaccccgttttattattgccgaattcatgtttcgacagttggcgcgccaggtaggggttgcgtcgagtttcctatcaacaagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcgcccgcgagtccactccgccggcttgtcctcgccaccgccattgctgatagcaacaacgacttcaccgccggcttgcttccgtcgccgccgaccggtgtcatcgcctatacggttggtcggtcacaccaccgttcatgggcgtccatgtcttcaccgaccggctggccttcgccgccgccgactggtgtttccgcctgcacggctggcctattatgccgccgccgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactggtgtcctcgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatcctcaccgttggctcaccttcgctgccgtcgactggtgtttccgcctacacggctggcctattatgccgccgctgttgggcgtctacgtcctcaccgttggctcaccttcgctgccgtcgactggtgtttccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcttgccttcgtcgccgccgactggtgtcctcgcctgcacggctggcctatcatgccgccgttgttgggcgtccacgtcttcgccgaccggctggccttcgccgctgccgactggtgtttttgcctatacggttgacggacttcgccgctgttaatgggcttcatcatctacaccactggcttggttccactggcgccgactggtgtttttgtcaccattgatggactgcttcgttcccacattggctacttctgccatcaccaaggggaatattacaaagctaagtcgtcatttattttattctttatatgatatttttccttttcctctgcctcactacaccaattggtcttccattgagtagtgagtcgggggctacagatgttatatcatattttttataatattcatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaactccgatccgtgaaactttgttccattaatgaagaactcatgtcactcatatgcatgtttgggaagtgcttaggccgactcccagtgcttggtggctatgactagttgggcagagcgtttaaacgtaatgagtcatctgctccgggaaatcaaaattgacaagaggagaaatacatatttataaatattttaaaatacttgattttttctcgagtattatatttatat

SEQ ID NO: 59555 - DNA, 6757 bp, Oryza sativa
cataaaatcccccgaaatcaacccgaaacttactcccacaagagtcggcggttttctcttgtaattggatccgaccaatgtatgcactagcgttgggacgtatccaaggtgtattgagaggcgtatcgtcgagtatcctgaattaatttttttttcaaaaatccagaaaaatacggatacatataggatacgtatcggagcatatctgatacgtattcgtatccgctcacgtatttgacacggatttgcaccttccatgacatatccaggtaacgtaggtgatcgaagaagagcattaccaacaccccaacggcttgtggcaaggggatgaaatagaggtaactggactgctcatttctgtattctacgtacagatttttcatgtgatctggaccacaatttggtcagattttgaaaatttcgatcaaatcagacattggtgttttcctttttataaaaaaaaatccaaaagaatttcttgggtctactatcactgccttgtgcacgcccttaattaagctccagcggcgctcatactcatttggatatgttttcacaaatccatgcatattttaaagctaaataaaatagatctgggtgccatgacgaagtgttgtgattcacgtttgtggaatcttggtagatcttggtgccatgacgaatgagtgattaagcatatatgccgtgtgaatcgaaatgacgaaccgaaaaaagtaaaagaaaatgtggatagatagaccacgcacccagcttcctatcgagaaaatttgagatacggacaaggagttgtcgtcgtagcaaggtcaatcacaaacaactagtcagtccagcaactcagggcttcaatcaatcgttactatctccccgggaagataatacttgtacttttagacaaggatcaggttaaactttaaaatctttgattataaattatttttaaaatatttatttttcaaatatgattactacatgtataaattagtgttaacacttttatacatattataatagaaaataatggtcaaagttattttttagaccgtgcttttatctaaaacgacaagtattatcaacccggcgagagtatatatgtggaatcgattggcaaatgcaaatctgcagggatcaggttctggtggagtctttagtgtgactactacaatttaaacagtcacgttgagactactgacacagtcacattgagactactgaaacgattgagatcgtttaagcactgttcatgaaaaaaaaaaacaccaggcatctactatgggagatggcgctatgccgctataacacttaatctacacctaggaaaatgaatggatgagatcacatgcagtgattaacttacggtcttgtgattgcattcgatctcaatccaatctgcagctaccagtacatcctactacgcaagtttcaaaatgattgaaaaacgagaggagtcacaggtaggtgtgttttaagaggaggaaaagagaaatgtagagaaggtactgaaaacaatatgatttattagcacatgattaattaactgttaattattttaaatttaaaataattaatatggttttaaagtaactcttttatatatatatatatatatatatatatatatatatttaaaaaaatactatttaatcgttaaaaaatgtacacgcaaaaaccgaggatcttttcactactacataacaccacatcaatgccagttgggaaccccacacaggaaccggcacaaaagaggcggcactgatgtgaatactcaaagatgccggtttaggtcccaagaatccaaaaaaaaaaaagggctcaatgcatcggctcgaacattgagtcgttccccttcaccccgagacccgtcaccccgagagatccaaagcaaatcacagatccctcaacaatttcatagaaacaatcaccgttgccgccacgtcgccggatccgtcgcgggagccaccgccgccactgctccgcccgccgatgccgatcccagatgcggctccgcccgccgttgccaccccagccacctcggctcgatttgggtgtcggttttttaattaaccgacacctataacatattataggtgctgatttttttaaaaaaccgacacaatatataataggtgtcggtttttattataattgcttaaaggtgtcagtttttttgcgatttcaacccgcggaggtaggaaaatgcctatatgccggttttaacactatcgacacctatagtggcgacacctatttaatgttttgtagtagtgtttcttgtctatcgacagtctcaaacaagtggtgaagaaaatgttacagaagtggcagggtgattataccggtcaaggtttaaatcacgtacacccaacatcctaattatttttatattttaacacagtattcaaaatgttactttgagcaaatttcacaaaacttcatatattttaaccaaactattgcaaaactatagatttaaagtgatacatcacaaaattacatatacaaatgtatgggagagtatcgtaaaattacagatctagtaacaaagcaattacaaaactacatgtttattatcaactaaatcacaaaacttaaatgtttataactcaaacataatattaatattagtgctaaggatttaaacatactagtacgaagatagatagatagtacgtataagagtatagtgtacattatgctgcatgtttcatgcaattgaaagaagagatgattgggaaacaccattaatagggtggtaaaattatgagtccacgactccacctactattaggaaacaacttatcaggtttaaatcttggcgtctataaatattatgcacgtgcgagtgcgttttcaatggaaatttagtgaagtcaaaaatttatcgctggtcttcgtctcgttaagagcattgtgtgtgtctgattgcggtgtgcgtgtgtctcccgtgcggtgttggcgcgcccccgtcccccctatccttttgggacctttgaccgtttcccgagtttcaacgtggcatccggtctacccatggtcccgcccgcctggtctccctcgcggtccttgtttcctcggcccgcccaagcacccgtcggccgtcgctgccttctcggccttccccgtggcgtgggcggccgccgcccttggccccacacatctcccaccaaaccacccaccccaacgccacctacaatctagctcctcgctccgatcgaccatccatggggaccatcaccgccgccaaagcagccgcggcggcggccgtcttccagtctccgtgctcccctgcgcctgcggccagcttccccgcccgcagcgtccggccggatcgccgccgcgccgtctcgctctcagtctcaggtaatgaccgtttgatttaacgccttattattattgatgatgaaagcagagaccatatgacccacttgtcgtcgtggcatcaacatgatgggataatggcaaactgtgactcactcaagcagtgctatgactatgtctatgttggcaattctctgaaaatgtaggtgtgttcgtgataattctattaagtttttgtgttgtggaaaacgcaccgattatacggccgttaatacgttgacagtgattagtccgtcacgtttttgcaaaacggtcttcactaatcgtttcacaacgaaaaaaatctcgtcattgccgattaatcttcccgtttgtgtctaatcggccgcataattggcctgatcaaaaggctgaaccaacccacaacgactaccctatcccatttgttgttttctctagtaggagtataaagctagctataccagtacgtgaattcctctagagtatctgatgccgctgcaacctggtctaggatgtgcacgcctaaagtttctctctgaagaacataagataatccatgcaaaatatttttccaatgcactaatactagacagatttctatatctgtataatagctctcatggttttcaccttttcctaattgtagcatattatatatgtagtgaatttccaatatatgagtctacaatatgcataacaatatttacatattcacaaccgttaaatttccgtcaaattccgattaatcgtccgtattccgattaatcgtttggcggtacccactctgtccaacatccgcattccgtcttccacaacactagttttgattatgttttcttgtaaggtttttttctatgaaattttctaggtttctcttgtgatgaaacttatattttgtatcattggtgatcattaccattaaaaagatgtgaacattagagaatgacctaatatcaaataattagtaattagaaggggtgaggcttcgaacccaggtcgtttagcccaccaccttgtggagctagccgaaagacccccgggtgtttctcaatgatcattaccattcaacatcatggttcaaaattttcgaatttggattttcccacgcccaacagggattacttttggttgaaaaattttagtcgcttgaatttagcgggaatttgttcaaagtcagcaaaaatctgttcgaattttaaaatacagcactgaagtattttgccgagtcaaacactgtccaaatgcccacatgttcatgatacgacattatttttagttttaccttttgttctttttatcttttaccaacttcgacaacttcctttttgcttgtcaatactagttattcactcttacgaatatgaaggaaaagttgaatggtttgacatgccacaaatttgcttttaaatgtttaaccaatcgtaacttcctatttctcgtagaacttggctacattgcagttagcttaatttaatttcgtttaggttcggttggtgcttaaagtggagttgcgtgggaaatgtgaactggtaatggtagttcacatatactatatatatctgttattagacagcataaacttatcttgttgttttgtattttggaatatgtaatgcttaagatttatatttatactgtttcagttaatcttcttttgcgaaccaaaaaaaaaaagtgttactcacctaaactatgccgtttgcaggtgtaagaactcatgttgcagctgttgaacaagcagtggtacaagatgctattgcacagtcagaggctccagttgttgttgttacaggtgcttccaggggaattgggaaagccattgcattggcttttggaaaagccggctgcaaggttaacacttagtaattgatttatgcttatacatctatagaaattttatcaaaagggctgatgcttatctgagccactgcaactggcttatctgagttacagcaggctggaaacttaaatggttaatttatatattcaataggatcataggagtatcccaaatgactgttattgacaatctgaatagatgaattgatgaaaactttagttgcatgctaccctgtgaaagaaatttaccttttatttaccttcaagtttcatgattgtgaatcatgtaggtgcatctagaacaatacaaagaggattgtatctggaaaattgggttcaaatatttatctgttgcctagttgttatgctgaactagaataatttccctgagtataacacaagttttacaatcaaaggggaaaaaaaaactctacttacctttcaggtcttagtgaattatgctcggtcttcaacagatgctgaagaagtctgcaaagaggtaaagctttgtgttgactagttactttgttcatattttttttaaagcagcataacgtagatgatttgtaatacgagaataccccgaagcattaatttaaactaaaactgcgttatgttcttatctaaagtaaagagtaaatttcacaaaaccataaataatcaaaggaaaatacaattgaatgttgtttccggggtgcatgtgttttgaaaattttgttctgttgttctgccttaaatagatggaagaagatactgaggtttccgtattttacagattgaaggatttggtggtcaggcaattaccttccgaggagatgtttctaatgaagccgatgtggattctatgattaaagcagtaagcatagtccattcgtgatactctgtgatactggttttctctcttcaaatttctgaccacgattaatcatccaggctgttgatacatggggtacaattgatgtacttgtaaacaatgcaggtactcctagtggaatattatatcttttttttacacaaaaaaaacaatttattttacttttaagttttaaccctgaccattctgatattcaggaatcacacgggatacattgttgctgagaatgaagaaatctcagtggcaagatgtagttgatcttaatcttacgggcgtattcctttgcacacaggtactaatcacacattttctcatattttgtacttaaaatgctttatgcatcatactgcaaatgttttttttgcaggctgcgacaaaagtaatgatgaagaagaaaaaggtactccatatagttcatttctttaccagattgatatttgattgttttttaatatttttatattttttttcacgctgttctgtactgaacttcaatacggcaaatttgcaatatagggaagagttatcaacatagcatcagttgttggccttactggcaatcttggccaagttaattatgctgctgccaaggctgcagttattgggttaacaaaaacaactgctagggaatttgcaagcagaaatattacagtgagcacattttctttcattttattgtttcaaatcattcatctggtaatcaaattg

SEQ ID NO: 59556 - DNA, 16878 bp, Oryza sativa
gggggccttaggattgtattcatatagctcaatttcataggaaaataagcaagaggttcaggccccatttgaattgtaggataaatagaggaaaaacaaaggaattgaaatcctacactatttatacctttgatttgtaggaatgagaaaaggaaaaacgtaggaaactttccttttcctacgattctagaggaaaaacgtaggaaatttaacatccactccaacttcttggaaaacttcccttgagtctatctctctcatctgaatcctgcgtttttcatgtggtccaatcaaacggtcattcctgtgtttttcctgtgttttgcaatcctctgttttatacttacattcttatcagaatcctatatttttcctattcctccgttttttcaatcctacgattcgaaggggccctctacctcttggaaactatcctttgctttatttgtttcctatggtgctattaaagggaccctcttcatattccatgtgttttccattcctgtaggattaggagaacatgccatttcaattcctacgtttttcctattcctgcgtttttcctatcctgtgtttcaaaggagcctttagaggatttcctttctataggaatttttcctatatagcccttcgatcagggcccctttgatttataggaaaaatgtaggaattttggaggatttcaatcctatggaaaaaaaaaatcctatgaaggcatttgaaacaaaggattgaatcctatcgaatcctttaaaattcctatggaatgggtaatcctatgcatattttggaggaaagttagcaagagatctaacctcttggaacatttcctctgagtctctctctctctctctctctcatctgattcctgcgtttttcctgtgatccaatcaaacggccattcctgtgtttttcctgcgttttgcaatcctctgttttgcaattgtattcctgtcagaatcctgtgtttttcctattcctctgttttttcattcctacgattcaatggggccctgaatcaaaggaatggatcttatggaatcctatgaaattcctatgaattgcctaatgccatgcaagttttggaggaattctaacatgaggtaaaacctcttggaaactttcctttgagtctttatctctcctctaattcctgcgtttttcctgcggtccaatcaaacgaccattcctgtgtttttcctatgttttgcaatagtctgttttatacttacattcctatcaaaatcctgcgtttttcctattcctatattttctcattcctgcgattcaaaggggccctcaaaagtggagctatctttcttccatcttctcccaccacatgcaaacgtcactgcacgcaaatatctccatatgctccgcgtgaataaccaccggatccaatattgtatttttctattagtcttctattctaattataaacctgatacattacaaagtacgtatgttactagtcttacgaaaataagctaaggtttacgaaaacaaaaccaaattagtaagtaaatggacacgtctataacatacactatttctcctgacagttcaaattgactcagctttccgacaatatcgatttgtcaaaaatatcctacacctacatgcactccccaaaatggcattgccctatagcagccaaacgatcgaggtcctcaaaagcaatatacgcaaatttatgtcatccaattaagattataagagtatagcgcaactacacaagcagcaagtcaaacaaactacaactatatcactataagttgttaaatttatgtccatcatttattttaagttgttaagctggtcattcggcctccacacctctagtgaagtggatctacaaggcggtcttcttcctaggaatcggtggcggatcttcgggggaagttttgttttatttctttgtccttgggtgctctaacctccactacagatgccccattttgggtatgctccttagctatatctttgcagcttgccatggccggtttcatcatctccattgccgtcgactttggtcggatcgccgtctttgtggaagaagcaaggaaaggacccgattgtttttttctactctttagaagtccttttctgcaaatttcaatgtatttgtcaatttgccccagtctgaggggcctttctgtaaactggttgtactcccagttctctattaataaatgtatacgaggctttaaaaaaaacatttgacaccgccggagaaagtcaaccctctagaaggccatgtaggcagcaggcagcttagccactgtcaacacttaattaattactcctcctcctagatgcacgtctacctgcaaaatcttgtgcctttttcaacaagcaaactgtacgtatctttgaacccatgtggcccgagagatgcagcggatcgaaggactcacctgtgaattttgtgaatatgcatgtgtgacgcagtgatgttgcggcgttctagaaggcgagcggtatcttaattgatgtcatctctttttttttctcctaaatggaaaacaacttggtacttcttctagaagcggcaactaatgatggagactcccaggaccttgggacgaaagttgcagtaacgtgtccaaagttatactaggtatttccctccggtacaagattccgtaaaaaaaaatcgacaatcaataatttgttaaatgattagtttaagaacaaaaaatatacatttgttttgagaaacactaataaatatcatataaacacattagattttacaggcttgtttataatataaaaataaatctttagaatcttatctggagcgtcaaatattcatgattagagattttttttttcaactacagcttatataagccaaagacatattactgatataaaaaaaagtcacgataagacttttatgcatttattactatcatcagtctaaaaggcacgagtatgacggaaacggaaaaaaaaaggtctaatttgtctaatattaagctccaaaattcaaaactagctagccctaaacaagtagtagttccaaatgtattgtgtaacaatccttcttcccaagtagcaatagaaaaaaaaactgttgtgagaaatccataaacaagagagttccataaacaggagagttccaggtgtgaaatcccatgactactcatatcaaaattcagaggcaaggtgtctaatctctttctcattttcaaagacgtagggatctccatctttgctgagctactgtctcattctccgtaagtgcttctcctacaaactgctaaacggtactccctccgtcccacaataagtaattttaattttttgtttgcaacgtttgaccactcgtcttatttaattttttttgcaaatataaaaaacgaaaagttatacttaaaagtactgtagataataaagtaagtcacatataaaataaataataatttcaaaaaaatttaaataagacgagtggtcaaacgttgcaagcaaaatcttaaaatcccttatattttaggacggagggagtattattttgcgcaaaatattttatatagaagtttattaaaaaataaaaatttcaaatttgtacttcatagttaatacttattttttttaaattaatacttaattaatcaagtgctaattgcatgcttcgcttttcataccacttattagagtaaacctttcgcacttacaaatgcagctttaggcggagttcgattggacggttgaactaatgccacatgaaacaaggtaagccattaaaacataattaattaagtagtaattactaaaaacttggaaaaataaacttatttgatttattaaagaaacttccatataaaaatatttgcataacatactgttggcggtttacgaaacgtgttcacgaaaagtgagcagcatgtccaactgaagtccgtctcagataaggtatctgtccttcccctcccccctcgcagtcgcgggccccgttcgctctctctttttgtaaagactcggtactagcagtgttcacacaactgaccaactgaccgatacgatcgagaaagtgagaagtcctgggacatttgcatgtaccggtgcaatttccagaaggaaaagaagttaattaagcttaattagctaattagctaggagtacaaatgctgtgctccaagacgaccttcccaagcaattaagccttggttaccttggtcagcaagaacacacatcttatcgatccaccagggcattcaaacccgtcggctatcgatccattccttcttgcagctgcagatgatgtgtgcccgtgcgtgttttgcattctgcctacctcgtggaaacttcgaatgatctcacgcgcatgctgccaaaaaaaaaaggaaagaaaaaaaaataaagacatcgtgactgattagaagttggtttaatttaactaactgagaagacgacggacacaagtcatactcatattatcagagctagcgtatatatacgttgacaggtgtcacaggtcactgattcgtggaaacatctcacttattgatgtcttcgtatgcatgagaattcagttaattgatcttgcccaataattcatgggttcatcgctgccaattaattaaagctactcttcgtccatctcaaaatgtggtagtactaatttctaaacgaatatgaatatagctaaaaaaaagttaatgattatattttgagatgaaggatgtattagattttccttcatattagttacgcgaaatctggaaactctcaatcatatcttgcttgtggggataatctgggtgatgatcgaatataaatataatatagcaagaagatgaagatgcatgcatgcgactcaagcctttttttttctgaatgaattagttggtcataaattatatgattatgtgataatatttttaagtgtataaacgaataaattctattaaaaactttaaattttgttctataaggtattttgagaaactttttatatagaaagttactaagtttttaaaaaatgtggtactgtttaaaatgttagaaagtgtgctcataataatgtgtactaggtgattcccggcccataatttgctgcaggaattattaagtaatttttaatattttttaataaatgagctgagagtaaaaaaatattagttattaaaaaccaatcaaactggttagccaaactatgtttgtagagaaatggatttcatagattttatggatgaaatataatattctacgttttgattatatagatgattgtattataaaaaaagatggatatgtatcttgaaaatgttgtgaaaataatgtgaagagtgatgattagatatgcttacatattgatttgtcgaattcaataaatggtagatgatgctgcatgcttacgtaaactttgtatgtaattgttactagtggatgatgaggtggtatatttacatattaagtttagacctagtgggtgggttgtaaatatatttttatttttatagattccgtgataggtaaagaacgggcatatttccaagctttaagcgacgggttcagtgtaaagataacataatcacgatgatttaattacttaaatggccacctttatgggatattttgtgaatcgtagaacgatcaccttttccgtgacgaagtagtactgtgggttaggcataaaggacagtacttgtactacgtttttaattatatcacaatctagcttaggctgctaatctcaattaaactcattttctaaagagggccaaattaaggtgcagactgttatgattttgttgattttagatatgcttttgatccacgcacgtgatttatcatcgatttcacaggtcacgggcgtagctcacgtgcaaacggataggcggaaaactatacaaactcaacgttcaatcgaatgttcggccggttaatttggctctcaattggtaagcctcgcgtgaccgttgatcacacaaaaggaaacaaaactatatttactccctccgtcacgaatttgtgttttccagtatccaacatttgatcgtttattattttcttttatatataattagtatttttttcttatataaatagttttttatgtgtgacttattttttaaactttttcataaatttttcaaataaaacagacggttaaacgttggaaaacccaactttttaaaattcatagaagctggcaaccaaccagctgcttctcagaattttaaactccttaaacagtcccatagacacatgagaacccacgtttcattaacatgtagtggtaaatagttaaatatcaaatataaaagtgtggtaaatagttaaatgccctaatttttttttccacaggaaattttgtgcgtgtacgcagtggtacgcgtccgcaggaagtacatgccccgatccgcaagaattaccagctggcgagctatatactactcctaggagtgacgtacgtgcattgcttgaaaattgttttgaaaaataagctccatctagattgatctctaatgatcttgtcccctaagttaagcgttgacttgccatcaggctaaaattattgaccgatctctctcgtcatatagtaagataataagatatcgatgtacccaagctaggtggcaggtaattaaatactaggagtatctctaatggtttggttaattaaccttagccaaaaggcccaaaaccgttagaaagatttttgcatgcgtgagttgatgcgtgtcctagcatggacacaattagttaactacactaatgtactgccgtcactgatgactgtattaccataccggcacagggtttagttcatctgtgggaccagtagcacgtggttttcgtggacttgtcgatcgtagtactactgtgcagtttgtgctttgcttggttggctaatttcggttgcaaggggaaggttccccccccccccccctttttttaatatctggtcaattaagtaatcaggtctagagcttgaccaatatctactgaatgatcaggtatctgagaaaatattattcaaaggcttgagaaagatcgaggtatctgagaataacagtattcaaatagatgaaaatgatgcagaagaacgtgcatcatgttgtgcttgcatcaaatgattcctttgtaacaagaaaatcgacagcatatatggggttaacgaccgaattcatggttcgtaagaataccatcaattttatcggaaaaaaaaagaataccatctgtatgtggtaatgccgtaacggtaacatccagcttcccacgcccacgttagtagtatggagtatatcaaaacttataatcctataaaagaacaaattaattagggaaaataaagcaagtaaccctgctttgtcattattttccctgaaatatgcgatgccgaatcaaaatatttaaacagaggcgtggaggaggaagagagatgggagttcatttcgaaggttagtgcgccctcgaagcaaattcgtgcctggttcgaaatgacgaaagtgacaagtctggccgtaattcgttggcagcaagctatataggagtatgaattattcaccggtgaaaagagcttaatgaacttttcgtttcaagatcgaagtagccagaagtctccggaaattaatgtcaaaatttattccatggactatagtctgttgatttcaacacgcgatttcagcggaaaaatatacgcagtccaccttgaaactttgttcaaagataattaattactccctccgtactcgtaaagaaagtcatttaggacaatgtttaagtcaaaccttgagaatataaatcataaataactcttaagttgttgagtttgaaaatataaaaaatatatgaatagatttatcttgaaaaatactttcatatttcaataaatatttttatagaaacaagaagtcaaaattgtgttttggagaccgtgtcactgtacgaaacgactttctttatgagtagggagagagtaattaagagcggctaatcctgcataacagctagatagagtacgtattaaaatactgacagtttcaatcgatacaatatttcgatcagtccagttagctatacctgtttgggtctgtcctaaaataaatgcagtcgtcgaaatccgtgttcaacgtttgatcgtccgtcttattttttaaaaaaaatagtcacacataaagtactattcatgttttatcatctaataacaataaaaataataatcataaaaaaatttcaaataagacgaacggtcaaacgttgaagatgaatagtgtaaaactgcacttattttgagacggagttagtatatccgaaaatgcatgtactcgcagaggcagagctagatccaccggaacttatttgttagtaaaatttttacaatatttgccctaaacatattgcaattttttttagactagttacatacctgcacttctttggttccaaaataaataaacaaacccagtatattatcattttagattcgtttattttaaaatggataaaatacgttgtaatagatcaaacccacttattagggagggatgatagttattttttcgcaaggaacacgctacatttgttaagaggaggatgataagatgatgactctgcttttaaaattgtagacaagacatcgagataaggccggcccatgcaaccctgcttgtccctgtgcattattaggctgtgtttgctggaatgggttggcaaccatctcctgcgcacgcgctattttttcaaaaaaaaaagcatcgatatgattttttaagcaactttcgtataggatttttttttaaaaaaaacgcatcgtttaacagtttggaacgaggcggagggtgttgggaaatagaattagagcaggtacaataacaagctattagtcagctataagtatattttaataagataaacgatgagagagaagagtagagggctacagatctgtagccagctgcggcacagactccaagacgtaatgtatgtatgacatgtgagaccatatattaatagtatagtaagtaactattgtatgaattggctattagattggttatagatgaattagagctagtagtgaggtatactattaaacttgctcttagcgtgtgtttggcagcccaggttcccatcactaactttacgcacagagaacggagcgatccattagcatgtgattaattaagtattagctatttttttaaaaaaatggattaatttgatttttttaaacaactttcatatagaaacttttttaaaaaacacatcatttaatagtttgaaaagcgtgcgcgcggaaaacgagtgagaagggttgagaaagttgggggcgaacacaccctaaagtattgtactaagttgcctggatggctggaaggcagagctaaaatgtcttactgctaatccgtaactactaacatatactactagtatatttaacgataaaaaaaacacgtgttcaatgttcgcggcgaggaacggaatcagtcggtcgcagccgggcctctgctaaaaacagcatggagtacgtacacaaataaacgcgacgtcagcagtcaaccgggctgatcaattcatcgttccgatcgacaaacgaggaacaatcagacggacgaaccaacccgtcgagctagcgctccggcaacagtggcgcccgctgcttttttttttctttttttctttttgacaacagacgccagctgctgggatgatcgatgatgcccaaaacgtcgcggtcgatcgatcggtggcgagcaaaagcccagcgattgatcgtccaaattaatcggcggcgcgggttcgtgtgcgcgcgtgacgaattggcgatggcgcagccgtgcttgcgtgcgtgcgtgcatgaaaacgtgcggcgttgtgctcgtgcaggcaggccgatcatatctctgtctcgtagggatagggatgcaagcaggaagcaggacggataaacgggatttttttttacccgtttatctcactttcagtgtattttttcttttaaaatttatactaatataaatgataaactagcaaatgggttattacgtggattgtgggagttggctacttgcatccctacctggggggatggtataccaggtgcaattttgactgatcgtgtggacgtatacgtgcggaactatgtgggtgtgatgcacctgatcgacgatgcagattgcagaaggctacgttttgttgaccgatcccatcagctgcatgccacctgtgcacttttgttaattcctgtttttttttcctgtgtaaatattccgtccgctgtgttctttctcgctcgatatcgtatcggtcagtggagtttttttcgcagacaggtgagattgatcgatagatactagaaagacaaacatgcatgccagagaagcctagcgaacacaatatttgaccggtgtaaagcttattcctcgtttctccggtaaagctgttggtgttttgtctcgggctcacgacgaagagggacttacgtgtggggttacgcgctgacttgcagggaaagcgtaaaggcgtatgcatgcatgcatccagctcggtctactagctaggaaaagggttaaaggggtacgatcgattcatttccatgtagtattgtcatttgtcaaccagtacttcctccgtatatcccattttaaacgtagcggtaggtatttatgttcaacgtttggttgtcatcttatttaaaactttttataaaaaaataagccagacataaaatactatttatattttatcatctaatagaaaaaaaatattaatcatagaaatttttaaatgaaatggatggtaaaatgttggacacagaaatctacaactatactttaaaatggaacataggggtactatctttcagtaagttctaaaaaaaagtactatcttctgtagatcctggctagttaacatgttcggtagagagtttttcggtagcacgttttctaaactactactctctatgtttcacaatgtaagtcattctagcatttctcatatttatattgatgttaatgaatctggatatatatatatatatatatatatatatatatatatatatatatatatatatatatatatatatatatatcattaacatcaatatgaatgtgagaaatgctagattgacttatattgtgaaacataggaagtaaacaatatatacatttttttaaaaaaacttatataaaagtttggttttaaaaaattaacttaatttttaagtttgtaataattaatactcaattaattatgtactaataacttgtctcattttatatgcaacgaaaaatcccacttcaaactcacaaccgaacttagcctaagacatggtcatcgaatttctagctatgccttggaagttggaaaaatgcagcgagaaaaaaggtttagggtctctcaggttcataggttttctaaattacatgaataggaaatacacgagaataatatatgaatacacgtgcaaaacaaagaattgtaatatgaatcttttcttcgatgagctgaataaaagaggatggagtggatgtttttattcctatggaatgaatacattttgaaggatttatggaggattgacatagtgtttctatgtaaaatttcctttaaatcctatggaccgaatgcataaatagtgtttattccaaaggaattgagaatacctttaggaatccttcaaacataataaagcacacttgatatatgggacctacccacatgggcgtatatgtcataagcacacttgcctttaatgtacattctagagtgacatgtcacaaattgagtaagcaaaacaagacattagcaaaaaattttaaaatttcaacaaagtttagaaaaatgtgtcaataaaccaagaaaatgtctaaaaagcctgcttcattcgcacattcgatctcgcggggaatcttgtttaaaatgcaagattgtatatcaaattattacttcataaatatgatttgaatcatctcaaagagaaaaaaaacacatgcttttcatgcatgcatggtacgtaaaggtcatagtcggatactatttgtacttacacgtatatttaatagaagcatgtacattgtgctctgtattatactatgatatcctttgatacagtgatacacatgccctgttgagttttagcaaggtaattaacttgaccacatgaaacaactctccaatttataatttattaaaactatccaagaatctaagataaggttggacaatattaattctttacattttggacaagattaagttcaaacttttataattttgaatggcaataactttaaaaatgttttgattaaaggcagtactagaactttatcttataaaatactatagtaaaagtaaaaatatatttacttattgcacatattataatagaaaaacatgattaaaatatatcttggagataatgttattgtccaaaacattaagaaatatgaaaccggagaaaatgtatattaactaaatcaaatagataataaaaaatcaaccagtgtttgatctttattttggcaaacaaaacttaatcactgcaaaccgccatagatctctctatttgaacgtggaccaaataaacaactcaaggaaatggtcacaggagaacaaaacagtgaagtactcttacgtatgacacggaagcttccgatgatgccatgagaacacgtgaaaccgaatctccatggacaagacagcatggtggcatgccaaggctcaacgctcgctgtgccgttccaactcgatcgagtacgtaattagccacgcctaatcagttacttaggcgatgtacgtcaacccctcacgtgccgaccctctagaaggcctggcagaatcagagcggtaaacctatattattacaccttcgtcccccaaaaaaattatttataaatttttatgttcaatatttaattatttaaaaaaattatataaatcttaaaaaataagtaacatatagagtattatttaataacaattaaaatattaatcataagaaattttaaataaaacaaacagctaaatattggataaataatccacacaaataaatttttttttggaggatgttgtaaatgggggcttgactagtttggtccgacacgactagtaaaagcaaagcggccagccacgtctctcttctgcgtctcccaggtgttgtgtgtactacttctacgatcacgagcagcaagcaaagacaaggcgaggcgtgtgaaaagtgcttcaacgtgccagttttgatgtgacaaaaggggtttggctgctggttaattaataggaccagactgccatttgtcccctgagtaaggccgaatatattgggtgttttggttgtgtttgtgtaaatccgggcactacaatttgtcaatttccctgttatattacggaagcctgtctgtgtctgtgccgtccgctccacttcacacaactcatagatagtataagggccattttggattgatgccaaaatgtgccatgccaatttttttagtttgaatagtaaatatgatggtttagtttgaagccaaatgaatggtaatgcccatacttaatttggtataattctagaactttcttcaccataatataaaatttggcttccaattggtattaatctaaacacattacttagaattctaccctaccaaattattggtagtttcaaaacatgcctaggttttgtcactaccaatgttttggtatggccctaaaccaaacaagccctaagttcaaaaaaatatctaacctaaaatcaggatgagacataatttagtaagatgattatgtcccatactaattctatgttggaatttttggaacaaaggaggacaaacattccaataactcttcctttttaggatgactctgtaccgtgggaccgtgggagtgttgcattatcttgggaccgtggggggaaatttgcaccgatttttcgtttttagacattctttcgaggaatatccaattttgaggtttagaaccctagcaccttaaaagattttgagagttaagaaaaaaaaagattcaacacagaacatcaaaatgaggatccaatggattataactttatttatagtaagatatggtttctattttattaactattgcaaacatctcactatttgatgtgaacacttactacaaggattatttacttcttacataactatgttcacaaattgtgaggatatatatgccattctgatgtttggaagttctaaatttaaattagaattttgtggcgtttgaaattgtgaacttgaatatggatggaccgtatgcattagaaatatttatgctttagttattatgatgatgtcaaattagatgtaaatataaattatgtggtggaatagaagagaaaaggaaatagggggtaagaaatgaggattttagagttggaggaaatcttggttatcagaaaatggggacaaggacaaccctatttgacttttgggtgttctaaaataatggctattgctcaaaatgctctagggtacaacaaatggcctcatcttttttattatactgatgtttatcagccaaaatttgaatttttagccttaaatttgaagctgaattttgagttttttttcatcgaagtttacttttcagcctttacttttagattgctaagaacacgtatataaaaattttatttataaattacttttcgtttgcagatacgccgttgcgctaaaacgatggcttcaaaaataacttttttggccgtactattttccgtgagatactcggatgacgtgatgtacttgagtaaaacaaagatactaatccatcatctttttcagaaactctgtgtagtgtcacttttgtcaaatccgaaaaatgcattagcaagataaaagccatatatatatatatatatatacaatactctatacaagtactacctccgtctcataataagtacaactgtgaatatccatgcccaacgtttgaccgtccgttttatttgaaaaatttgtgaaaaaattaaaaatatttagtcacacataaaatactattcatattttatcatctaatagtaataaaaatactaatcataaaaaaaattcaaataagacgaacggttaaacgttgaatatgaatagggtaaaactgaacttattttaggagaagagaagtactataagggcaagttttataatagaggaggtggtcacatataattttatctaaatcatctacacattaatttagaggtaataaatacaatagattgcatctatttacactacacccaatatatttgctaccaatccacttctctctttctcttccatttcttgaaacttgtatggaggttaccccttgcatgaggggtggctgctcttctctctcttctctcctccacatcatcatttgagtctatatggcatcttggaattagtgataagatgattatagtacttgccctaagaaaaaggaaagaaaaagtatgtgctttcagactataccgcagaaggaggacccacctgtcagcccaaacagcagcacaggacaggagtaccaaccccaatcccagggatacgatgacagacacgccgctggccgcttgacctcgcccttctagaaaccccacacatgcttggtagccacggctgcatgcacaaacacacacatgttgcccgtgtacggtgctcgattcgtacttgtaccgaaccgagcaccagcaggctagtcttccacacatcccgcctccgcgcctcgctactctgacccgcgtcccccacctcctgcactcgcacaaacagaccacagcaacacagcgcgccgcctccccacccaccccaagttcccaacggtttcccaccccctacaaaaacccccacagccccactcgggaccaaacacaccacaccccgcgccgcgccgcgccttcacttgcaaaagcccggaagaaatcccggtgccgcgccgcgcagcgcagcgcgcagactgcgaggaatcggaatcacaacaatcacccacctcgagaagcgcacaacggagagggattagaattgatagctctcggcgaggaggttttggtggtggtgggagatggacgcggcgggggagatccagaaggtggcgagcatgcggctaggggggagcatgaggggggacagcgggtcgatgtggaggagaggggacgacgtgttctcgaggtcgtcgagggaggaggacgacgaggaggcgctgcggtgggcggcgctcgagaagctgcccacctacgaccgcgtgcgccgcgccccatccctgccgctcggtggcgacgacggcgccggggacggaggagggaagggcgtcgtggacgtgcacgggctcggcccgcgcgagcgccgcgcgctcctcgagcgcctcgtgcgcgtcgccgacgaggacaacgagaagttcctcctcaagctcaaggaccgcgtcgaccggtgcgtgcgttgccgccagttctcgtcttggcatggccgcgtttctctgctttgcgcccgctaggtgtttgatctaacgactttcgcgcttgcgctgtgcgacagggtggggatcgacatgccgacgatcgaggtgcggttcgagcacctggaggcggaggcggaggtccgcgtcggcaacagcggcctccccaccgtcctcaactccatcaccaacaccctcgaggaagccggcaacgcgctcggcattctgcccaaccggaagcagaccatgcccgtcctccacgacgtcagcggcatcatcaagccccgcaggtgaaacaccatcccccccccccccccaacacactcccacacccacatgttgttttcaccaaaaaaaaaaagaacatggattctcttgtcttctggagcaatttttatctctcgtgttggagactggattagttaaatccgggtcttttttttagaattcaatttcttc

SEQ ID NO: 59557 - DNA, 14855 bp, Oryza sativa
tactttttctatttgaatcatcatcttacatactatttaaatttaaatcacatcgaatgatataaacttatgtttttatgtttgtgtaaacttatgttgtttaagcaatcttacatattatttttacttaatattatagtaaactccacccggggttccatctttacatagagttcgtttgcccagttgacaagctgttgctcacttgcttgtcattacagtccaagcatctgtgcgaccaaaggttgatgtcatcggcgcaacaccgaagagcttaggaaggttctcaagcctaggaagggaggcgagctgtagtgattcgatctcagtttaataattcaacgtgcttgacagatttagataagttcaggacatattcggattaccccatcccccttataacacagattatccatactgtatgcagccagccagccacgataataggatccacttaagtacttgccagaattttctagttgacaaagccacaattggtagaggtgaatcttggaaatttaaagaagatgaacagcccaattatctttgaaaccgcacttgcccgattattccttacattacaaaagttgaacaacaaattattttttatggtgctgactaaatcttcgtaagaagatcaaccatggaagctcgaggttgatagagggcctcgagaggcaactcctttggcattgtaaggccagagcactccctcatgtcaaccagctcttccccaaccctttcccaatcaaaacactggatcaatgtcccaagggcaagtcctaccatttgcatccccaaattctctcctgggcaccgccgtctccccataccaaacgggatcaccatcttcccttcgttttttccatccgcaaacctgttaagatatattcttagtagttcataacaagttgtgaatgaattttagtaaatgtaaagaacatgatgaaacttgaaaagaacatttatatgtgatatatatatatatatatatagattaatatcaaactttaaaatttttaaatataaataatttctaaagtattgtcttagaaatatagatatcctacttcaataaaaaccataaatttctttatattttctatatatattagaatagaaaatagtgattaaatttgtttttagattatgttatttttaaaaaaaaccaacgagtattatcggagggggaaatagtacagtacctatctgggatgaaggcttctggttcatcccaaacctggggatccctgtgaatggcgaacgtgttcaccagcagcatcgtcccctgggggacgtggaacccggcgacgacgcagtcggcggacgactcgtgcggcgccagcagcggcaccggcgggtacagccggagcgtctccatcacgacgcaccggaggtagtgcagcttggggaggtcggccgcctccagtagccgcgccgccggctgccccacgcacgcgtcgatctcgccgcgagccctcgccatcgcgccggggttgttcagcagcagcgacatcgcccactccacggtcgccgccgacgtgtccgtcccggcttgcagggagccctggccggagagagagacgaagtagttaaagcaaggtgttcgtccggggataacgcgcggcggcggcggcggcggccggtactcacgatgcagagggagcggatgagctggtcggggcacgagtcggggtcctttctctgcagggagaggaggacgccgatcatggtccgccgcttcgccggcgcgtgatcgtcggagtcggcgtccatgtccttcctctggtcgtcgatcagcctctgcaagaacctcgtccggctgtcggacagctcccgcatccgccgcgtcatcctgccggcgtccagccagcgcgccggcgctggtaggaagtcccacaccgtcgacgcgccgctcagctccatcgtctccttcaccaccgacctgaaccaccgcgcctcctcgctcacctcgtcgtcgccgtcgccgtagaaggtcctgtcgcagatcatggccatcatgatgttcatgaacagctcgaacagccgcgacttgagctccacccgcgggggcgcccccgcggcggcggcggcccgccggtagagacggcgcgccatggcgcgcacctcgcgggcgttgacgccggcgaagtgctgcacccggtgcgcggagagcagctcggtgacggtgatgcggcggatgtggcgccagtacggaccgtagctggcggtgcccatggtggaccactcgtacgacaggatctccccggacggcagccgcggctggtcggcgaacgcgaggtcgtgcgggccgaggcactcctcggcagccggcgccgacgacacgacggcgacgcggcgggacccgaaccgcaggcccatcacggcggcggcgccatggcgagccgcgagccgcgccagggtgcggtgcagcggcctccggaacaggtgcaggtgccccaccaccggcagcgccacgggccccggcagcggcctcccgcctccccgccgccgccgccgcctccaccgccgcagcgccgcagcagccaccaccaccgccagcagcgcgacggcgacgctgccgaacatcgcgtcgacggccatgacctagctgatcgggcgcgcgggatcgatatggttggagtgcatgcactgcggtgtgtgcttcgtttgctcgcagggtgggtgcatgagtttatactgctgcaatggcgtaaaaaataaatgaagtcatccggcggcatgtgcatgtgccgcgccggtttgggcggcggcgacgagcggctgacgtcgccggcggtgggcgagccgtgcggggctctccggtgtccagacaccggctcacctcatcactgtcgatagggctagccaaggacacatcttgtccggtggaggcggtgacacgttgtccccaagtgattaattatttctttttttttagacacatgtgattaaatttgttgctgtgcaagggcattctatgactgatatagtgatggcattttgcttgcttcggtgccttaactggctgtttgctagttggagtatgatatgcgatttttttggggtataaaattggttcagtaggcctactgaatcaataatgttgggtgtattatttggcataatgttggctgttctgtgaaggtattgagcaaacgttatttgtccttaaattcaaaggttgataggagtagtagctgcttagagcatctttcagatcatggagtgctatatggatatggctatcccaagacacgccgtttttggcatggatatggtctttaaggtgcagtgacttaactttggagtagtttattacaaaatttttacagagcccaataaaattataatattactttttgagacaaacatacagatactgttttccatgtgtctaatctaaaacattttaaaacgtagataggataagtacatactgtgtgtttaagtccgaccaagtagtccataatggatctcgtgtgtttttttgcctactagctactcttagccaaatatagtcaagcactgaagaaacagagaaaagaaacacctgaacaattcagcatggatatccctgttattctgtcaagtttcagtgtcatgatatataatttttcttttaatttatggctggtgggctgccgttttcattcatttggagtagtgaattacatggataagaaagtaaaagggattgggccaagaaccacaagctgagcccagagtccgataacaacaggcctcgtacatcagtcacaaaggactaagggcatgtttagttggtgaaatgaaaattttgggtgtcacatcaaacgtttgaccggatgtctgaaggggttttcgaacatgaatgaaaaaactaatttcataactcgcctggaaaccgcgaaacgaatcttttgagcctaattaattcatcattagcacgtgtgtgttactatagcatttatggctaatcgtggactaattaggctcaaatgatctgtctcgcggtttacatgcaaactgtgcaattagtttttctttttatctatatttaatgtttcatacatgtgtccaaaaattcgatgtgatgtttttggaactaaacagcccctaagaaaaaaaagttcaagatggaatgccaccaaattccgcggatcttctccctccatattatttattaggctatataatccttccaacatcacatactatttattactatcatgtttgaaagtttgctctctcttcttacttaggctgtgttcgctagaacaagttaccatctggaatgtgatcatggaaaacagagcggtttattagcacgtgattaattaagttttttttaaaaagtgagattaatttgattttttaagcaactttggtatataaactttttgcaaaaaaacacaccatttagaaaaagcatgagcgtgaaaaacgagggagaggggttggaaaaggggcatccgaacacagccttagtagtccaccaagtgttcttacatatggcttttgagatgaaaagatgcacttattttcatttttttaacaaaaacaattccatgatttctaaagtgataccttatcatgccaattcgatcaactatccaaaagtttgatatagtattgtgtaattaattaaagctagagtaaaatgcactagcggtacttaaatttgtcatgaggtttcatttaggtacacgaacttgtaaaacacacatcgaggtccctaaacttagtttattgtatcatcctggtccaaagcgttgtttgatcgtggtcttatctacatggcatgccacgtggacgatgacatgatgtttttttttcatttccccttttctttttcctcatattcttttatcttcttcctccacaagagccacctcgagctcccccgcgtcgaagaggccgaagaagagaaaaatgaaagaggaagaagggaggaaaaaaagaaataatagtaataatgtgccatgtcgttgtctacatgtcatgccatgtaggcaagatcacgatcaaatgagactttagaccggaatgatacaataaaccaagtttagagacttcaatacacactttgcaagttcgtggacctagatgaaacctgcttaccagtttaagaaccgtcaatgtaatttactcttaaagctaataaaggagatgcatcagtgacgcacgaggttgatagaaggcttgcagaggcacctccttgggcatggtaagaccagatccctcggtcatgtctactagctcctctccaactctttcccactcaaagcactgaatcattgtcccaagggcaagacctaccatttgcatgcccaagttctctgcagggcatttgcacctccccatgccaaatgggattgccatcttcccttcacttcttccattctcaaatctatagaaacataatatgctataatttaatacgcccgtacatatatatagcatttttgaaagaaattgataccgatacctttcagggatgaagcttgttggttcattccatacttgaggatctctgtgaatggcaaatgtgtttacaagaagcattgtcccacgggtaatatgaaaaccagcaattgaacaatcagtagacgcttcatgaggcacaagaagtggcgctggcgggtataagcggagtgtctccatgataatgcactggaggtattgtagttttgtgaggtcactcgcctctagtagcctactggttgtcctatgaatgcatcaatttcgtcacgagcttttctcatcacattcgggttgtttagtaggagagacattgcccactcaattgtatcagctgaagtatctgttccggcttcaagggaactctggagaaataaaaaacatgacaatattatcattttgatatatttatcatggaaatatttttcataaaaagattaaaaataagatgcatgggaatatttttcatataaatctaacattatcattttgatatatcactattttagaatgaaggaagtatgttttggggaatattatatacaattggagttttcttctaatattgtagatgcaatttagttatatatatgtgtttgtggaatgatatgtgatgatataatttatattgtttacttttttcacaattgtccatctatttcgatatgggtcttgaactattaatttaatcataatgaacacaattatgcaaatggattaaaaactggatacttatgcaaaattcaaaagtaatggtttgtttaaaacccatcatgcaaatcatggtttatgcatgggtgctgcttgtctaggtgctcaaggaggggagaaattaaagggatgtggctttgcaacccccttttgagataaatttcaatgatccgttcaatgatttaagtggaaactgaagtttgaattattttttttcatttctagattttctttattagaagcgccaatacaagtcatacaaatgggttagtagatcatagtttatttactccatctatttcatattacaagtatctttgattttttttccttagttaaacttctttagatttgattatttttttaaaaaaaatagcaacatctacaatatcaaattaatttcattaaatagaatattgagtatattttgataaaatgtttattttatattagaaatattgctattttttgtaagctttaatcaaactctgacttagaaaaaaaaatccaaacgacttataatatgaaatggattatgaaatggagggagtagatacgaggggaagaaggtggcgagcgcggcgtgcacacgtgtatgggtggtgtgtatgcggtggtatgggagtggagaggggcgtacgtaatctatgtgtgcttgtgtgtgtattagcagctcacgtgacatcatacactcgtttgattgcaatcactttttttccactatatgattggtactccctccatccaaagaaaaaaaaagccaaccatgtgtcctcttctatttactacgaatctagacaaagggctgtctagattcattgtattagtagggatctcctcctaggttggttttttttgaacggagggagtaactctctatttatatctcttccttattaacttttgtttcttttcttatctacttgtatgtcttaatttggccggtatttttttcaaagatttaagtacataatcagtcctcttgacctagttactatgtactagaaagattatagtgtaagatttaaaattaatagtataagttttcaaaattataccatacatatttgaaataacaatatatatataaggtacaaattatacaatgtgaacacatgttgcaaaattttgatcccgacccttttgtgaaacatataatttggcatgtgaatatatatgtagaaaaacaattacgatgcacaatgagcggatgagctggtcggggcacgcgtcggggtcctgcctctgcaccgagaggagcacgccgatcatggtccgccgcctcgccgccggctgcgcacggtccgcgccctgctcctgctccatctccttcctctcgtcgttgatcagcccctgcaggaacctcgtccggctctcgcgcagccgccacagccgccgccccacccctcccacgtccacccaccggagcgccgccggcaggaagtcccacaccgtcgacgcgccgctcagcgccatcgtctcctccaccatctccctgaaccacctcgcctccttgctcaccttgccgtcgtcgtcgctacacagagttataccagatccatggtggttaaccaaaagaacttacgagtcatgcatcatggtgatcttacgcgccgtagtaggtcttgtcgcagatcatggccatcatggtgttcatgagcagctcgaacagccgtgacttgagctccacccgcacgcgccctgcagccgccccggcgccgtggcgctggcgcgacgccgggcggcagaggcgtcgcgccgtggcgcgcgccttgcgggcgtgggcgccggcgaactgccgcacccggtgcgcggagaggatctcggcgacggcgacgcggcggacgtggcgccagtagggcccgtaggcggcggtgcccatggtggaccagccgtaggacaggatcccggccgacggcaggcgggggcggccgacgaacgcgacgtcgtgcgcgccgaggcactcctcggcggcgggcgcggacgacacgacgacggcgacgcggcgggatcccaggcgaaggcggaacacggcaccgtggcgggcggcgaggcgcgccagggtgcggtggagcggcttcctgaaaaggtgcaggtggccgacgagcgggaggcccggtggctccggcggcagccgcagccgcagcctcccgcttcgccggcgtcgtgcggtcagcagcagcagaaggagcacgagcgtgagagcgatgagaagagtggaggtgtccatggatctgggaactgacgattattgtagcagttgcagttgcagatgcggcaattttttcagccatgcagacacatcgtgcacaacccgccagacgaccccatgtggtgacctgccactaccggcttgattagaccagccaagcagcaaggcccaatgtccaatgtccaatgtggaccatgttctggttctaattttgtttatttctatttttttttaatttaaatagaaaaaatatccgtgcgttgcaacgggtgaagactattttaattgtattattgttagatttttttttgtctaaaaagtatatgggatttttattttgatatgatatccaattcgaaacccttgtatttttaaaagcaaacgaattttaaaaccaacttaaatacggacaacatactaaaactatcagcggaaacaacttcacagcggaaacaacttcagttttaataataaatcacttaatcctaaatggccgaacggaatcatatgttgaaaaaattatgttaaaaagaatcatgtgtagatgaatccttcacaaaataaacggacatgcatgcaagccacccatacaaaaattagtatgtttttcatttgcatgtgtacaaaattattgaaataacacaaacaaatctgtaataaatagtatgtaacatatgcttagaagataggcaatatttttcactgagacagctcgaaataggaagacagattgtgatagacgttgggcccttttacaattttaggcccatatgtgcaaaaacgtattggatgtgcagagaaaaaaaaaaaggaaacgtgaatatggtcaaaatgctaaaaacatatatgaatcggaacaagacggcttgttggaatgaagggacggcggacgaaaattcgatgagtataaaattatcttcaatttttataataggtaaaggttacgacggaaacattttgttctcttttgaagcatttttttgtttttttttgccttttattattttggatggatttttttcacggactggtggactgccttttttattgttgcatacaaaacaaatctttattttttgtttttttgaaggaacgaactttttttcgccgctctgggggaatcagacttttcttctgggggactttttcactcttttttaattttttttacggatggtttttcacctttcttagttcttacgaggaatcggacacgttttctttttaaggcggcccaattaattcgctcagatggaaacattaaattaaaacctatttaaacacgggtgacctactaaaatctcgataaaaacaccttaaatttttataatagtagagatagagataaagaagagatagagatatatggtttagttaagatgaaacacattgtgttaaattcgtttggatatatattttgttagaaaattatgagttgtaattagagtccaatcatctcaagttaacctgcgagttttttaaacagatttcttttacgattccttatatatttacaaaagcaaacgaacttaaaatcaactcaaatatgaatttgtatttataaaggcaaacgaatttaaaaccgactcatacacggatgacgtaccaaagtaccggcaaaaacctctttaatttttataatagtagagatttagagttttttcatctcatctctgaaatttcttttccctaacatttatttccttgttcatttttccttttagcgttcactcctacgcttggatatataatcctcatgtaccttgagatattacgtactccatctatcccaaaatatgagcagttttagctctaaatttaaacaataatatatttataggtaaaagttattatattttaggacgggcttagtagtcatggtcgatcataattgataagaagtactatcattaaaaatttacacatatcatcattggtatctaacagatatcattgttgataaattgatatttatcatcaccggtacctcacgtgtatcatcagtagtacgtacatgtatcatcgtatattcattggtgtttacatgtatcattaccagtacttcgcaagaatcattactgattcctacatttagagcgtccccagcagatctttcatccggtactccatccgaaatatagcgcatgagaggagaaaacggcgctccagcagatacggtatcaaggcctcaaaaaatagaggatgcaccaaatcagggagagttcggccaaatatggcgattctctctcctcacgccaaaccttattgcccgcgctcctgcccacatccggagttccggatcaactttcctccatcgcaacctccctttcgtcgtcgcccggaggtatggaagtagagaggagagacttactggatctgccggcggaggctcggagtagaggccgaggcccgcccgcccgttcgccgcgggatgccgttcctctgtcggacaaccgccgcccgcgccggtcattcctccgcccgcaaacccgccgcccgcgcctgcagccatgcggccgccgcccgtcgctcctccgcccgcaaggccgccgcccacgcccatcgctcctccacccgcgaccccgccgcttgcgcccacgaccccacggccgccgcccgtcgctcctctgcccgctccgccaccgcccgcgcccgtcgctcctccgcccgcgaccccgccgccgcgcctcgccgcccgaaaccctcgcccgtgaccccgctgcctccggttgtccgctgagggaagagaagaggagagcagtagtagagaagacaagaggagagcagaagaaaagagtagtagtagctgtacacgcggctgctatattgattttggaacgtttacaaacaaataacgattttacagtgtcccatatcattttatttgtgttgctatgattttttttttgctatgattcactcaattcaaatataccaattaaaaattaccagttaaaattatcactgttaaaattatcgtgataaatagcaccgcgttaaaatttagttgttcaaaatatatcccttaaaaatagaaatgtaaagttagttaaaagatattataaaaaattggatatggtatagatgatctgctggagtaggaaaggatacgagtgaggaatcttttttggatggctatccatatgggcatatggaggatgagatttggatgagctgctggagatgctcttatggtcattggtacctgcatgtatcattactcctacctacatgtactatctgttatccgatactactctgtcaaaaaaaaaacgaattcctagctatgaaccttgacacatataggattggtcttttttttaggacggaggggtaagcatcatcactcgtatttatatctatcagaatggatgttacggtatcatataggtgtcaccaccggtacctacaaacatcatcattggtatccgcaagtatgatcttctatatctatttatatcatcaccgatatttgacatacattattagacgacattgttagtgtatagaagtgcaaattttagggtcatatgtatcatcactttatataagcaaatgccatgatgtaggattgaatagtaagaactaagccaaccagaggggtggatgaatggatgtagtacctaaaaaccgaaacttttagcagaaataaaagttaccatcgaattcaatggagagctcgacgtaatcggtctaaccgccagatctactccaatctgactgcagtgccgccgctggtctgactgccgcattgtcgccgattggattgccttcctgccgccgcctcctcgctggttagaccgcctgtattacttcagtcaaaccgtcgggacctaggaaagcacgtatcgatgaaatacttaaaagtagatcaactttattgcatcaatatgtgtttacgaagtacaccaacaacactcatcaccaaaatctcgactaaactcgaaaccctaacttttctctcaactcaactctctcaaaaaccaatcccaagaggccacaccctccgtctctatttatatccaatataggcagcctaaagctacgaaccaaccttgtacaagacatcctaatccactagaaaacatgtccgtaaaaaaaaattaaactttactaactcgaattgtatcaaatttggacaccctccaaattcaactccgctttccatacgcacacaacaccacatgtattccatatggaaaccttcacctccacgtgcattcttctctagattgaacattccgcgtgatatccttgaccgcccggacctcaacctcccgatcctcccccaagcctagtcccgatccatcaccgactatactcccatggcctcaagcaacacttgcacatgaacaacaactaaactccatatccgagtacaagttcgcactacttgactcacatcagcacataatagcatcacatacaaaaagaaaccaactagaaatcatatccatgaagcaatctagaaatcccacgagaacaacccgaaattgattcccacctagagtctgccggtctaaccgtcgggcaacacgatcagatcgctccaacactaccggtctaaccggcggcacctgcccggtctaatcggccacacaaagtcgagaaacgaaaacactattcaccttatttttataaaataattacttttgacaattgttcatcaccatgattaaatcattacatgactctacaatccctccgtgatgaacacattggcaaaatcctcaaaatgcaatttggtgtttttaaaaaatgaaaaacaaaaacaaataaaaaaaacacaaacaactcaaaaatcacaaaagcaaaaaagaaaaactctctcctttttcaaaagaaagaatttcttcccatattggcaaacaaagcacaaaatcgactattttttaaaagcaaaacaattcaaatccccccggtgacttggtaacaaaaaaaaattcaaatctccccctttgaaagcatgcattttgtatatttctccccctttgacaatgatttcatcatgcatttgcattttaattagtaatgttcaagagcttagcatcatacatagagcaattcatgttatgtgttgtaatagaaagaagatgaacccatcaattaaatagcaggcatgcactagagtataatcatgaatcaaagatattactatcaagttcaaatcaacaatcaatattcataatttcaaataatttataatgcaatatattcacaagcacataggtttaaaagtcaagcctacacatatctttctcaatattagctctagcacaaaacaaccaatagaatttgtaacatttatttgagcctttttgttttactcatttttttctctcatttattctggaaacgtccttgtcatcaagactatttttgaggattcggcacccattattttcgctcacatcgaatacgtccttgttgtcaagactgtttccaaggattcagtattcattttttttctctcatagaaattattttattctcttgcacgatgagaaaataaagagcaatttgaggaataacaattcaacaatcatatacataagcattcatcatccaaactatgtactagcttcaacattgcatttttttcttaattcaagtaaaagaattagtgccatgcaccatctcacttaaaagcaatatctaagcctcataaaaacactaaaatgcatacacaagaatatacaaaatacatggcaaaatattatgaaccttcataatattgctagcatgcacaagaatatacaaaatgcataagacaaagctctccttttcttaattttttttgttattttcagatttgcttgataacaccaagagcaaccccccctctcaaattaaccttcaattttccccggacaaaaatcaagaaggaacaaagcttttgaaaaagacacccaattgccaacaatatcaccaaggttctcatgaattgatatgtatctacttgtattaaccaaaactactacctcaaacactagcatacgaaaagctaataatcaagagagtagaacaatattaatattatgtcattccaaaattattttgatgttacctcgaaaaacaatcatcttcacaacgttgaacgcatatggagagtatgccgccaaaatacctacaaagaggaagatgtcgaggcctgtgtgttggggttaatcataagaaattttggaatacaacattaagtcacacgactggtagaaccaatagatacatatgcacacacaaaatcagaaccagacttacctgaaaacttaccttgtctcttcacaaaagtctaatttgaattatgcgcaaaactcccccgaggccagtctgatcgccgttgtacctgcagtctgaccgggcttggctaccggtctgaccaccggttcacctgtggtctgaccgagcatcgcatatgaaaagaaaccatctagaagttatatccataaagcaatctagaaatcccacgaat

SEQ ID NO: 59558 - DNA, 113832 bp, Oryza sativa
ctcacccccaccactactcctttttaaaggagtatagactagccaagagcccgtgcgtcgcaatgggaaacagattgagtagtacttttattatttttcttattgaacaagtaggtgattttgaaatttggtgagagccaacagtggaacggggaaggacttgttgaagggtggtgttggtgtaatagtatggattgtggggcccaagtgccagtggtaggggtggtgtggcagaacggacaccaccactactaacattttaagtagtatagatatagatatagattttgatagagcactaaaccctccaaacatttttgttggctcactttaccccctgaactgcttaaactatggttgcccttggcgttttatctctcaagtttattgcatagcatattgccgtcaagatatcatagtagcttttccttctgtaatagcatgcacataatattgacattttggttgaggaaccaaggacatttccattaccaaacaggaatccacatctgctgaaatctccatttacatcaacttagcacaaatgatggctacactcttctttttgtagctaggatgtttcataagttcgaggacatgctattctggtttttatgcgcagtctgctttttgtagctaggatgtttcataagttcaagaacatgccattctgatttttatctgcaccccgcgtggatgtcagataatcttttttatctgaattcataattcattttccataatgttggttattcatgccacttgtcttgatgccatgaaaggggattccataatttatttttcgtcattggttgagctacggcttataagccgaacaaaaaataaacgaagcaaccaaaaatgattttagggcaggacttttagatttctactcattgttttaaaagccaaggttgaaaaatagaaaacaatgaaagaacacctagattaatttgaaaaaaagtttcccatgtcatgattggttgaaaacatgagtctcatggactaaatgatgcgaacatgtaaaagaatgtagactatacaatattgaaaaattatcttaattaagatcacaaaacgttgaaagcctgaatacacatactcgcacaaagctgtgcacagttataaatttatgattgcacacacgctgtacatatttatctcttttgtagggtgttcatttttactattatgcgcaatttttctgtagctgcacatagtctgatatgttttacatctatgtacttttatatgctatgtgcatttcgtaaaaaaaatggtgcatttggtatgtttgctagtttaggaaaataatatttgtggttgtgcatgatggttctgacattttgcttttcaggtcacatatcacccattttcaaaggaagaacagatggaagccctagagtctgaaaagagagctatcgaggagagaaagcgactcaaggaggctggggttattggtagtacaatggatgctcttggtggtgctgcttcactagttggttctggtgttggacttgtgggcactggcattgtcggcggggttggacttgttggatcaggaattggtgctggtgttgggcttgttggttcgggtgttgggcttgttggttcgggtattggcgctgtcggcagcggcctcggtaaagctgggaaattcatgggcaagactgtggccgggcctttcagtatgtcccggaagaacggtagcagctcaactgctccccaggctgaacaaccttctgcgtgacttgatgtacagtgattgcaatggacatcgcatgttcagttgcgtgttaattctgtttgatataaacttgtgatacctagaattatagggttgcataccatgcatttcagtgttctggcaccgtcggtgtcaattatatgaccatctgttgcttttttttcttcgttctgtttttacctgaagataaatagcaagattaaactgtaaattggcaagctagacatatccagatcctttctggacaatgcaatggtattgaaatttgtcgttattaccgtcttgaaaaaagttactatatactcgcatcgtttctattttccttttttttttggagatgtctatatattcagatgtactactagtggtgtatgatgtgattaattgatgactcgtgccagacacacctagtatggttagggcatctataatgtagtacaaaagtagtccatagggaataaactattccattcagccacctagtaacattgtgcaactagtccatataaagtaaataacaaaaggtatccatatgcatatggactatccatataaaataaataatattatctatctctacttctctctcttctcttaatgctaccttgtatccatacggtagaggagtgatcctctctagcgggtggtcgtgagaccctcctttatgagttcggccgggggaaatggcgcgatgatcgggagcctacttccgctcgcggtctaactgctagattgctctcgtggctgtgcgtgagatcaaggattatacaggttcgggccgctattgagcgtaataccctactcctgtgtgtgggattaagatcaacttttacaagaggtcttgagctctagagggaaatctagctgttcttcctctagagcttgagctatctcagagtcgtcctttttctcggtgggcgaggtcctccttttatagttaaggggataccacatgcaccgtttgcacctacccctccatgggaggggaggcccacatggccctaatcataccgctatcctttgcttcaaccggaagcagcatggccacctggcttcaagtggggcccagcgccgccccccgcctgacacggggaacatacctgtcattccctattaattgtatgaaaactttggcggctcaccatgcgcgtggggcgcccctggcaacgtgtcaatgggacagggtatacctgcccccactccgcctgacacagggcagaacgtgggggcactgcccccgtcccatcgcctatgaacggtcacaggccggtcaagctcgattgacatgggtcaatcgagcggcgccacacgtccctcccacgccgcattaattgcggcgcaggacggttggggcgccgcacattgaaggcgcggagcagtgtttttcgccccgcctgctctccccgccacgtggtggccgggcgagggcctcggggtagcacgccctgaaagcccgaggggtgcgacatggcaccccgaggtcccctggccacctcagcgctacccaaggggcggggggaggcgaggccgtgtagccacgcgactagatgggaaggatactttcctctactgtgcgtacccccgggcccatttcaccgacacatacatattgtgaggattgctatagttaaagtttatttatgtgggtctcatctatatagactacttttgccatatacattggtgatgccctaacgatcgtggtagctggctttttttgctgcctttgatatatcatttttatgatacagtaaatatccctgaatatctacagtatctcttctctataggtgtatataaaggagctatggtggggagctgagcctgtgccgagttcgacccttgagttgcaagcttagggcctgtttagatccccaccctaaaattttacaccttgtcacattgaacgtttgaacacctgcatgaaatattaaatataggctaaaaaaataactaattgcacagattctgattaatttgcgagacgaatcttttaagcctaattgctccatgatttgacaatgtgaagctaccgtaaacatttgctgattaattaggcttaataaattcgtctcgcggtttactaacggattctgtaatacaccctatattattttttttaataataaaataatacaccctatataatatccgatgtgacactctaagactttaccctgaatctaaacacccccttacctgcgtgagactgggaaatggctgtgattgtcgtacaacgtcagtacgtccaggggtgggaagggtgcagcgagccacccatatgcagcgagtctgcggagcgtaacggtcttccatccaaaggatccttatccttccccagcccagagggcacggcacctctccctctaagacggcacgagcgacattaatcgcccccctctccatctccaaatccaaacgagttgatcgtcgcatcgagaccaaataatgccaattgccagtgtctctgccaagcctctgtctcacctccccgcaaaacgaggcaagtgaaaccatctatcgaccctcttttaacttctaccctggatgtatgcgtgctgtacaattctgaatttatctgcatgattctttcttggcggtactttcaggatcatccaggttcacaacgaaaggtacatcaagagtaagggttatgatgcttaggcaaaaaaatccgggaggccagaagaagagctttgatggaacaggcgagcctctatatcttgggatagactttggaacttcaggtgccagatatgctcttgtcgataagcaaggggccatacattctgaaggcaaaagaacttaccctcctgtacgagttttgtgaatctctgatcatttttttcttttcagtttggctgaagaatgtagatgaacaactgattatcccaagttttgttttattggcttaaaatatcagtaaaactgtcgtttaattggatcagaatcaaccagctaactccttttcagtccataggtagaacaagattgaaaaatatggctgtaattttttctctgccatcatcactgcattggattatttgttcactcctaacgagcatacacatcctttggtttgagttactaggtaggttggtagagtcacaaactgggcaagctcctggagagaagctctcttccatcttctgggtaatatcccagccatctaccggccatccatctcttccatttcaatcgacgggacttcagccaccactttcatcatcgacaggtttctgttcctcagatccttacacattccacatcgcttcaatgcaaaattcagtcagacaaaaggtgcatcgctaatgcaagtatctgaccatgcatgctcgcaattaggaacaatggagggattcttgctggcccatatctctacaacgagagcttcgcagacgcgctgccagcagtcgaatcgattgccccggcaaatcatacggtgcgttctggttcgtccaccctgtgcaagcttgtgtcatggtggaattcgagctcagcaggcttgagcagtagagattcagcgatactgatgcaccagtcagactggttgctctggcttttgcatggagaatatggtgtttctgattataacaacactctgaaggtaattatatatcttgacaccccctatccagagagcctttacttattaatatgactgaattacacattgggccaccttttattgtcatagcttcacattgaaccaccccaaatctaattttttcactttagactagctaactttacatttcttgcactttgaaccatcctgactttcttctctagccatgtctatgactatcctatactcgggtaaagatatgaccggctcataggtggaggatttcactagcgtggtggagccaagtcctcaatgccgttgatgtgctaaagaagtggttttggatggtccaaagtagaacaaacataaatttagctagtccaaagtgaaaatgcggcaaccaaagttggtctaaagtgtaattcactctattaatattaatcatgtacacacatagcgagatgaaactatatgaacatgtaactgacgatgaatgtccacattagtgtcctatatatttttcttttgagaaaaaaacgcatttcaatgtagtacaggaattgctcgccagaaatttagggcccctttgatttggaggaaaaaatataggaattttggaggatttcaatcctatagaaaatttttttatgaatgcctttgaatcagaggattgaatcctaaccaatcatttgaaattcctatggaatggacaatcatatagagattttggagaaaatttagcaagaactctaaccttttggaaacttcctttgagtctctctctctcatttgatttttgcgtttttcctgcggtccaatcaaacgatcattcctgtatttttcttgtgtttttcaatcatctattttacacttcaatttctgtcagaatcttgtgtttcctattcctctattttttcaaccccgcgattcaaaggggcccttatttatagtgttttcatgctgcaggtgggctacgatccagagattgactcgtacccaagttggttgatgtcacagccatatgcttacatgttgccgtctgttagagcacccggagctccaattggctcaatcaaggaggatgtacgcgcacagtttggtacagatccaacttaattctcatatttttcttggatctcgttaaactatatattgatttggatgtcgtgactacaaaatgacatcaaacttagtagcttttattgaaatgtatggcattggcatgtcaggatttcccaagaactgcgtggtctgtactggaacaacggacagcatagccgcttttctcgcagcgcgcaccacagagcccgggaaagctgtgagttaattctacgacacggatgaatcgcaattcacaaaatgttttttttgtatgacacgtacgaatcaatcagtgaatggatcgatgatcaggtgacgtcgttgggttcaactctggcgatcaagctgctgagcaacgcccgcgtggacgacgcgcggttcggcgtgtacagccatcggctggacgacatgtggctggtcgggggcgcgtccaacaccggcggcgccgtcctcaggcagctcttcaccgacgatcagctcgtcgctctcagccacgagatcgacccgtcggttccttcccttctcgattactaccctctgcctaagagaggagaaaggttccctgtctccgaccccaacatgatgccaaggtacacaagtaaatcatcatttactaattcaactcttttctttttcatgatatatactcgtaacactataaatctacaaaattattacagaatcctaatactataaatctagaaaaaaattacccaaattcatagtagaagaatgtactaggtttattttatttatgggacagaaggtgtaggcctcattgatcttgacaacatttatttgtgtttgaatgtttttgtctcatatatctgcattaaggctgcagcctaggccggagagcgacacggcgtacttgcatggcatactggagtcgatcgcgcggattgaggtgatatcttttttctgcgctgcattagcatgagttaaaagaaaaactgaattattggacattgaaatttggtaatttttagaaatcatgcaactttaatggaaaattataaaaatagatgttgtttatctgaaatcacaaattaagcaccctattgaacaatggttgtttgacaaggtttaagaagttagggacttagatgtgtgtggatgcatgtgaatgggctgtgggacatatcaaacttcgggaattcgttaggccaccccatgcatgctcttttctttttttaatcaggccaactaagttgtcgaacaatattatcgaactacggttgtttgataggggctaaatttgtgatttttatcaaccaatatttattttttataattttccattaaaattatattatttctaaaaaaatgaaatttggtatgtggacgaacggcaagcaggcaaaggggtacaatctgttgaaggagctcggcgcgagcatggtggaggaggttttgacggcgggtggaggagctcggaacgataagtggacggcgataaggggaagggtgcttggcgttccggtgagaaaggcggagcagacggaggcggcctacggggctgcactgctagcactcaagggtgctaatactacgcactagcgctctaatttagcaaaatatatgtacatatacagttttttaatgatatatttgtgtatgcgttgcaatcgcaaacttataatgtacttgcattgtttctaaatatacgacactgtttacttttggacataatgtttgatctttgttttcttgttaaagaaatagtgtgaaaaagaaaagtcatatgcctcataaagaaacatagttaccgcctaacccaatagcaagataatggtctgggtagtccatgaattaatgttagagagtatgataattttagtcccatacaaatgaatcacatttcgtaacatatgtacagttcataagttaactttaaccattaatatctgtttaatggaaggattcaacatttaaaatgttgagacgatgaaagaagaggtaaatgatgacatgatgccactttgaggaaggctggtcatttaaacaaaaaatctggtaagtcatttagtgccactgctgccggatcaacctatatatttattgacaaaattttcttctagaaatttaacagatgcaactatagtacaatcgtagtataattatactgtaacttacatgtaacttgtatataactttcaaaaatctctctgtaacatgctatttcggtgaaacggaggtcgtgggaacgaatcctctcacatatgtgcgcgcaataacttttttccttcttcacttgcacaaatcttaaaacaaatttaatggttcaaaattatatgaaagttatatgcaagttatacattatagttacattgtagttacatgcaatttacagtattataattacatctctaaaatttttaggagaaaatttatcgataaatatatagcaaaagtgttctcgttatttgatgggcaatctaagtagcaacagcagctaggatacatcagggataccacacacacctataggttaatattcgaagctttggccctaactcctacatgacaattaagggcagcacactatgcgcaggatttggacaaaaattaacagtatcacacacgtttttaatccagatagctaaagccgcacggatatcttaaagggttaatagtccatgaagtgggctctaatgcttgttcaaataagatctgacccatttagaaagttacagaccataagatggcagaaaggaacactgtaaaagtacgatatatttgaagactgaaggcattcagataacagctctaggagcaaaaacagatgagtaaaaatgaagacaaccggtacagaataactagcagaaaaacaaacatgaatctgcattgaatttaatgtgaaagaattactcgttactaccagtaaccgagaggaaacactaaatggtgatggatatttgggaatatttaaataggaaattcctctctcaagaagaaacaagaaacctgtcaatggacgcaaagcagacagaataatacaaaagaattacaaccgagtcttgagctcttcatttctttttcttttatttgtgttagtatgcactgaaacctagtccagagaaaactaaaatatatttggttataaaatcttgaattgttctcagaagtgtgcgtagactacagtgataaagtagagtactggcaaataaagccccagagtaaaactgtagcatgtatttcctctgtagacatcaccatagttttatacttaaagaaatgaagtctttttttttcaagaaagaaaaagacttgaagattttttttttgtgaggaaaaactgaaatatattaaactccaggagcattacaatctcgaggtaaaggctcgcacgcacacacaggaacttgaaaacgccacacggtagattgcttagatttcagagccagctgagcaagactatgggcaacaccgttatcagctctgtagatctttccaatcctagcactgggaagcagattcaacttggctttagcctcggagagaatatgccacagcagtgatctgtccatcggcccattcttcagcatatttaccgcatttgcgcaatcactctctaggatcatcggctgcttaatccattccaccgtgagtcttatgccctccagacaagccagcacttaggcctcctctgccgacccacaatttcttatcactttccaagaagacagaagaacccgcccttcatgatcccgaatcacaaccccggcacttgcatctcccgtactcctgacaaaggcaccatccgaattaaccttgacccaatccaccggaggcttcctccagttagagaactgaactccatcttcctttaccggctccgatctctgaggacaacaactcgccttgccatggagatccagagtctttagggcagttttgtttatcttgccgaagagaatcccagtaacttagcaggaaaaggaaggatccctctacactcgcccgacccgcaccaaacaagatatcatttcgtaagaaccacgccctccagagaacgaggagaaagcaggacctcacatcctttgacacatgttgcagaatcatcaacagccaaccggccctgatctcaccaacagatttcagccgggagaagccattccaggcgcagtctgtcacggagctcccgcgcccttgtacatgaaataaaagcgtggaactcatcttcctcctccagaccacaaatgcgacagatagcattattttccatttttcgagttatccggttgcacatagtagccacctttagccacacgccaagcaaaaatcttaaccttatttggaactgagttccaaatcttctccagatgctccgttctccactcgccgagcagctagatgcccccatattggaaggcagctgagacttcaaggcgactttataaacactccaaactgagaaaacacccgacttctcatagtgccaagcaagaaaatcctccgactgatactgcggtagtttaatcctcagaatttcagggacatcacaaggttgacacacctgatatatcagtccaacatcccatgatctgtcctcctgattaatcggttcagaaacccatcgcatccggcacctacccttctggcctgccaatttgagagaagtctccctcagtatccactgatcacgccaaattttaaccttctttccatcaccaatgcgccatatcaacccctttttaagaagttgcaaaccatattccaccgctttccaggtaggagaagaatcgctagggaaaactgcatctatcaagtcacagttagggaagtatttggcttttagaatttgagcacaaagattgtcagggaaggaaattagccaccacgcttgtcgactaagaagagcttgattgaagagccttaaatccctgaaacccaggcctttcttgacaaattaagcgtctttctccccattgtcttcatgcctgacaacaatttgtagcacaatactatgagaaaagctataaatctgttaagtgtttataaaaaaaggttggcggactcatatataagcagattggagagagacaaagagtgagagtgatcatctgttaagactaccaaattaatagcaatgaaattaaagaagaaattaattatcacctccgaattggtgcttactatctttctaacacataatactttctgaaatgagcaaaggtaatgctcttcctaaaaacattatgctcacttccctctgtagcacacagaggcatttcaacatgcaccttacaggtgctttactggagagcctcttatgtactaacacagggagcaatttgtgagcacatattaatggcttagcattgaatacacaagcaactaaatatagcaagctatatgctcagttgctcggatacagcgtttgcaagaacaggatgagtccatcagctgaatcagtccaatggaaaatcacggaatgggccaacaggcacgctcttctgatgtggccattgcttttgctcgccgctgcaacaccctgtcacattagggtgaccctcgacaggctgaaactagagcaaaacgataataagcttctggatgcaccgaatattgttcaaatataaacttaatgagagaaaaaaatagaaggaagatcaaatgataccaatggagaataaagccatatggtgttaatttgcatatctgttatttgccaatcatacctttgatgagtggtggagcatgcccagtgatgctgttaatggccagatgcagcagggcctcaactcacttgtcatccttggggcatggattatctggaagcatagaaaccattgtgtgtttgatggtgccactcctaacctgacgagcaccctgttacttgccaagaaaaaagtgcagttctggagtttggctggggcttgaggactctctttcctaagagccctatcgcctggatcttagtcttttagaggtggttgttggtagtcttttgtcataggcgtgaacataatctgagttctactaaggtgcacgtgtgtactcaggattctaccctttcttctttagtacaatgatatgacatgccaagaaacagtgtggtgggggggggggatgtgatgaggtccatagaggatttcgctcgaccttggtgttgtcatggattggactagggaaagataccaatggtagggatcaacaccattgagtctgcaccagagcagagcaaggcctgctcagtgccagtgatcgggaagcactacagaagaaggggggggggttagaaatattgtcgttttcattacaaattaccgtggataacgcaattaatttgttcaggtgggagcaaacatggtggcagaacaaaatcaattcataccatacaaaactattttatctgttaatagcaaatcaactgcaatatcatcataaagcaacttcccagctttgtgaatagaaacctcgaattaaatttctgacaggttgctggaagtaaacaacagtaaacaacataatggggtgtaatggtccaacataacaacacatatttgaatcttcaaaatcttgtgaatgtagccatacaaaagtacaaaacacaatgtcttatgaaactcatattagcctaatcagttctgagaatctgctaaaataagtgtgaccacaatacacaagaaatagtacatatgcatttcaccaaaattgaaaaataaaggaataaagggaactgttggagttgaatgcttacttatcaagagcatctttgagacaaaattggatttatcttcaacctgacatcaactcttgcttcattagcaaccttcaaaatggcacaaatcgataaaaatttcagaacgatccgaggtactagaatacaggaacagtcaggtaatttgggttttattctcaatatttttcaccttaatgtttttcatgagcttcttagacagtcctgccatcctttgcaatttgggttgtattctcaatatttttcatgagcttcttcgacagtcctgccattgtttctgattgtaacagaaattccttactactttatgatcagcaccacctggtttaaaagaaagttacagctcatggttgattgggatgcacaaactattttctgattgcaacaggatggaattagagcttgaagactgatacacaacaaattagccaaacagcaaagaatgcaacaattttcaacataatttcaagaggaagaaattctcacaatataatgcaatcaaagccatgcactcatgaataaacgaagccaagatcagttacaacctataaattattcaggtacaatgtacaactcagtttttatgaaaattaagttacattcattttccattgctatattctactccatcctacatcctgcatactattgttaaaatatgcaggagcaaagaattttgcagagtgaaacctgtagcaactaagaagtaccctcaatagggagagggatgccacaaaagactcgcaggtaacaatcattaacctctcagaatcgtatcaatagaattaaatacattaaattatttggtatcagcatgctggtgatatatgttcctgagataatactccatgtgctttcttgaagaaaagcactcaagccacagctttggagctgcaggatgcacattgtacaggttggaaatgaacctcttctctgagttagcaagcacagttgcaggggctaatgttcttctaagaagaccattctctcggagccaccgaagcattgtatacctaggctttacccggttctccaaatcaaagcacagaaatgctggaaataactcgaggtactccactgagtatcctagctccttagtcatatagttcaacttgtcattaagcatcttctttccctggttgagaatctttgggaatacactcacgatctgacacagcatcttgtactccaaccctctttccaggaggcaatcaaatctctcttgcagagtatcccgattgctgtgcagtacggctattatctttgtggctatcttattctcaccatatccaatgctcttcaagaattccagcttgccgtcaatatgctgagctcttttatcagccttcatcttaatcatccctcccaagaatgctcgctcaatctcaacgtcataactaacatcctccaacacaaaatctggaaataaataccgcaaactctccccaccatcagaaatcttctccaggaaccaatgatccagttccattgcccgcagcacaccagggaggttctgcagcaggttcttcccaacaacgtacgggtgcttctccaccgctgcattaacctcattcactgccaaaccaactctcctcaggtactccggcaccgaaatgacaacatcaccaaattcaagataaaaaaccatgggattggtaagcaagaatctccccacctcctctcccgccatccccaaccccttgaaaaacttcaacattttaccaatcctctcctcctcaagctcaagaaacaccctctggttgttgcagccgacaaggtccccaatgcccccgacctctgaaccagcatcatagaacatccatgtcctgcggcaaacccccaagaaagcatcaatgtcattggaggtccccaaaccagggcccagccttccaaacaccttgccaagatcgtcgacgagacggtcactgctggagagatcgttctcaagaagcgaggggaaggcgaggcaggcggcgatgatggcggcacgggggagcgggccgaggcaagcctcgagagaggcaaggcgggaggtgatgaggtcgggcgggaggcggaggaggacggtggggaagaggaggccgaggcgggaccaggggaagccgaaatgcgcgagcgcggcgacggctgggaggagggacgggtggtcggcgaggaacatgaggtcggagcgcgtggtcgggggcaggccgatggactcgaggaagaaggggagctcgttgagcgggtggaaggcgaggtggcggcggaggagggaggggaaagcggaggtgcggagggagctgggcacagcggggaggccggcgaggaaggcgtgcagggagcgcggggagcgcgcggcgatggtgtcggcgtgggaggagggaaggcagcgcgtggcgtggaggtactcggagacggcggcgcgcgcggcggggacggcggcgcgccggaggcggtagggaaggttccatagcttcgggggtgccgacgaagccgccgcggtggagagcagccggcggagcgccgccgcgcggaagagcggcattgcgccgcttttgctccacagaggaggtggggtggggatgggcgagcgaggtttagggtttttcagactttgtttgcttggcagataatggttcggttcagtgaaaaaaaagagtgtgaattacagtttggtttatcttttttaccgttcactttagaacactcataattcaatattttattttggactagctaaatttacatttattttactttggaacaccccaaagccactttaccacatcaacaatctctaggatattagttatggcatgctgccaaaatcctccacctctgagcaggccatatctttgtccgagtataggatggatattaaagagagtcgaggtgatccaaagtaaaattaaggtaataaaagatggtctaaagtgcaattcactaaaagaacctgaaagagggataatataataagtaacatttgcaaccgagatgttgcaaattacttctaccgactcaaaaaagagtgcattgttacacgagagaatccacactactgacttactctcttggtttcaaaatagacaaacttagtacgagatgcataacaatgccaaaatgaaaaccatacatttaccttcaatttaaatccattctcacccttatcaaagaaactctattcccattcactcaaataaacaaacttaaggcctgttcggcaagctgggactgcagctgcgactgttgcagcccctgctatcttggagcttgtcagactgtactagttggttgcggcgcagctgcaactccggcagccgaataggcccttagcacgagatgcaaaacaatgccaaaatgaaaaccatacgtataccttcaatttaaatccattcccacccttctcaaataaactctattcccattcactcatttccattaacctaaaattggtactctctctttcacaatgtaagtcattctagtatttcctacattcatattgatgttaataaatctagacatatatatctatctaaattcattaatatcgatatgaatgtgggaaatgctaaaatgacttacattatgaaacggaggaagtaagaacaaagaaaaaacccttaacaaaatatccaatatgttgataccagtttaaagaaatgtagcactcagattagttttaaatcaattaaagcatcactcaggacaagttgcaaaaacctagtaaaaatgaaaaaaaaaggacattattttttttaagataatggaagatttattgaacttggcaaaattttttaaggacactcctagcctctacactacgaaagtgcacacaaccaacacacctcacacacaaagaaaataaaaaccaaactaaggttcaagaaccttgcacctgaaaactatgttgccacccatgcaccaaggtgaaaaaaaaactcattggccacatgctccaaatgaatacaagccgaagtgacaaaactatgtgaaccgggcttctggagaatagcccatgctcgaagctaatgtgtaaccaagaaaataactagcaaaggagaagaaacatatttgctttcaaaacccataatcattcctcgaaagccaagtgacccaataagttgttgctgcccctacaagaaaaagatgtctgagctatttggtttgtcgcaaagtccattgcccaaacatatgtgacacaatcctaggcgaacaaatgttcgaagaaatctggattagagaccaaaccgaccgagctagccgacaacaagtctgagctcctctcctctcctgccaccgcattgcacgccactcctctcccccgccgctcgtgcactccatggccgacaatagccttgttacggtcgccgctgcaggatccggcggagagggaggaggcggggaggccggcgagcgggtgggggaagaaggaggccagcgagcgggcggggggaggaaggaggccagtgaggaggccgtcacagagcctcagccgtcaccttcgcgagccacacctaccgttgctgagtcgccacaacgctggcatgccaacaaccgtagccgactgacaaggaagctccaggagggaggaagaatggccaagagggagaggggagaaggaggcgccgacgtgccgctgtcgagggcttcttcaccgactccggcaacttcttcggccgtatccacgcccgcctcgtcgacacctcctcctctgctctctcttatctgtctcgctggtgtcgattggttaaggagccactcgcagctaacatgtgggacctatgtagggcccacgctgactcaaccggaggacatgtgagccccatatttttttaatttttaatttgtatatttttcttctagtgccatcatcaccacgtaggacgatatttttcttctagtgtcatcatcaccacgtaggacgatgactaagtcaaaccagccacgtagacgccatgtcaacttaagccaccgttcaaaccgtattagaccttattttcaccggttttgacagttgagggaccagtgtttcagagatgaaatcggtgtcaagtgaagggacctcaaatgaacttattcccaaataaatcaacacagtaattctgggcccattcttcccctctctcgcaggccgcagaacggcccagtaagtttactattctttcgtgcaaatcaagaaacggacgcgaaacctgagagaaaactgcagtgggagacggaagcaaattccggcacgcctccgctccaagcgggctcagacccgaacccggcaagcgcggcgtcgtcgtcgtgtataaaacggcggccacgccgatcattcttcgttccacctcgcctcgcatccaccgtgagcggagcgccaactcgctagcaaatcagaagaggaggttagagtttcgtcgtgagcgagcgagagtcatggaggcggacaagagcggggagggggagaaggccggcggcaagacgatctccttcaggtgctcggacggacaggccttccacatgccggtggccgcggcgatgctaagcacggccatccgcaaaatgttcgacaagtaccccagcatcgaccacggcggcgtgatcgagctcccccaccaaatctcctccggtatcttccccaaggtcaaggaatactgcaccaagcacgccaaggtcgacgacaagggcaaccccaccgtctccaccaacaccggcgcggcggcggcggcgtcaagcagcagcaccgacgacgaggaggaggacctcaagaactgggacaaggagtttgtcaacatggaggtgaagcccctccacgacctcctcctcgtcgcccacctactcgacatcaaaggcctcttccacatcacctgccgcaaggtcgccgacatgctcaagggcaagacctccgaggagatgcgccagatcctcaacatccgcaacgacttcaccgaggaagaagacaaggcaatcaaggagcagaacccctgggtcttcccggatccggagtagaagctagcgtcccctccctccccgatcgagcatctgctctgctcatcatcgcttaacccgtcgcgtgtggttgctccccgtagttatctctggtaggttcgttcagaacttcagatcgaatcggcgttcttgcctttttacctttcctttgcatcatgtccaactagaacagaatctggtgtgtgtcgatcgaaatgttcaactgcttaattgtttgcatcaactgaaatgttttgcccctgccgctttatgctgatctgttcctgcatgcagttgattaattagtcatattaaatgatttctttgtctatttctggattagtactagtattgatcaattagtatgctggttggcacaatggcgtgtggttcgttgaggttgtcttaagaaatttggttttctgatttctaacgtttctctatagttggcatatttcttctctgttttttttggtttgagtgttcagatgtgtatattgggcttggatgcctgcaacaagatgttcttctctcttgttcatgcatttgcgtaggtagcaattctacacttcgatttgtgcatcgtggcacatctgtgaagacactattgtgagatttatgtgggctcacttggtttcagagatgagtggagtgatctgatattctgatcagtatggaatgtgctctgtgactttgtgttgttatggtaaaccggatcccctcaggcctcagtgttctgctgcatctttccctggtgtgtttggttcccctagatggtggtttcccgttgtgttgtttgatttgcatgtgggttctctgaattctgaggtagagtagtagatgtatgtgttggttagatactaatttgtgtgttgttgttgctttgaagagtatggtttgtgacatgtcaatgtgctagtacgtatatcacttgccatcacatgttgcaggttgtgacatcatggttggtgttttttttcgattgtcatcccgattttccaagtctggaaaaatttctctgttttttcttttcgttgttcataacacactgcaaaaggcaaaaaataaaataaaaaaaaggataacactcttgattttctgaactgcgcagagcataccaaacacagcactttttgtccaactaaaggcctagtcaggtctagaaagtggccctctcttagagaactgaccagtccgggaagaaacctcactgctctgaaacagaggaatcaaatagatcaggggaacaccatactaatggctggtaaatttgagaaagaaaataccatttcaagttatgagtagctggcattttgtgtaatccttgtggaagcttttgtcccgaactccatcagtgtacttgtttggttttaccaatttatactgaggtgccaaaaagacagaaaaaagagattactggatttttgtcaaaccaaaacattttaagaaaattgtttggagtggacatttcgttgtctgcaacagaccaacgcacctgcatagtttcaagtcacttgtgagttatgaagatgcaattccttaatgaacatttgcagttgctggtcagcaaaacgtgagatgatacggtaatattttgttgtaccaagtgatttgcatatgaagacccaaaagtaaaaagacaactgacgctttaattttttcaaataaatttctttaaatttgatcaagcttataaaaaaagtagcagtttttataatacaaaacatactattaaaatatattccatgttccattgttacaattgcaatatgcatactagagattggaaagtgctttctattagaattgaagcaagatccgaaatttcagatacccccaaatattccaaaacgaaggtcttgtttagatcccaccctaaaattttttaccctgtcatattgaacgtttgaacacctgcatgaagtattaaatatagtctaaaaaagtaactaattgcacatattgcgactaatttgtgagacgaatcttttaagcctaattgctctatgatttgacaatgtggtgctacagtaaacatttggtaatgacagattaattagacttaattgctaataacggattaattaggcttaataaattcttctcgcagtttactgacggattatgtaactagtttttttattagtgcccgaacaccccatgcgacaccctgtataatacccgatgtgacacaccaaaattttacagccctgccctggatctaaacacccccgaagtagaagtgtctgtgtaattgtttcgaattgacaacatggcctagtgctgctctccctaagaaggaatagactacctggataaaagaagaagcaggagagctcaccgttgggctctataagtcccggcacatcctcagagtccaaagaaaaagaactagcatggcaaaaagtgctatctattctattagaactgaagcaagatccgaaatttcagatacccccaaatattccaaaacaaaggccttgtttagatcacacactaaaatttttcaccttgtcacatcgaatgtttgaacacctgtataaagtattaaatataggctaaaaaaataactaattgcatagattgcgactaatttgcgagacgaatcttttaagcctaattgctccatgatttgacaatatggtgctacagtaaacatttgctaatgacagattaattaggcttaataaattcgtctcgcagtttactgacggattatgtaattagttttttattagtgcccgaacaccccatgcgacaccctatataatacctgatgtgacgcgccaaaaatttacacccctatatctaaacacccctgaagtagaagtgtgtctgtgtaattgttccgaattgacaacacggcctagtgctgctctccctaaggaggaatagactacatggataaaagaagaagaagcaggagagctcaccgttgggctctataagtcccggctcattcatcctcgagtcttttggctgacgtggcatcctagttggcaaaaagaaaataaaaaaatgtagaacgcacatgtaagtgagcctagatataatagggcccacatgtcaaggatttcttcttccttcaatccccctctccctcctctattcctaccatctctctccccacctctcccctctttccccatctctctctaggccggtggtcgtcaacggtaggaggaggggcagcgatagcgccttgccttgttgcggccaaggcgatggcgggtggggggggggggcacaacttcaccacttgcacctccattgcggcaaccgcaaaaggactctacagtcaccatggaaaccgcctcccctttgttgcctccatcaaggaatccacaggagggctccctggctgccaaggagaaagcctctcccccgctgcctccactgcaacacaaggactccctcttctctcagatcatggcaaccacagacccactgcccccatcttggagcagtgtggtccctccccgaggaaccccatgtcatgaagcctgagatccagtccatcatcaagttcgtgaagcctgagatctagtccatcatcaagtatctgtgctagagcaaccgcttctctccatcccacgctcccgttccgtatcaacttctgcacccttccctcattcggtctcaccttctagctttggcctccaccctcctccgcctgctctcggcctccctccaccctcctcgagcttggctcgaaaattggcactgctagccttgccctaggcgtggtgctgcccatccatgccacctctgtcggggaaatccgcaagaaggctccatggctgctgaggagaaagcctctccctcgtcgcctccactgtggcgccaaaaggactccctcttccgctgggtcgcaatcaccaaggacccactaggccctgtcctagagcagtgcttggatatccccacgacgctccctaacctccgccacaacgcctccctcaacacacccctactcgactcccatggacgcttcgtctttgtattagcgctcccttattgggacaccgtcgcgatggaggttgtcgccgtcggccacctcccacagacaagctcgccaaccactagctctttccccgccagcaaactcgaagagaggagatagatggggagagttggaaatccacttacatgtgggtcccacatgttttttattttctttttgctaactaggataccacgttagctaaaaccacctccaatactactaaatgatctgatttgaatggtttcggaaagatggggcgtgaagatttctggtgttagggttagggatatcaattaaactcaacgtaaagatgagggatcgcaagtggacttactgcccacgtgaagattccttgttccgaatggacaagagtacttctcggcccatcaccccccgcgcatcagggcccatgtagtcggaccattcgtgcagaacaaaaaacggacgtgaacgtcacagattgagtggactgatctgatagtatgcacagtatgctctgtgtgttgtttaaacctgctcccctatgtattgtggtgcttttggtttcacagattgagtggactgatctgatagtatgcacagtatgctctgtgtgttgtttaaacctgctcccctatgtattgtggtgcatctttccctggcgtgttgtttccctagatggttttccggtgtgttgtttgatttgcaagcatgtgggatgtgtattctatgaattctgatgtagagttggctatagagccaatatgtgtttggctgttgctttggggagtatggcttgtatctgatgcttttcaagatccatagttctcaatgttctatatcagatatcgctgcccatcacatggtgcaggttgcgatatgtttggtgttttttcacttgtcatttggaatttccgagtctggaaaatctgctctgtttctttttttcctttcagattcttcatagtgctctgcaaaattctacgctgtgttcttacattgttcaggacactgcaaaaatagaaaaaaagtatgacatgaatagtggtagcactctttctaggagattttctgcactaaaagaattggccgctgctactactctttctaatatgtattgatggcacaaattgtctgcggctactgttattttgtatatatggttggaaaatatcgcctatggttgaaacaaatatattctggatgtcatcacttcatatttgtgtacaagtctgctcatgtgtgatattttggtggattgaattttcaggattttcagtgcatgcagcagtcgtggatactgttttactgtgtactctgaaactacgtggttcagtgttgggtagggatcatcgaattttcctcagttagagcatactaacacaagttgaaccaatttcagatcgaactatctccaagcatcagtatattgtaggaattgtgtgcatcagtatttcctagaaatagcaagtggttcagcatggcctgcaaactaggttatggaaaacaaggaacaagtttattttcggaatcaagcttactttcaaaaacaagtttcaatttcaccaacaagaagcagaaatcaatgcacactttgcgtgtttatccattcagataccatacagtaacaatcagtatatcacagtcaagcttatatagaggctggcttcattttcaacattcaggtacagagcattcagatggcatcattcattcttacattgcagttatacacatccatgctaccgaaaggactgttgttgccaaacaaattaccaagctatttccggtcagactatttgcagaagctaaggctttaaccattgcagaaagcatataacagttcacaactggagcaaagaaaccaatatgcgatacgcagccaaactcagttcacaacctgtctccacgacttctttgtgcaagctagcattggtttcccaacaaatgcttcaccaagtgctttgctcagttaagaaaagagaaaaattcagttgctgatgttagtgttagcggcagaacatatttgactgctgatgttatcatgttattgttaactgcagaagcagcagtgagtagtactagttttcattcgagacggaaatcccctttgttttaaactcgatcagtgtttactcttttccccgagcgagaaaaaacggaaaatatgtattactagattttgcaaatcaaacatcttaagaaattatttgaagtgaacagtgcaatgtagacaattgcgtcgtttcatgtcgcgtatgagcatatcatttcatgttgaacaaatttgcagttgtggtcagccaaacttgagatgatacggaaaatacactgtacgaaatacgaagtgaatgttaatgaaggcaaacaaacaaaatgccactgtcaaaagccaaaacattaagataattttcaacctcaacactgaaaccacagaacatgctttcaaccatcaggttactctgttaccaacttgtagtcataatgttcgcaccaggtggctgctttcctcctctaaataatctcttggatagaaaatgctcccaagactccggtgcattcttttccaagtagggacaaaaaaaaatgaaaccacagaacatgctttcaaccatcaggttactctgttaccaacttgtagtcataatgttcgcaccaggtggctgctttcctcctctaaataatctcttggatagaaaatgctcccaagactccggtgcattcttttccaagtagggacaaaaaaaaatgttgttacaaaacttatacaatctttttcagccaacatgcaaaaagaacagctgacttcacaaaaaaaaaacatagtagacattagatacatcagcggggggcagagagagagagagagagagagagagagagagagagagagagagagagagagagagagagagagattgagaagaggtttctatcatcagtataaattatatgaaactatttgttgaaaattgcttgcactgaactgagaggatcacatcgtacagcagcataagttcgaagtgttaggctcttccatcccaaatagcgaatgcatgtttggcaatgactgatccaattgagaaagaaatagcaagagaagagaagacctactctatatgagagctttgataccaacttgctggatctcacgcaaccgccaaaccgggtaatatgactcttcctctggcacctcatcactatccatcagttgcatggcccatgcataaaagacggtttggatggtgtcctaccagaatttcaagcaaaacaaaacgataaaagtattagtttatttgttacaaaatatgggctatgctccacctttgaattaaaagaacctaataagagcaaagcattattccctaacaatgttttctaaaggcaaccatatggttcattatatattttttagaaattcataggatcctacccaaaaattccatgacctacttggttctatagaaatgaaataaacatttatgctatttaatagtagaccgtctatttaatggtagactgtacaggtccaacctcccattcaggtttataataagaaactactatttaacaactctagctacatgattagctgtgtaatcttgaaaaaagataattaatggtgcatgctcctggtgtaaaagatatttacccctggagaatattgccatgagttttgcaagattaaattaccaaatgggcaaaaattcatttagttaaattctatcaagcaaggagctggtatgagagtgtaatcaataaggccgttgagctaacaacaaagctaccatctatcagattaatgcacaagtcaatagaaagaaaaacattagtacaacaaaagcagcatatagccctatggatagcctacctgccctccttctgttacttgtccttccctatcacgaacacagtaaatttgctgtgtttggaactgaaacacattttcagaaaagtatatgtaagcagaataaacaacaaaaatgacacatttaaaatttaaaatgacacttagccaattacccctacaataatgatgggcgtagatcccatcatttttgtttctcttacatcagcatctgaaatatgcaaaatctgcaaggcaacagaaaatcatatctttaatggggttatatagtccagctttagttccttttatggggtcatatagtccagcttacaagcaacaaataatagctcacatgaatgaatccaaatctacagaatggggcttaaattgactaaatactaaggaaggcatatgtttaatctgtagtttacaaaaagaaaactgcaggacagggaatgttgccaaatataggacagaagaagtgcctactttgtgatcgaaaaatatgccctgtgatgcataagcatctctctctcctttgcagcgttcaatcacttccttggtgcaatacttttttaaggtcttcacatcaccctgaaagcataatgtgtagtcttgagataattagattgtttaatataatatcagacaatatctattaaaaagcattaaagcaagttaattgaccgcttcaaactcacgcggatagttttatatcagactcgttagttttcataattccactacatcattaggaccttcaaccacacaatcatgctagttcaataatgagaatttatcttggtaagatggatgctaccttggaatatgcagtaagaacaggtttaatcatttcttgaacatcaccagcaaaatcaggcaaagaaaaggatctgtgcacaaaatggtgacatagttcagatatatcctaaaattatcaaactgtgagttgcatatattcttgaacatcttacgggtctctctgccgaatttccctgaaagacactgcagttgcggtttcctcaaaaatagattcattcaaactgcaaggaatgaacaaagacaaatcaacagaacatcacaagttgatatattctgaatatgaccaaacaaagagaaaatatattaactaattgcaactgtaagaaagagattattgcatttagttttcatgtatcatcaatgatattctgtttatttggaaaccatatgtactttttatacagaacataatgtgttaagttttcatcaattcatgtatcaccaatgatattctgtttattttggcaaccatatgtatttttttatacagaacataatgtgctaaatcataaaacaaataaataacatagcataactctgtttgaaataaatcagaatcaacaatagcacaaataatggagttcaattactcttgaattttctgaaccactggattgtcacttgtctcccaccgctctcgtacatcctcagctacctgtacaaatgtaaaacatcactggtacaggaaaaactgcattccaccagtttcatgaaacaaaattgtacagaattccgatggtacctcttgtcctatgttgacgactggtttggtatattcattcactctcttataggctggatgacctcgcatcttaatagagaaaaaaaggtttcagatggaagattaaagtagaaaaaaaggagatgaatgttcaggggtcccctttagtaccttattcttaaatgcttcccacttttcacccagtactgatttctttgttggtacaataactaactcagttcgagtactcttttcaactgttccagcagaagcatgcctggcatgatttctcttctttctgctagagctagagcttagctcatctttgaaaatttcatatccctgcttagcataagttgagactctagtatccctcaactttgcaaatgcaccagacagcacaggtgaagcagatgaaagtgttgacctcagtttattaaacaatgtatagccacttgtgccagcttgtgacttgtcatctgaatgtgacgatgtctcagagtactcatgtttcgaagtttcaggtgagccatccttacaacttgaagtatcttcttttcctagtctaaaactctcctttacctatcaatagatcccaacaaagcaaggaaactccatgtaaaaaacagtaagttacatactggactgatgtgagatcgccataatgatttatcactaacctcttctgtagcggcagacattttttctttcacatttgcagtaacctacaataaagccaaattcctaagcatgaaatggaacaaataaagtaataggacatgtttttctagaccaaactatcatacaagaagggccactgtaggtgacatacctttttagatgttgcctcagcttcagtcaaaacatcatcaacgctcttgtaaattgtctcagctgtttgcttagtcctgcagaagttattttatgatatcttcaagtaagcctatgagaaaaactggaatttcttacataaagaagaatataccgataaacatccacatgtacaagactcaaaatggaacaagtgcattgcttttattaaattataccttactttaagatcttcttttaccccactaagtttctcactgaattccttcatggatttctggaactcaggattactgcagccaaaaaacaggaataagtaagaagtgctgataagattaaggtgattcccgagtaaacagctgaaggccaaatatctaatactccttccattccaaaatgttcgtttagaactctagcattcttctctaaatataactcactacagcacatttaggcacttatttcctctcgtgtgcttgttaattgcatgatgcctgcctcatgaaaaaagttaggtatcttttccaatgttttagtaacaaggaaaaatgctcccatgccccctgaaaattttactcaatccactatttaaccaccatgttccactgacatctgggtccacagccaacatgccagagaaatattaagggacaagaagggatatcacaatttttttcacaaacactttgttaattcctgtgcaaaagtcaacatgatctacaattggaatgagtggaaatatcaattgtcatattaaggctaacctcttagcctcccccttcaattgttttgagaactcattaaagacacttagattccgattattcaaatgcctatatccagtaactccttgcaccctgacacttgctgcctgcacacatgataagggagacggcaatcagtaaactgtatgcataaatactccctccatctacttttgatagtcatatttccaaatctgaaaaatttatttttgataggcatattacaatccaacaacttatcatcttaatggctttcttggatttaatgcgtgactcttcattcttccacacaagattggctacataggcatcgagaaatgtaaatattaatgaatcacttgtttacgaggaatgagtagtagtatatttaaatggatgataagtataatcccttatccttggtctatgtgccaagatgaaatatgactatcaaaagtagatggagggagtataacgcaaggaataaagttgaaataacataagcaccacatagtgaataatatatccacagacatccctcaattcattttattaaagaaaagaataaagcatcaaaatacttttagaagtatattacactgattggaagccattatttattccatgtttacagaataatgtttatctactcaacggaaatcttaaccaagttcaataataaaggcaagctctttgctaatgcaaatgcataagcagcaagtaattatttctatctctccgagagatttagttcaagactgctatgctgtgacagcataccagtctcaaaataaaactccggcattctaagctacacgcacaaagtgttgaagtgatatgccatatacagctcaaccaaagctacatccttgttgttcgtgcatcattccccggtgatattttgaaggattatatatgttaactaacatttctccttcaacaatttcgattgagatcagttatagctaactttctctttgggattctcaggcgtatttttcttccaaataattcatatgaacatttaatatccttttatgtgctcgacatattcttcatatgattactaagatactgaactaaaggtgcacaaaaaccgattgaaaagtacccattttcctcagatcaaaattccattgtcagccaacaaacagaatttttcctctcattccacagcgttctaaatgttgaattttcaacagatggaccagagcgaatgaagaaaaaaaatacagtaacataggcaaaccaagccacaatttatagtatctcgctcagtatactaaatcaacaatttttattccaacctcattattctcctatgcccccaacatcgatgaacaacaaaaacgaacccgaacaagttggctggcgctccaatcttcgcaccgcaataataatagtacagcccccccgcgcctcctcgaaggcgcttcgcggacccaaaaaaaaaatcaaagaaacagcataataataagaagaatcacactcaccaatcgcagcgcggcttccgacgagggccgcctcagagcccggagcagcgccgaggtcgccatcgctggagggggaacggaaggaagcggcggggggcttcggcgaggctcgcagggcgggggaggtggcggcgcccgggcgggggggaggggaggagaggcgggcgggagggggagaggggagaggggagaaagactaaggcggccctaggatttttttacacgagggataggttagcctggtgtttggatgaaggccgaggctggaggctggaggctggccgggagagcctgggatagggaacggaacggaacgggcggcgaacgactacatgtctagggttcgcagcggatgaagcccgggggacggggggagggtggtcggctccggggctttcctttcttttttctcaagacaagagttttgcaggggacttccccattggaaaccgatgcaagaaactctaattaaaattaaaggttcataaaatcgagctaatcagacaagtatcacagatggtactataataaacatttggtgttataaaatggcactcttatcttctagtaaatttttttgttggttctcttccatgttccaaaatattataacgtcgaccatatgcaaaatttgttcaaactagatatagaaaataatttctcatattattacaaatccattaaaactagcatttgagttgaaaactaaaaaaatcatgataaacagttcaatggcccatgcctatacagtagatttgggggagggatccttgtggaccaaagtcgaagctcctccaaggagcacctggatcactccatgaatatctcattgcaagacaatataataaagagtaaatttcataaaactacatgttttatggttcaagttacagaaaagcacacacattttgacactcgacacttaagtacatatattttggtagtttagtttcacaaaaccacactatcaatgaatggattcacccgtgagatgatgtggttgttccatctaggataaggatgtggcatcctattaatttcatgcgatggctgataataggatgccatgtcctcgtcctaggtgaaacagccacgtcatctcgcgggtgaatccatttatcaatagtgtggttttgtgaaattacacaaccaaaatatatgtacttaagtgccaactgtcaaagtatgtgtggttttctgcaacttggactacaaaacgtgtagttttatgaaatttactctataataaaagattatacttctttaatgactcaaactatacaacaactaatcaaaacatcaatatagctccgtccatcagaattttttgagtcccctttttaacatagtatcatctctaaatttcatctgactcgggtgtgattgcggaaaaaatatgttgtttcacctatcatgaatctttgggcttgtaacttcgtatagaagctcagcctaagtagggttcatattgtgtgtgcctaacctagtggagcatggctctagaaaaccttaatcgtccttccactttcgaaatagttaggtaccccttcaacttctcttggtttttgttatattaaaatttagccattactactttatcttattattatgtgtgatagctatactgttcaattacttatcttcggaacccacctttcaagtatccgatttatcatgggctttattcctatttgcacttttgttttttttaatcttgttttgtttttcttgtttagcgatttgcttgcaggaataaggttgatctgcaccgacaatatcaacaatacacaaagaggtatatcgaccgctaagacgcaacacaacaccatctcgcgcggttgtagttgagttgctaacttctctcctaaatcatgattatctcaactcatggaaagatcatgccactattgctcatatcacaagagtttcatcgagaattagaaccaaaaattattttttatttagttttaaattgtgttgaaaatgttgtacaaatttcattaaactaaatttgaaaatatatttatttaaaaattttaaattgtagtcgaataattccatcccctttgtttttttacgagtgactttttttcacttgagaatagtgttctctcgcaagtatgagaaaggggcaacatagtcattttgaaaaaaaaagatgaactaatataataggtatagaagggattaaaatgagaactcaaaggcatgcataaggatgagacaaaatttagagatatagaagaaattgagacaaaactccgggacacaaaaatttctcagaagaaagttggtgagagtgagactagtctccttttagcttggggcactagggtgcaacctgatgggtgtccagtgctcctctttttttaaaaacggatttgctatactgctgtcgacagttaacagggggtgaaaactttcaaattttaagccatctaatatgctttgagatttgtgctggtgaaggaaaacggtttaaaaaattcagacgcgtgcagtagggatcgaacccaacaacctccaacttcgagttttgttcacctaaccactttccctatcgtgcttttttgagttacactcgagttacatattagttatatagtagttacatagtaggtacaatgtaatagtagttacaatgtaattacatagtagttatatttgaaagtatttcatcccaaaaactgtcgacagttgtatagctactcccttaagaaaacatgggataaatctggcctctacatataatcggatgtacatagccaagggtgtctagtgatgccttccaactgggagtaataaacaaataaataaaaggaaactcaactcccagacattttcttatttctatatttacagcaggttgtcgatttctttatgaattgccagaggacgctagtgatctaatggtttctttcgtcatgagttaaaagacctggattttgtaatgtactctacccaaatatttttggttaattggattcatgccattgtaaatataccatattaaaaaatgccactactattcgcgatatcggttaagtgccaccataatttaggaaaattggaaccataccactacatcacggtatcggtcaaaaatctccgatagctctaactgtatgtgggacctagctgtcagttccatcttcttcacctccctctcctctcttctctttccccttcctctctccaatctatctcttcggcactcctcatcctctaccaccgtcgccgccgccattgtcgatctcctcccaccatggacgagagggctcgggagccaccaccgtcgtcatcgaccacctcccatccacgtcgaaagggaacgggagccaccgctattgctgtcgtcatcgtcgacctcctcccagccatagtgggagggctcaggagccaccgccatcggcgacctcctcacatccatggcggaagggttcgaaagccacggccgtcgccgcggtcgtcatcgacctcttcccatccattgcgggaggactcaggagccagcgtccttccaatttttcctctttgtcggtggcggcgtcttcccatatcctcctcttcgtcggtggctgtgacaagggctaaaggctgcgccggcgagctcctttatcaagcggtagccctggatggcaagccgatccccggagcggtggccccagctcatcatggacgaggttggcatccatatctggtggggggggagttagcaacctcgatgccttcccacttcctcaaatggtgctagaggccagctgcgcatgttcagcaccaaggattccacctccaagccgtcgagcgtcgtcaagctgaagagatgggcatggtctatgccattgctgccaacctcctcccttccacggcaggagccaccgctgtcaccgtcaacctcctccagtccacagcaatccaccaccaccaactgtgtcatttgcaccgaccagccaagagagaaagagggatggagggagacagagttgacagaatatttgacggcaatggcatggttccaatttccctaaattccagtggcacgtagccgatatcgcgagtagtagtgacatttttctatgagtaaattgcacccacggtacaacaacttggcaggtgggtgcgatatagtgcaacaacttgagaattgagcgttcgagtgcatcaacgtggcgaggcatatgctaggtgagttttttttttcccgatatcaataatgccattacatagcaatcctacggatattacctcagatattaaatttaatctttaataattgtattgctcatacagtttacatccaattaccttaagattttttttgttttctttaccttctcaaatatcaaccgaaatataataatttttacatcaagtttaattgacttcaagttattaattattataataaaaaatataaatatgcttatacaaatccacactagtatattgtcaaaaataattacttaaattgaatctatatagaaaatgatccaaataattaagttgtcgcatactttcttagtttattgtatcaaaatcgcacctaccttacaagttacaagttgttacttgttacatttatatgatcacttataaagttcttatactaaattgcacatattagttgttacttgttacatttatatgatcacttataaaattcttatactaaattgcacatatttgccaagttgttgtactagaacactcatttctcaagttcttgcaccaaattgcacccacctgctaaggtgatgcaccgtgggtgcaatttactctttttctaatatggcatatttgcaatagcatgtatccaattaacccaatattttttttgaagctgaattctacccaaatatgaggggggagggatgaataggtcatccttcacacaaacgtatgcaagacaacgtttaatttctcgaggcacatctacagattagctggctagcttcagtcctacatgtccatattaatttacatcaagagcttttctggcaacaattttgattacacgtgtcgatgaaaaatattacaacaatgactgccctttgttcacttttgtgaagtgtgcacagctatgaaaagctacgatctgtgaacactcctcggagtttgtacattgcgtgaactcatgcttgcagttttcaggagcctgcgaaattcatctaggcttatttttccatctctgtcaatgtcagcctcctccaggaggggatcaatagaacctttcagtcctgtttgctgcagacaatgtaagaatacatatatgagaagcatgaactggttgaataaattacgatcttatgctatgcaccaattaaggattggaatcttataggaaataaatcaattctcacgtgaataggaaaagagtaatgtttcacaggtatttgaagaggtgtaccattctcagttcatcagatgtgatatagccatctccgtcaacatcaaatttatcaaatgcagcttgagacaatgatttccacttctcagtatcatgttccactagctgatgcacatgtaatgttgcagcaacaaactcttcgaaatcaactaatccatctgtgttactgtcaatctgcccagcaatgaaaatctttatgccatgatagcaaatactcccctttgcaaggagaaaacttgatgatgtccgttcaattgcatacatgcaaatttaatagaaacaatggaacttgaaacattgcatctggaactataatttaaaacttactacaaagctatatttgaggatcatcagtaaaacaacatcaagcattgtcataagagtcatagagagggaagtggatgcatttgcttagtcaaagaacaaaaaggcagagaggaatatatttactcagtttcaatactgttatctattattaaacagtaccatttaggcatcttaactcatttgacctaaaaccccccacatcatctcgaaatagctagaataagtatacaactactccaatcttctatatcttcagcactaaataataaaatatatgaaatccatataatttttatcatctcttaccctagctgccttggaaaaatactattactatatactaaaacatggaagatgacttcactctcaaaagctgtcaaggatgggacagtgaaattttgaaaatgcaaactatttgcataacgtcattaaatgttttagaaagatttaacacttcattgcaattgcacatagttccaaccaagtgaccacaagaaagcatgtgaatctgagaccgataatagataatgttactacggtaaattataagaatgagaacatactgcctcaacaatctctaaaacacgtggaccctttaatctccatggaacatcctttgcaagagcctgcaaattagtgttgacatcatatagtgatagctaataagacagatgacttataatgtgaggtaaaaaattgacactgccgaagttccgcatgtcatatgtataagagaaggtacaacatagaatttgtttctttgatatgtgtataagagcaaatatatggtacttcttcaaagaaaaagaagcatgtttccaattctttgaatacaagttaaaaagaaaatttcataatcaaaatgtctatgcatcaatgactaccaaaagaactttgatggtgcagctgtggtcatcaggatgctttccttaatgaacaaaagagctttatcgcacatctttcactagggagagtaacaaatagtagttataatctctagcacttaacagaagatatcattaaatctacctgacttacaaacaattaccaattgaaaattttagaatagttcagaataattgagaaaacagaaacattttttgtggtgtgatttcttgagaaatgtacaaaagtaaaattttaagaaaaatctgatgctttgtcatggtggaccagcatgggacataactatgtaaatggattttgtaaacaccctttcattcaatagttagaatgcatgtgtatatgatttgttgagttagaacagcagtatttgattccatagttgcaaaatagccccaaaagagttccagccaacttatatataagcttgtgctgaaaccttaatatttattttttcaaaggatttataaatattttttcttattttctgatttactgaataattgagtattatttgctttaatagggagctttaggtttttccatgtattaatgtttctttacaagtttgtacccccatctccaaaatcctgcatcagccactggggtttgtacaatttaacaatggcaatccctaaacagttttgccattatatacttcttacattatcctatggttttccctattttcatttttctacatttccagtatttgtttccaaacggacagaatgttggcatgagggaagtggcagaatggaagagagcttggtcagaacagtggcccaaaaataagatgaagagaaattacaaagaaatgtattccatggattatgctaaatattagtaaaaaaaaacaagccaatagtgtagcgaggaattccaacaaggatgtacctgcttcagttcttccagactaattgttccattcttgtcaacatcaatggcattgaactggtcacgaagatcagacaactcttctgcatttagtgtagaagctaacgcctacaagagatgtaaacatttaaaattgactccgaaatcatcctgagtcatggataagattcccttaagttatggtatgataacttacccgtaaagcaaattgcttaaaccgactgtattttacaaactgacgcatattatgtaatacagatatatctagaggtatatcagatgcctgtcctccttctctcacccattcatgtgctgaagaaaataatatgtaaattttcatgttagtagagcactgtgataataagattgtttatttttataccaacagtatgccatctgtgataactgataaataaccaactgaacagcaaatgttagttgctatgatgtaatgaaaacatgaattagttggtattggttatgtatcaatattagattgtaccaagccttagtaactgaaccaaccatgtctaaccatgaaaaaacaacataagatgtttctatcaaattcaaggtataagctgttattttacgcatggtaatcagaaagtgctaccatatacatagcaataacttaacaatcaaatcgataaaaggcaatggaggtctgaatttcatgagtagcaagcatagccacatggcttcaaataacaagccaaagctgaacccccagcagaagttaaacaaataagtattaagctaacagggagtatgcactgcaaacccattaatgatcgctgagtaagcctttgaggttggaccctcatacataagtttccaacctgaaggggcccttcataaatccccttagatatatcccatctaagagtcacccagtaatcaagttgtgaatttgcatgactgcactcagacttagcaacagtttgccactagaatcccattattaaataaccagatttgcaaacttgcattcaagatgtcccaaaatgatatagagtttccctaatcagattatcatacttaaatttaagacatccaaaaatgatataaagttacatacataatgcctgagcagcagttaatcttgcacggggatccttaacaagcaacttttgtacaaagtctttagcacaaggagtgatatttggccagggcttgcgacgaaaatctggcttgtttttcaacacctgcaccaaaaagaatatgccactttgttagcattgtggaaagagaagcggggaacagaggatggacacgatttgagacaaggtcagtaattccaacatgatacccaaagagaaacataaatataagcagccaccagggtagcggctacccaagatatacatatttttctttatgcacaggcacagctaatgttccatagactgcaggcttagctccatataggtttaggtaaggagagagggtgaatcatgtagattgactccacatagatcctcctatgctagcatttgtacacattacgatacttgttctaagatagttcactcggttcatccatggatgcgtgcttttctggatagcatataaacttgttgacgcttgtggtaagctatttcccaagtatataatcagtgtaaatctacacgcctgatattgtgccaatggcaaactcgtatgctatgaagtgcactgcatagcaaggtattttcatcttttcaacaagttggatcatatttttcagatttgtcatgacacagatcactagatcagatatacttgagcataaatcctgagaagataaagagttagtcttttttatctaaaaaaggggaaagtctatctttggtctgtcaactcttcatgtaggtcaatttttgtctctcaagtcaactctaagacaacttgtcactcaacaattgaaatcatgcaaataatgtccctatgattgtttctcaagtggttttaagtgaggtggctttccacatcattctgttttgccatgtcatttgccacatcatctagacccatgtgctgatccttcctcttcctttttggacaagatgaagagccacttaactgaaacataccagcctaagattctgaatttccttaaaacagaccagaagtattttaagaataacatgcgcacttccttggaagtatggactactaaaagttagaacgatatcaaagtaatacggataatacggcaacatcgaaggaaaaaaagaagaaaatatagtgattgtaaggcaagaaaatagttttaatcaatgaaacacatgtaataaaatggttgtaagacaaagatagtttaggcaaaatgacctctttaaatattccatcttcagttttgtcccagaaaggtcgtcttccacacagtagaatataggttattacgccaatactccaaacgtcagattctgggcctgacttacgcttaagcacttctggtgctacatagtaggcacttccaacaatgtcacgaaagtgtttccctgtgagtgcggcaacttaatttcaattacactgagaataatttctttattgagaaaattctttatatttgccctcaaaagttagtcgtatccttcatttgcccatgcggaactgctcaacccctcatgcccatctttctcaactttgtttctatatttgcccctcgtattacttctccattagtttgctacttgaattatgtgtgaagtacttttttaccttctaatgccttctcaactggaagcaaggacaattatctcttcttttttagtcttcctatttctaatgttgtcattaataaaaaaaaccaatatctttttaacatgtagagagtataactttagcatgttagtttttttataaatgcatagtaaaatagctgtttttctttttaattggctcgggcctaaatacctttttctatgtctgctactaaaatttgtaaatagttttgtcattttctatgcctgcagacttggttctctaaaaagaatgtatgttctaataaaagatggcgatcaagttttactactacttataattatcaacatttttttatgcacatggatcggtgaatgccctttttacattgacaaggaattagaagggattaacatagaaaatataataagccatacctctaatagaataggaattactagaagggtaaaaaggtttagtttcgggagagcaaataagggatatggctaacttacaaggccaaatagagatttttctcttttatatttcatatggaatggaagaaagttaaacaagaaaacaatagaacaagtagttacaacatacacacaaacctggtcttataaaatctgaaagaccaaaatctgtagccttgagggatgagtcctctttggttgatttgaagaggaagttctgtaaatacacatatcaaatgatcaattactcttataagaagacttagtcttgtacttttagagcatacctcaggcttcatgtcccgatgaaccaaaccatgcaaatggcactcagcagcaaccttgagcatttgccgcacaactactgcagcatctttctcgctataacggctatctttcctgtaagagcagaacaaatgtgatatcagtgaatttgctttctacatacatcaaatattcaaacgaacttaataataaataaaaatctttgaacattcagtcgaaaaaaaatctttgaacaattcctgacagttgatggctagtggatgtctcacataaacttatgtcaatccctgtaatattttggttttatggtaataggaaaacaatatatgactatatgccatacatccatattaaattccaagctctttgtggcacgaagcactaattgaaatgctctccggttcaacatccctatatttagaataagtaatcccaacacaaccaaaaaagcatgccacagttctgtggtaaagtaaaaatttttgacaaacttcaaaaattgacttacttggctagtatccggtcaagtaactccccgccttcacataatctgtcaaatacatgtaacagggtcagatcttcattagcttgcacagttccttgatacaaagagaacaaagatgagaaacatgaaagtgtttgccaactatttatcctgaacttgatatttacccggtacaatttctagatttttacgagggtattaatattatgccagtttgcatgtggtgtttcttttccatgtaattagatcctgaattgccaaagtcctgtttggaggggcacaaactaaaatactagacctcagtaagatcaattacttaaaatatgggtggtttctaaaaaaaagcataaacacacatatgaaccttccttcaacttggctaaggccatgaaaagttcacttagacattttatggttatacttagatatacttctactgatttcataaacatttgagagtttttccatgacttactccataacaatatacacataattatcatcttcaaatgcattgtaaaaatgtacaacattttcatggccttgtaaggccttcagtattttaacttctcgctttacgtcttcaacggcaacaggaagaaccatctgcaacgaaaacatcccatttgagaagttagagcagtatcatttcttttcaaaatagaggctagttctctacttctgttgatgcttcaattcagcatagcacatgctgacaaggctttacaataatgcagagtccagaaaatcagtgcgtcctattttctgaatacacatattacatttctctgctcatgaatttatgaccttcatgtacaggagaagtagggtcatatacgaatgtgttacgtttcagtacatatcagtgtctttcaggaattgccttgccgtatctgttaggaggcatttgtgcagtctttatactggttttggaactaaacaaatttgtatacgccacatgtgtccattacgtatgtgtatagtccattatccacttgttgcctccatcctgactggttcctattttgctcaagaatgaagatttaaacatcccaaaatagtttggtattttggtttgaggattgagatgtccattgaccacttgatccaaaatagtttccttggtttgaggaatggacctcatccctgaaaagtacatatactgagtgaagaaatgaggaatggagtcatcccaccagattcgatggtttagatggatcacctccatggcaatctgcaagttgcgctagtactaacatgcagcagcattaggtagtggcagtgcatttttgatttgtaccactaccactacagtatcgccccggattcacatttcacatttcctcggcaacccaaccccacgtgcaaaacgcgacgccccccgcaaaggtggtcgtcgtccaggctagcccaactggccgatcgaatcgagcaacacatgggcacatggcccccacgcgtcagccgcacaccaccacgctcgtttgggcccataccttgttcttgtcgatgcgcttgacggcgacgcgctcgctggagcggcggtcgacggcggcgaaggtgtagccgaactggccgtggcccagcagcttcccgagcgcgtaccgcgcctcgaagtccttgtcgtacccgaagtccgtccgcttcccgcacgccacgatccccttcctccccgcgttatccttgttccccgcgccgttaccgccgccgggtgtgccggcgtcccggcgggcgctggaggaggagcagagtcccatcgtcgtcggctgcggcggaggcggcggatccaactattaccatcaatgtggcggcggcgcgaggctgccggaatcgggagcagcgaagcgaagggggaggggtgttgggaattggggtcaaagcagagcagagagagagagaggagaggagtgaggagacctcaccgatgtcgtcgtcgccttcttcctttttaataatataagggtaataagaaatggtgggaccaaaggggcgtgaatcctttaccgcgcttggcggtcttatgctgatgacacgtgggggccagtggatgtgggtcctacgagacggtgggggagtgggtggggctgacggtggggtagctttggatgtgggggtgacgacgtgacgtggtggtggtgggaaatgggcaggaaaaggcacaggacgcgaactggtccggcggccacacgcggccacgcgggggtagtagttttctaactctccgtaaaaaaaaaaaaaagacaaacctaatttccgtacccaacgtttaaccattcatcttatttaaaaaaattataaaaaaaaattaaaaatataagtcacgcataaagtattaatcatattttatcatctaacaataataaaaatactaattataaaaaaatttcatataaaacggacagtcaaacgttggcacggaaacccagagtttgcctttttttttggaacggaaggagtagttgagtaatatattttgcagatataccctccaatgttgcaattttaagggaaatgagcctcctgtggtattcttattttttttcataaaaagacaattgaccatgcaattgtaatgataagctctgtaccacctgataagctttgagcttcctcgatatgctcatagctacgattaattcaatatttcggtaagttgataataactacaatttgagagaaaagttaatgacccgactacaactgtacgaggagttgttgtgttgcgccttagcgatcgccacatctctccgtggattgttgatcttgcgggtgtagatcaaccttatttatacaagcaaatcgaaaaaacaagtaaaaaataaaaataatctgatattgcaaataggaattaaatatacatgataagttgggtctcgtagcgagaaaacaatgatctaaccgatcacggctttatctagaaaagtagcaatagctagactttaattaaaaaaactcaaaaaccctgaaggggtacatagctatttaagttgatgggaggatgaccaaggagtccctagggacgtgctacactagcttgggatgcatcccacttgggatccacttagaccggggtcacaaacaaagttataagtccagagacctatgacgggtggcacaactctttatttcttcaactgcaaatgatcgaggtggactttgaagatgagctggatccgttggaaagagaactccaagagcttttcatcaagtactcatggatccagcacagagctcgtatggacatttggtggccgtttgaagtcaatactactgcaggtgaccgaatctaatttcggaacatgaacggcggtttgatctctttgacctttaatatgaacactgctagtattcatattcgtagtaattatcatcacatcatgtaaacttttggatttagcatggtatggtgagtaatatgaaatattcataacatgttcacaaatcaattgtctctttgtttagtcggaatagtaatatataatttcttttcatgtgcttaaaatccaaccttccaaggggacagtacggattcaccatgtttaattgcatgtgtgtttaactgaaagttgtgatcgacgtattttgcatatgttatttttccggtgtcactttgtttgctgttaattttcattttccatgtttggttgatcttgttattggtattgctactaggctaaggtcctgattgggggagtttatgcttctaagaagcaactatttattagttagcttttgagaatcacctagcatctcgattctagtttattttctacattttataactatagttctcagaatcagaataaaaaggtagactctttggaggagtttttgattttgaaagcagctatggcgtcgtgtgcccctaattaattacaagctatatatatggtcttacccttaccaactaaattaccttgcatttttgtaatagcactccccaaatgtatcactaaccattgtcatatgcatttttgtaatagcactcccctatcaatagccattgtcatgtgcacaccgactctatgtaaaattcattattaggtgtggtttaccatgtaaatcacggcataaaaagttatttggggaatttaaaaaataacacttatataaatatataactaagacgatactacataaaaatgacaaaacagtgaagaaggagatagaaaaaaaaaggaattgtgttttttcttcgttgtgttttaattttctaccattgtcctagaattttatatatatgattatttttaagtttctactatatattttccttaccaacttaacatttttctacatatgcaggagagatgggaaaccaagattctcttttaataaatgggcaagatcgagggggcttatttcgcgaccgatcatatgcagtggaagctagcgaacaccttatccacatcttatgccttccacccaccatagattgattcatcgagtattcctccacatctcacgcctcaaccacgcaatgtcgcctctgcccctcacgtcgtctcttctccttgatgcatcaacgagcaacagtgcgcaccatcatcctcactaacgcgccgagccctccactccccctcccctatttcttctcttccctagcaaggcagatggtgtatgcatggcaaaggccgtcagcgccggtgcagcgaatggcgaagtgggtgccttgttgcggttgcgagcgttggtgacgatggggttggaggtgggctattgccctcgggtgagctgcacggttccatgctaagttgaatgttgatgatttggagtaggattgtggaaagtttccaatttagagtgaatagttcctgagatattgagaatgcttgattttgaatatgaagttttttgagttttttaattggtttgaaatctcatgtctataaaagtttatctgtacccaaaagtttatggcttcatctctacaaaaatatgtatgtaaaagtttctataaaaaaaatcaaaagagagtttatgcaatggaagtttctagagagagttgatgcaacaaaagtttctcaggagaaaagtttatgcaataaaagtttctatacaaaaagttttgcaatgaaagtttattcttgttatggacgttctcaactctcttatggaccgggcagctcgggagggttggattcagactcttgatgttcggcaaatgtagcaaaggtgttctttttatgccgatgatgttattatgttttcaagaccaacggtgaatgatctctccattatcaagaatgttttggatatttttgtccatgcattgggcctaatgaccaacatgcaaaagagctcaataactccaattaggtgcaatgaagaagagttggaagtgatcgtgaatgtgttaccgtgtgagatcaaggattttccttgttcctatttgggtcttcctttaaatgttaagaaactgtctaagaccgacttgcatgctttggttgacaaggtagcggatgatctccccatgtggaaagcttccctcatgaatcggatcggtcgtctcatctcggtgcgggttgttctattcgccattcctatatatcttatgattgctatggatctaccaaagtgggttgcaaaagcaattgacaaaagaaggagggggtttctttggtcaggacaagaaaacaccaatggtggtaattgcttaatggcctaggatagagtgcgccgacctctagcttatggtggccttagtattcttaatttggaatatatgagttgggccctttggattggttggttatggctccaaaagatagacaatagtcgtgtttggcaaggattgctcgtccaagttccccgtgtttctcatgacctttttagttcggcggtgttgtcgcaaattgggaatgggcaatctaatttgttttgggtggacagatgggtgcatggaagaattattttggaaatggcccctaacttatgtgaattgaaaaggataatcaagcattgtacagtggctcaagcattggacaactaaaagtggatcatggacattagaggacctttgacggtgcaggtgcttgcagaatacatcaggatttgggaagcagtccatgagggtggtgctgcaagaaggaattctagaccagcactattggaagttctcaaagtcaggagtttacacttccaaatccgcatatgagaccttcttcatgggggcagtcaagtttgctccttggagaaggatttggaagagttgggcacatcttaaatgcaagtttcttcggtggctggcaatacacaactgttgttggacggctgatcatcttgccaagcgttacttgcctcatccagccgcttgcccctttgtgatcaagccaaggagacaatgcaacacattttggtttcttgtgttttcagcagacaaggtttgtcactagttctccaaaggcttggctatttctccactctaccgaaatcatgacacgcgcaagttttcgtgttggtggtcaaaggcagtaaagggttgcaaaagaacgagaaaaagggcttaactctcttattatcttagtcgcgtgggaaatctggaaacactaaaatgcttatgttttcaatggtgttactcctagcgtgacaagtgtggttctatccattagtaatgagggcacactatagtgtatggcaggagcttctaggttccaagagttgttggccaacacaatagctcttgtgccctaggaggaggggaggtgtgtttatgggtgtgtgtgtgtgtgttttccagtgggtgtgttggcgtgtttttgttttcgtaagtccgaccttttattctttgcttattgaaatgatacaatgatttcacgcgtgttcgaaaaaagtttatacatacaaagtttattatgcaataaaatttggtgataaatcgtattgtttagaattaaatcgaaatgcccctgaccacgtttcctaaaaacaaaaaaacaaacgatgcgtgacgaatcagggatttttgaaaaaaaaaacacctacgccaaaaagggaaacaggaaccgatcacgtgggcctaattccagtgaccgatcatcaggtagcattttcagagttaactagaaaaaatgcccgtacgttgcaacgggtaaactgaaattataataaatataaaaatattagacgattacggtttagtttttcatgatatgagccttcaaaaaaatatattccttagaaataaaaaagtgctaaaaaaagaaaaaaaaagaaaaggtccattggaccctatcggcctgctattgcgctccttgcccatgaagcatgcgtggcccagcagtgcggtggcccgagatggaggtcggcctgacgtgggatcgatctgtgccattcattttgatggacgggtcggatcgattctatatccatcaaaccgtcagtgctaaaaacactaaccctaatcacactttcccatcccattccaccatcgtgagaacctcctcccccttccctctctctgccgctcccgctcccccttcccttcccctcaccggcgtcgccagtccctctcctcctctccctcctgtcacgctggcgcggcgtgaagacgacgagggcacgactctattcacgagcggataaggagagagggggggcggagtgtggtggcttcccgtgggtagatccagcggaaccgacggcaccggtcgcttcctatggcttgatccggtggtggcggcgcctttctgcggtggatccgatggcgccgacggctccccgcggcggatccggcggctatccgtgtgtagatctggttcgcggaccgatccgccggcgatggtggcttcccacgtcggctacgacggcggcggcatatccggcggctacccgcgtgtagatccggtggcgtagtaccttgcccgtatgcggagctgatcctctccatcaaatctaaatcttttttgaccggttgaggggttttatccactcggtctagtctttctgttttttccaaaatcggaacggatccataaaatttgggattgggataaaaatggccagccgagcatcatcaaccaatgagattaaatccagtgaattaaaagaggaaatcgtgaaaaaaaaataataagagtggagtggggtatcgatttttacaatcaatgggaggagaaaacacaagaggaagtagcttgaagtacaagtgcgcaacagattggataagataaaaaccggatgaaaataccaacaaaaaaaacacgaaaaaaaacgaatcggaaaaaaagggaaaaacagcgggaaaaaacagagcgagaagccacgggaaaaactgaattgggcaaaaaagagacggacaaaaaaaacacgaaaatggaaaaaaaaagaaaaatagccaaaaaaatgaagcaaaaaattacgggaaaaactgaatcggaaaaaaaggacggacgaaaatttttttttacggaaaccttgtgtattttttagttaggtaaaaaccagatgaaaaaacaaaaaaaacacgaaaaaaacgaatcggaaaaaaaaaaagaaaacagcgggaaaaaacggagcgagaagccacgagaaaaaaatgaattgggcaaataaaaaagagagacggacaaaacaacacgaaaacggaaaaaaaagaaaaacagcgaaaaattacgggtaaaactgagtcagaaaaaaggacggacgaaaattttttttacagaaaccttgcatattttttaattaggtatagatatagacgtgaggagggcctaaagccacctaacatatagaaattcatgttatgccaacttatcgtgctaaccgacggatatggatttcttaactatttattttataaaattatacccataactattcaaaataacgtttatcaaaattcaaaattcaaattctccctacttttaaaagattacctaacagaaaattatttttcaagaccagacatgatataacatagaaattgctccttttggaaaacttaacatgtagcacataaatttgctctatttagaaaattatcattctcacatgtcaaacataattattcatgttgttttatagcaaagttcaactacaagattcgaaacaatacttgtttgtgtttttattggagggagcaaaacaaagatgcatagggagaaaatgtttgcttgcacagagcaattttctctttcttcaattggaacaataaaaaatgtttttagtacacacgtgcttaacaagggtgccaaatggaatcatagaaaaactaattgcagatttcactattttttaaccttttcgtattcaacaacgtgctgcaaaagaatgcaaagtactctatatgagccacattaggtgttaaccactgaaaaaaaaaactaaatataaagggatgttacatggggaatcatgaagctcgtgcttcgctacaaaaatcccattattgcttgcacttttgataaaattaagattggctatttatttgccataaaaaaaagcaagcaaagttaatcggtggcgaataaaaatgtatcaactcaatattttccgatcaaacctagatgtgcatatgattagaataaacacattattgctctctcttcatcttaatttgcagctacattaacacataatcataaaaatctttgaacaaattagtatagactgcttagagtcgctaaccacaagaattaagcagtgaagggaactattatctccgtcccaaaatataactacttttagctataaatctgaacacccacacccagttatcaaacccagttatcaagattcataactaaaaaatacttaaatataacaacttttagctataaatctaaacacctagttgtctaaattcatagctaaaaatacttatattttgagatagatggagtagcttatttggatccctactgcccatcacttgttaagaataacaaatgcatcgaccaaacaaacagacaatgcacgacctctttacaacgtacgggaaaatgatgatttggagaacacagcacatgttttattaacaacattcttttctttatttatgctagtataaaccagctttaacgtcagatatcaacgagatgaaggggccaaaggaaaacaagcacacaccaagcatcaaaatggattaagcaatgcatcatttactctgaacaattgtgaatttctcgttagaattttgcggagaaagggtataaaccaaactccccaagatttgcaacttattacctctgcgcctcttggttttgcacaaagatgaaaaaaaaagtaaaaagggggcaaatcgtataaaggctatcctgcatggtttcccgggaatttactctgctgtcaacgaacttgcggagtaaacccataaaaacgggctaaaagaaggcttgtaaattgatcctaattcccagtgtaactggaacgaaacaaacaggaaaaagaaaaattaatccaaaaaccaggtcatcctgcccttggctctgtgctcttggttttcaggtcctcctcgaaatcatgatggaaatatacaaaatgagacagcaccgttctgtgcatcattcgagaacaagggaagaatagttttgatgatctttagcttcacagtaacattgaggttggattctcgatatagcccttgaatgctttcagaaattctgccccgattgcacctagagtaagcgcacaagaacaaaagttaatttcttgcccatgatccatgaagccatcatttattccgataagatctaaagagtataccatcaataaccctgtgatcacagctcattgttgccgacatgaaggaaccaaactcgtattgaccattggcgctgccaggtatcaccctcctctcagctgcccaagcaaaaaagcagttgagttaaaaatgaatccctatgtacggactaaaacagcatgactaagtgaatgagcctgcctagcaaatagaatacattaacaaaaggcactactagcccttttacgaaaaacaactaaatactactataaacagctggtcctatgtgcatgacttctgagtttaagtactagatcagggacttggaaaatatacttttcaaaatacactaaaataatgcagataaatatataatgctacaattatttttacagagtaagctaagtggcaacgaattagtggaaacaaagtaaaagtgcaacatgacttattaccagaaccaatggccaagattgccgactgaggaggatttatgatggcacaaaattgcttaattccaaaaggacctcccaagtttgatatggtgaatgtgcctccctgaaaacaccacataaaagttctcatggaaaaatgctgttgtttcatgcaaaaattaactaccatacaatccatatacctcataatcatctggtttcaaactgttatcccttgctctttgagccaactgcttcacctcctccgcaatcataccaagtcctttcttgtctgcatcctgcaacaagcaaaagttagaaacattttcttacacagattagacaagtttagattactaaccctgattactggaacaaacagtccatgctcagtctgtacagcaacattgatgttcacgttgtggtatctgcatgcgaaatgaaattttcattatctcctttcttgccaaaactttagtcccaagatatgcctggtcagaacttactggcggataaaatcattcatccaggagctattacactgagggacctttcgaagagccagagctgcagcctgtacatcaaattaagataaattcagaattggaggtcagaagaaaatggacagtccacgaacataaataggctgaatctgcaacaatccagtggttggcacttggtagacataagaaaccacggtaacacgagaaactggtaattacctttataactagatcattaatagatatcttcttaccaccggaggactcctgcaatggattcagttcccctcgcaacctgcattagattaaaaaaaaagaactacttttaaaagaaaagctacaaaatccagagagatggactttgaaggtgatccatcacatatgtttcctacaaaatatagtgatttaataacacaattagcattcaacatacttgatgagattatcaacacgtgtgtcaactgtcaggtaataatgtggaattgtttgcttagagcttagcaggcggttcgcagtaacctggacagaattgaagttaaaacactatcagatcaataacatcgcataaaaaacgacttaacagaaagaacgtatgattgaaattacctttcttatttgtgcattgggaacatcggtgtaacttagccctggagccgcaagagcttcctttctgcaacccttagctacagaagtttgtttaagaaaaaaattatcaattgaattctcacagatagaataatagcataacacaaaataaatctggcaaatataaaggaaagcataaaaccacacatttgaacatacagagttcaagcaaattacattaataatatttcatttggatcaaccaggatggtgctactaaaacaacaaaattatttagaaattcaggcacacaggaacaagtaaactaacagagttgagtgaacaaagcaagcaaaaacagattttttttttcttctgataacttgatatatgggtgactggatgttcaaatcaagtgatcaaataccatacaccacaaaatggagtacataatacgcatcaacatatgtctgaatatgattactttagaatggataataagacagtaaagcacaaagatcagtggtacagcttaacattaagcaagaggattcagatcaccagtatactggtgctttcttatcattgacactaacagattgctattatgcaggaacctgaccagagaagggcagaaacaaggaattgcatgggaagaaagtagatttatataaggggagtgccatagtacatactagttacaaggaagttttaacatgttttcctcgcctaacatcttttccacttggccattaggattaaaattgaatggtgagagaagtatatataaagtgtgtattacagggacacagtcataaccaaaaacctaactgctcttgcgagtacaagtgcatgcatgattcaagtgttctataaaatccctagcaactgtaacacttcatatattaaacaagcaacgagcagcaaaggaaaaacatcacaataaaatttgacatcaagagttcatcaaattcagaactagcatgatatgtcaaaggagcacacattatagcttcaaagcgatcttgttaaatataaattaatataatggtcattgttgaattctaagttactcaactacaaaattctaaattcctatagagttcatcatttattttatttatttatttatttattttaattttattttattttttttgggggggggggggggaactataggagaaagtgacatacccaagtaatcttcaatgtctgccttcaaaatgcgcccatcaggaccagttccctttacactcgacagtggaacctgttttaggcagcacaatccttgtgttcattaagtatgttacaacaacagttggcaagtaacaacctagacagctaacatcagaaaacttacattgttatcttccgccaattttctagcaagagggctggagaatattcgatctcctgaccgcgaaggttcttcagtccttggggcctttagctcagatgctttggaaggctctctttcctccacctttggttctgtaggctcagactgagccttcagttcagaaggggctacaggtgcagccaaagttgaaggtttataatccttaaacttcttgatgtcaccctcttcttccacggttacagcaataatctaaaatgaatagcatggacataattcaaccaagattatgtcagcgaaacttaaagactgaggtatttgtaataactgtattagtaaacagaggataataaatgattgttcaaatatgtacctcaccaactttgatctctttggaaccatctccatgaatgatcttagcaagatagccctcttccatgcactccatttctacggtggctttatcctagtcagcagaaatgcattcaaaggatatttagattctcttgcagcttaaataaaagaaaataattgagcaccactaaaaataagtactaactaagatattgctgccttagagatcagaaaacttacagtctccacctcacaaagaacttcaccaggtgagaccttatctccttccttcttcagccaccttgcaatgttcccctacagacaatacaagtataaggtgtaatactaactagatgaataccccgccgcgttgctgcggaaaattaagttgcataatatgtacaaaactaaaacaatttgatacaattttgagcttgaaagtaattgagattgcatgtttttaagagagaagaaaaaagagacaatttggaccatagatctatcatccaaaggctagaaataattgtggtgatgtggcttaatgagagaagagagaaatagcattaactacacttagtggggatgaactatataagtatataggatacatgcaattcaaggaaaaacacaagaggacattatgatattcatgattcataataaaaaaaattggtgagatatacctcggtcattgtaggagagagtgatggcatccctatttcctgatgtggtggcaggtctggaataaagaaattatggcaaaacttaagaaataagacaattaacagagtgctatatggattatggaatcattgactggagttatgtactacctccatcccaaaataattgtaattctagtttgattagcatatattaagatttgagataaaagactatgatatccctcatcaaatggtgtatacataagagtgggaaggtaattaagggtaaaataggaataaatttgaatgagaagtgattatgggacaattagtactctattgtgacaactattttgggacaaatgtgaatcctagaaatacaattattatgggacggaggcagtagacaattttaacatagtaaccagagcaatgggaagatgtggactgaatttcaaatagacttttctttttgaagcggataaactagatgcttagatatcattaaaaaaagaaagttgttctgatttttttaaaaaaagaaataggcgtggagaaaaatatccaaaaatagtggaatacagcatcacatgcatgtaaaaataagtacgtgggaagacagggtacagtaaataaaatagatagtaaaaaagaaaaagatccgcaaccaaaataaccaaattagtaatctatcgtcaaccaaatatgtttataagaaaccctcttgcaaaaacatgacaaccaaaaggactgaacagctactttgcaatatcctggttattttatgaagttatcgcaattaaagggcataaaacacgtaagtaaagtacctgcactgcttgagaaagatcttgctgaagctatctgtccactggaaaagaaacagggaaagaaaagggaacattataaagacgccatggtaaacagaagtacagaacagctatcaggcgttaggagaacactattagaaatttagaataggacaatcagattcaaatctcattcccaggattggagtttgttcttaagtaaaggagattatcatttagacatgtactaaaaagcagggagccagataggcatgattcaggggccttgcaaaatatgccagcgattttttttatggtgtatcttagccaacaacatgagacgcagtgatcaaatatcgctggttcatattctcttgtaagggtggttctctcatacaatatgtcccgacactgccacataagctaacaatatcatagcagaaaatgacacataccatgacaatgaaccattgagaccagtaatagtatttgggataaagttgttaggtgatctcctgcaagtgtagcttccattaagtcctagtgacaactgaaagagaaaatgacaaactagaaagtcaggacaagacaataatggtctcaataaagtgggatatatttcaaggacataaccttggaggtctcaagctcttttccaggttgcttgcgctgaggaaatctggcacctccaattcttttctcagcacctgtggaaaccaaaagcactaaaacttcaatggtgaaaattgcttaatgaggacattcaatcaagaaggtgaattctcactgtacaaataaattcccaaaggaaccaaataactactatctcaagacaaaatgagtgtgcctatactatgtcaatgagaaatcacgccttaattaaaaattatagtatcagctcaggaagccaacccatgcttagccaaaggtacaaaaattagtggagaggtaatgtgtcaagaaatgaaaaaatgaacatattggattgtacttctgttgcaacatattttttttgtacagatgtttgtaatcaattgacaatctgtctatattagactacagaccaccaacacacaatcaatgaatgcctctggaggatccaggattaccaacacctgtgaaaccaaacgttttataactaaattgcctatgtaaggctctatattggtttcagttatgatggcaggaccattttggtttgacgccaaaatgtgccctaccaaattgttgacccttcgaatagtactttggctagtgtttggtttgctaccaaaatatgccaataacacacataggttgccaagaaaaaaaaggctaaaattcacctaggttttggtattgctaatattttggtatggtaggaaacaaacaaacccataatacagaaataaaaagttattggaacagaacagaactgcatgattaaaagcagcagacacttatgaaagaaataaaggtatttgctaactatcacagcaattagtcatgtggaaggacatctccagttgagttggacaaacaggttgcttgcgtaccgtggtcaattagttgacaaatacacacaatcaaaataaaatgataaaagatgggtagcacataccatttcccttggtggggaacgaaccagaagcagtggagaagtagcgcacgaggccagaacgctcacagtctagagcattgtgtaaactccgcaactgcagtaaagcagattgaaatgtcaccgggaattgattgacgatggcgtaacattactagcgcagaaacatttctttcccgctgcagtaggcaatagatctcccgatcgaccgaaatcaggtgaattactagtcaattcgcacagacgggagcacaaggaaatccaggaacgatcgaaaattcaaccacatgcggcacgcaggctccacgcagcgggaaggcagatcagaacagatccgatggcttttccgacacgttgggatgggagacggatgcgcaggcagccacagagagaggaggcagagagagaaagagagagagagggagagagacgaaccttgcgagagtggcggaggagatgcgcggcggacatggcgacgggagaaggcaatgggcgtggctagggtttgtctcgatcggagatcgttggcggcggaccgacgagggggcggatctccttggccacggtcgccgtggcggcgctggatcggtcgaggcaggcgtacgagcgtctcccggactggctgcggctcctcccggcgtggtcgaggccgcgggacagatgaggacggaggggggtcgtggtggtgtattgggaattgggatgtcgagtcgagtcgcgtccgggaatcacgcgccgggagggggcgagagaacaagatcggtagcgagtaagcttaccggggggccgggcctgggaagggagatacagtccgatggtaaaaaaaaatatagagttaatttcattttggatgatactttttctttaggtttcacttaaaatcattctttgtttaaatttttcaatttggactaggtaattttatctttgttgcacaattgatcacccccaaaccgcatcttcatcacttcaatgacttcgagtaaattgttaaagacatgccggcaaacttttatatctatatgcatgttatccctttacccaaggagacgctagacatgactagcaaatagaattaggttggttcattatgtaacaaaggtaaagttacatagttcaaagtaagaatattggttatagggtagtttaaagtaaaactttggcaataaaatatggctcgaaatgcaattcactcaaaaaatatatactagatgagtgagtgagagtggggcaggggatagttgtaaaattctttaatgttttgtgtggagcggatactatatgaaacctccagtgttgcagcggatcgttcgtgtgtaatgtagttataaaaattttaatatatatgtatgaaaaaaacattaaaaaagcctgtaaaagcatcatctaagtactcccttcatcctaaaatatagcaaacttgtactggatgtgacacattatagtacaacgaatcaagtaaaaacaacaaggatagtatctgtactaattcatcgagtccaagaataatagtttatatcatcatgatataaggtcattcccaatccaatgactaggatagtgtccatagcattaaataagctgccacctaggataaaaaatgatatgtcaagtaaataaatgaggaaagagaagaaaaccatgtcttgagacatggtttctacacaacatccaagacatcatgtgagataagtagcattaaattgaagtatggaatagtggtgtttgcattagaagagtggtgtctaacactattttcttgatgatggggagtttatggaaattatgtctagtgtcataggttgagaatggtctaagtacacttaaaaagccacatggtccacagtagaacaatgaattcagaaataccataaaatattttgtgcttattaattgcttctgattatgcacaatcatcaacggttgactttacggagtcataatttggttgaaaatgtgaccttttcatccacattgccttgcacttgagccgattagtcaatgttgtacatcaagaataactcgatggacatgccgtgaggaatgaccatagtggcacaatgtactatgggcaatgtaagcggaagttcttattctttttatctttggaaagatcaaacataagatgctcctatttcttttatggagtgtaggtacctctaggtaacacccctcgaggtaggcagaaattggtccaatggcaagcatcaccgtgaagatatgtatgttcgggcttgtgttcattctcgttgtcccaacctcgatcgggctgtgggtatcgtatggataaggcaaacgctgcagagtggtactgtatttgaatatactatgctcctgattaaaggagatatgtctatgagtgaatcctaattagtggtatgagaagtctcttaatggaacatttgaatttaatgaggaaaaggcctgaaatgaaacaaccaatttttgaaatgtaaattgattacaaattggccattttgaactattactaaggtttacagttagttctagtttctatccttgtgataccttgcattagcacatgttttgtcatgcatcttttgggttctagtcgtccaaggaggttgttgaaggtcgttatcgatcagtttcaactgtcaatattatcaaaatagaggagaattagtgatgcttgctatgcatatatatgttagaataataatattccactagtattaggtctactaaccttttgcagagaatgacaataaagtagagaagaatcgacatcaactcagacgataatcaatcggacgatgtcgagaaccagacttatgtatgaatgggccaagaactcagaattaacacgacaaactgggccaaaattcacaagtctgcggagaaaaacaacagaggaggccaccagccaaaccatgggctagttgggttggccccaggttcggccgaacctccctcatcgtcgctggatgcagggtttcttctggacggtgtggattagctcccaatgacggttggagggtatttccgaccattccaaccgtcacaaccgtcattgggaggctatataaacccctcaccttcttacttcactcatacacctcaagcaagagctctctcatttttctcaagtttagtttagtagtatctagctggtggaataggaatagagtagaaatcaggagtccggaagtcttcagaagagttcaggtatggctctagtagcttttctcttctcttttgtaagctttgtacttttattagaatactcttctatatacatttatggtatgaaaatactttccgagtatatgaatgcctactttacattatgttcatgttatactgaatatacggctagcttatctgggagatgctttggtgcgggtataatgtttgcttatgcaattactctatgtcatgacgatgatattagagtagtatctggtagtttagacgtggtgtctagattacgagatatcgttatttggggttatatgctgcggatgagatgtgggccgctgatggtgacagctcagtacgggtattcctctgcgcctgtatataatcctaagttaatttcctggggatggtactcctccgtatttagccctagttgtatagacatgacgggctgtcgtaaggaactcagcagtcaggggtggcttctcgaagtaccaggagggcatcggataaagggtattaactagtatatcggttaactagaatatatgtatactatgtatattagaagtataggaatagattgtctttctcttttctttccacttagcttagataatatattatgagaatgagtagctaatgcttatgtgtcactctacccttgattatcttaacacctgcttaaaatatgattattacaggtaatatttaaattattagtcaagttctctcaacatgatctttccacgagataaaataaataagatacccttggaatactctcgggtgaaatgttataatgatatatccgtgcgcttgtggataaactctttaactataatataccaggagtatttctacgccattgctgaaaattatatttctattaatgtcgttaagaaataccaacaaagtgtaagtgaagctttataagaagattgatcctattaatgtcgttaaaaaataccaacaaagtgtaagtgaagctttataagaagattgatccgttcaagttgtatgaagatgaaggcggtggtgccaagttgcatcttttagttgtatgtatggtcgtaggtcgggatgaaaacggcttggaaatgaatggaaatcagatctactatttttgttttcttttttaactagaatcgaaagtggaaaccccagatacgaaaattacatagaatattatcaaacataaatatggagtaaatatgaatcggagcgtatacggtaacgaatatttatcggaataaaaaataattctaactaagattctaaaatcaacgaagagatgaaggccattatttttttatcacaataaatcagcatttctatttttatcaattaaataataatacacacgtacacttcacttccctaaaaaagtgcaataagcaaaactatattcatctggcattgcctaataaaagaaaataaattaatagtcattaggcaaaagagaaatagatctaaagcaccaaactataaaaaacatctccattcaactaaccacatcaacactcggtgcaaatctgaacatccggaagagaagggtaaagctaatcagctgtatattaaaagcaatttgtttccagttccgagaaaaaaaaattctaaattcgtttctagaaagtttctcatcaatttcggtttccgacaggtagtagcattaccatgtcaatttcagtttccaagaaaatattccgaaatcatttaagtttcctatattttctgaacaaattactcactactaaaaaaggcaaatagctggctgccaggtttttttttgctagcgggcggtggtgccaccagcgacctaaggccaatgaaaataatacatattcactagtggccggtcggccactagtgaaaatcgactttcatagataaccaagctaagatggtcaccgacaaaatacgattttagctgacaactgcgtaaagagacctgccatcgaaaatatttttcaaagcaaaaaaaaaaagaattgaaaatcaggatccaaaacagccagtacagaatcacaaattctcaaaatcccccatcacatacagtccttgcactgtggtcatcgttgtagttggcgagagagagcgtaggtcgtcatctttagatccatgctcgtgaggaatagcatggccgactggtagttgccaatctggcgtcgtcttgcatgcccaccaccgccggatgtggacgtgtgctcgcagtagaggtagtcgttgccaccattgtcactgagccgcaaccctagccaccatcaccactgagggtcagcgtcaccgaggctgcgtatcgagtcgtcgctaagcttgtgggcagagccatcactgaggacggccgccaccagatctagcggtccaaagcactaccgctggctatcttcttgctcctcatcgtagtcgtttcgtccgtttgtccgcgccggttagcaagggagcccgaggtcgccagaactagtgtccatggtctcattggttgtcaatgcggtggcggtatttgtagacggtggttttctcgttggggtatgtgatggtaatgatgcgattcggcggctgccgcctccatggtggtagaggaagggcggtaaaaaggtgatgtcctgaaaaattattttagttccggtcgatattttctgtttcggaaaatacttaaggcatctacaatgtaagacactcttagagtgccctcactaactgagggtactctaggggtactcacctctacaatgtaggccacttctagttagtcaaatgagtgtcccaacccaaaaaagcccctttctctcctcttcctctctttcctattctacccctctcttccctctctctctttctccctccgcacgaccgcacgcacgttcctctctccctccgcccgtcgttccactcgctgcctgcttccctctctctcgccgccacctactgcgcttgccgacgctgcctccctcctcgccctcccttcctctctccgacggcgagcggtcgtatcgaggagacggtggcggtggcctcatcgacgatggcgctgtcgccttcttcatcgcgctgccgccgccgcctccctcctcgccctcccttcttctctccggcggcgagcggcgcctccgcctcgcccttgacgcgtgggccggtaacagaggggagaggggtggaagaggaaatcgaagctatggggtacgtcgcctcaataacctacctatgcaatgggttgcttcactccgtccccttggaaaaagcgagcgagcaacacgttccccatcaggggcgcgcgttctgtcccagggggacgacgcagacagaaagcctaacggacggcgctagggggatgggccgaagcaccgcattggtgatgcccttatcgatatcggaaacatcccgaaccgggacagttggtgcgtgtgtcaagtttggagttttaacagaatcttgtcagttcgtataacgaacttcctgagcggatacgtgttggtggaatatttggaccatctcggtgcgttcccacgtacagttagctcctctgctaattgtatggacagtttgccaataccatcgagcaacaacagaggtaacaggccgcctggttacgcatgggctcagttgacccataatttaatttgttattatttttcccttttcaaacaaaactcttgtggatatttatgtttggtgcattattttttctataagtaatctaatgaccccacataaaattattactaccttaattgtttggaacttactccgctactaccattttaataattgtaagggtgagtgtcaaaattctttccatgcaccatttgactaaaaggcgctaattaattataattataattgttcgggagtgttattaaagttttctttgaggtggcactcacttcaagtgaattggtgtaataattagctgtagctcgttaagcaaaagtcaggatgatattctattacaagcaaaagtatggatgatattctattacattatctaaaaattgactaaaaggcgatagtcttttcacccatactatatcatttcagtgataacaacaccacaacactgccacacgctcctaattagtactccttccgtcctgttttaagtgcaaccatgagttttcgtatccaattttgatcgtctgtctaatttgaaaatttttttaattagtatttttgttgttatgagatgataaaatatgaataacaatttatacgtgatttatatttttaattttttttcaaaaaatttttaaataaggtgaacgattaactagttgagtacggaaaagcatgactgtacttaaaatgggacggatggagtatatattcttactctacagactgtattactgtacgtctgtaccctttatttacagatgcatgcatctagcatggctgcatggggaccatgtccactaattagtccatgcaatgcaatgccccagttcactgcaccagtaagatatacgggcaggtactatatactatacgctacaaatggtcaccaatttgctcacgtgtgcttttttgtctgaccttaattgtcactgtgcatgtgatgaaaggcaagcatgagtccaattttatgtcacgatttgaagcagttacgttgcagccttttttcacatggaatccactaccaactgatcggtcgagttcacacactgcattgcaaggcatggatgtgatcgagttgaagtattgaactcgcgatcgatcgcgcgcgagagctatgtttttgcaggttcgttcgcatcatcatcaatggctagtttgctcggacatccagaggagctcctctaggtagtcggcgccgaggtcctccagctcgaggacgatctgcttgtgctccccgccggtcgtggcggacgtcgtcgtcgtcgtcttgttcgccgtcgccgtggcaccggccagctctgatctcttccgccgctttcgcttggagtgccgccccttcagcgccagcacgggcgagcctccggccgcgccgagcgcgagcgcgcggagcgactcgcgcacgcgttccacggggaagttgagcgccgcggccgcgccccgcgccgagagcgcggcctggtcgtaggccatcgcggcggcctcggccgtctcgaacgtgccgagccacacccgcacgccgttccgcgtggagtccctgatctccgccgcgaacctcccccacggccgcttccgcacgccgatgaagcccgccgccgccgccgccgcccccgccccgccctcctcctttctcgccgccctctcgcggcccgcaccgccgccgggcgccgacacctcggcgctccccgccgtctcgtagtcgtagccagacggctgcgattccgaggatgtcgacgacgccgcgccggcaccggcggctgcggtgacagccatgccgccgccgtagtaccagcagtggctgtgttgctccatgtgtgtgactctgtgagctgggaatgtttgacttagcggctgcgatcactgtgatgtgtgcggcgaagtgacggggcgtgtttgattattccctttccaggaaggcagcggattaaattagcgcggggtttatatagagccccgagagggttgggtggctctgtgggcgacgaattttccaggacggtgcggtggggcccgcgcgtcgacaaatgactatgacatgtagggtcatgaaaacctggaagtttgggcgttgtcgttggacttggctgacgtagggcggctgcataggacaaactagcgggcgtcagcgtacacgatccacacccttgctttgctggtggtgtccactgagcaggcctcggcgcgccttcgttaagtggcccagatcactagatcagaaatggattactgtgtttttaagctagtactccgtatctagcatcaccgatgatccaaggggtagtataagctataacacacgtgtctcaaattagggcttcttattttatttatttacatataagaagcgtcagcgatgatatggaggatggtaacgtactatttgctgcatggacaagcatataggtatataggtggtatttgaatcttctgaagatgaaggtaaagattaaatgttccacgtaaaatgaggtggtaacaacgtgtgcttaattgcgttttaattattacaaacttgaaacatggattaatctgatattttaaaacaacttttatataaaaagttttcgcacgaaacacaccgtttagcagtttgaaaagcgtgccacgaaaatccaaaacttcatctaatgtttgtagtggaaaccagtggcagatttaatttgggggcggggggtcttgagaccccactactgccactgggaccatggagaccctcctaagcccccactaaaaattatttgcatagattcataagatatgggagctgaagactctcctaatttgtttagcccccactattattttgttctagatccacccttggtggaaacgaacgtggccatagccatatactacgtgcttccccaaaaaaaaaaagaagagagagagagcatatactacgtgctgaaaccgcgcaaacaacgaaattgaagagcacctcgcaaaaaaaagaaggaaaaagaaagaaccagttaacagcggccacaacaataggctgtactctggtactagcggctggcgtggaacaatgataagtgggtataccaagaaatggtttccccatcgcaggttgggttgagtttgccttggcatgatggaaatttgggctgcgtggttatgggctgttgggtagctacttactcatttgttacgagcacattttctaaacgaataagtctactatacatccttaactctttcctggatcgaatcatatcccttaaccacaaaaccgggtataacacctttcccaacttaaaaaaccggtgcaaatcgactctttaggtggtttgcgaagcgattttgctgacgtggcataattgacttggtccaagtgcactaatgtggcaatccagtcattaaaggaattaaaactagaagtgggccccacttacaagtgacaagggtaagaataaaaaatggtgggcccacctatcagctccactactactctctcaatctcgaacaaatttttaacacaattttgttttcaaatttagatagcttgcaaaaggacagtgacactgccccttaaatttataaaagtatttcttcaggtttgcaagttcagataatgcaaactgagcaatgagcatgctatattcgtttgatcgatcaaagtcgacaaataaattgtacttcattttataattatcagacggatgcaagtagatctacagtgttgaagaacaaaatgaaacacttgagggttatagcaaggttgagtactacccatcgtacttagcaagtcataccgaatatgggtatgatgcaagggattacaaggacaacataagcgctcatttgtataaagcactagtaaacagttgcggttgaaaacaataaagctatggataatgttaagcaatactccctccgtactcgtaaagaaagtcgtttaggacaatgtttaagtcaaaccttgagaatataaatcatgaataactcttaagttgttaagtttgaaaatataaaaattatatgaatagatttgtcttgaaaaatactatcataaaagtatacatatatcacttttcaataaatatttatagaaacaagaagtcaaagttgtgttttggagactgtgtcgctgtccaaaataacttcctttacgagtacggagggagtattgatcaccgatcaatgctacaccgtgttaatagggcccagccatccacctgtagtatactcccttcgtacttgtaaaggaagtcgttttggacagcgacacggtctccaaaacacaaatttgacttcttgtttctataaaaatatttattgaaaagtggtatatgtatacttttatgaaaatatttttttggacaaatttattcatataatttttacattttcaaactcaacaaattgagagttattcatgatttatattcccaaggtttgacttaaacattatcctaaacgacttcctttacgagtacggagggagtacctattctaatattccattaagtcaatttaattaagagtgtgactaatcacggtgaatcttggtcaatcacccataacagcgggcttgactatttgaatagttttactttgactaaaggtgtacaactatactcagaagacacatcccccatgcatgtctccatacaccagcgtatcgccatggtaccctagtaagaggctgtgataggaccctttgcataaccatttacaccacgttgaggttttgcccctacccagaccaggataggtgctagtatttcttacggttatagataaatccgcaagatcacggataccgatctagcattttaccctggagtattccaagtgtgctgtatttatatttctgcaggaaaggtaatggtgtaaagatagagttcatacatccttaatcaagctataattactttactatagtctaaacatgggttaattgataaatgataatgggtaatgtgacacacaggagattttctctaataaatatacactaggcagtggagaagaactatagaaagctaaggttcatatgtacttgtatattactaatgtttagtagtttacatttaacacatacatgcttacaaagctagcacttaattctaagcacacatgtactaccgagagaccactccctattggtctgccagcgtggttatggtattttacaaactcttacgtcatacccgggcgtggcagaatacaagggacgaacatggctgtcaccacctgccacctgccatctacctcactttccgtggggcatacctacatccaacgatatttagctaacctaagaaccatccttatgttaataaataatgtcaccatttcccccaggactcccacctttcagatggataagttggaactagtgcaatccgttaagatcattggaccgttaccgtagcatagatcgactagcctaatcgatcaaatgaagcatataaataaagtacaatctactcatagagcacacatctagtaaactagtagataattcctttattacaactatagtcttacaagaagggtaaagtactcaaggcatacaggaatctccgagaagactatagaaccaaagactattgtaaccctaactccactactactagatataatacaatatggaatgagagaattgcttcttgaagtgtgtgttgaaagtgaagaatctcctctccttttatagcctcctaatgatggttgtatggcggattggcggttactgaggtcggtgcgctcctaaccgtcattagggagggctgagatgttgccacatggaagatgaagatgaggggtagccatggcggttcggccgacccctgggccccacctctctccactgcctttcaccaaaggctgccagatgggcccctatggtggttgaggatggtttggccccactttaggtcggtttggactgacttgtgagcccatcaatccatggactcgtacgtgattcactggaggtatgttttttttgcatgccggctcattcccccttcactttattgtgtaatctctgcatgcacattaattcttcaagacaagtggaactacattatttaatactagcatacatataagaaatgttagttctcttttatttattatggtagttgacggtcgaaattggtacttaacaactgtcaactaacaccccaagctaaacttttgcttgtcctcgagtaaagataaaacttaggttgtttatgatcaggagttgctaccatgttttatgtcacaacagtatcatgcccacaaaatatccttctacctagaatttgaataagttggcaacaatactttaacctctcttatcatactcccatgggttttttagcttctcctcgtcttgggtagttgagaggtagaacggatcgtagagcattaatcacttagtctttgttaaactttctttatggaggttttcaagaattttgcaataaaaccaaagttcctccaatgatactctcagatcgctcaatgtgtacaatttctcaccaaggcgtagtgttgcatctttttcatcctacctctaaaaggtttatagtggagctcaaggtgagaaaaaataatgagacaatactttgtacacatattttgcaaaatcaaagagaggatccaaggaagaaagcaaatcatacaatatgatcaagatgtgcaaagtgtgtggctatatggtggaaggtggtatgtggtactcctttgtcataggctctctttattcctaattggagatatgactatttttgttctaactatttttctcatgttgctcaggaattattgtgagcatacactccttttctcctttttctcataatatgcttgagagcattttctattttctacctcctccttttttttttctagagccatatgttttgcgaactgctaggagcaatttctttactgacatgaatggagtatttatttggtggatgaaaatgttgctaaccgcagtgaagaggacatcaataccgcccatacatcgacgtgtacacaagtacaacttcatggttctattacccgcgctcatgcgcatcaactcaactatcagatgagttcattcgtgagttcatgttcatctgatttatactctcgagacacgtgcattcttgttttaattaggaatgatggagaggatcaacaggggagaggattcatgtgggctggattcagactgcagaacatcaccaacttatgacgaccaccacgactttatgcggactccgttttgcgcgtgcgcataaaaagtttgactgttttgagctccacataacaaataaaacaaacatgcaatggtacatatgctgtgctaaattcccaacatagaacttataaaaatgtaaaaaaaattgagaaatagagtagtacaaattaagtataactaacctttggcgcaatagatctatcaaaccattcgagttcaaaacattctccccctatgtttgtgttcataagagagagaaaatcgtgcttaaatagcatggcagttaaggctcgaccttatataggagaagctattttcactagcggacaacttaagccaacaccatagaaaaaagtaggagtggcggtggcttaagtgggccgcagcgaaaatatcttcatcttcactggcgacccacgtcactagtccgtcatcaaagattttccatcttcgctggcggtcacttaggtgtgccaccagtgaaaacctcaacagcttcattggcggcccgcttaatttggccgccagctgttggcggctgttaaatgccgattttataccgccaacatctgcataaaagttcagataataaaatatccaacatagtaataggtgcttaatctcacatattccacaagtgttggtatatatttgtatgcagataataaaccctaaagttgggaggaaaatcaaactaaagtgaggagaaatgtgtatccatgcatggatgggttgtgaacttcatcaaaatgcccgagaatcaacccaaaatcttgagaaaatagatagaggaggtccagggggaagatgggccaagagccaggccagatgggcctagcccaggttcggccgaaccaaaatctcagccatccaggctggggtttggcgtggacggtcctgatcatctcctgatggcggttgcgaggcatttccgacaattcgcattgtataaccgtcatacctacccctatataaggacatcatctcactcactttaacacacacttccaagcttgaactgaattatacaaggctctattgtactatattgtatactagaataggaagagagtagagtagaagaagtcggaagaattccggagttgtcggtaatcttctcctatttcttttattttgtttattactctgaattcaatataatattcttcctgaataatttagatttatcttgtgagaattatctcttgattagttcctaaacagcatatgggattattgttcactataaccaactaaaaatataatgtttgctttgttgagttataaacactaaagtagatattaattgcttagacgtggtgtttaggtagttgttatccagtaattgctgcgtatcgcacagtacgtttgaggtaggtgtagaggtggtgacagccctcgagatcacttaagtcctccctgtccgggtacgtagtagagcgacatctgagaacagcgggttgccagtgcctgaagtattgcattaggattaaagttaagcttttcgtagacactgtttctcactagtaaatcctctctatcctttcctatcatctgcttggtgtccttggatgaaccggaggaagatctgaccacacacgttcccttggattcgatatccttggaatactctgtaggggaagtgctacatcggtatatccgtgcgcttgcggattctatctgtgatcgtaagaaatatcaataccaacgaagatcggttttcgctggcagtcctaagccccccacccctccttacgttgttgctggcggtttcgcgtatggccgccagcgaaaagttttgtgtaacgccatgaaaaattatttttctagtagtgattgcatatatcagtcatgtagggaaagattaattatgtcccaaaatgtccaaaacccaaaatgaaatatatattgattagtgaacgtattccgtatgtagcaaataaaactaagatttttggatttgataacaatattgagccttcagtgccagtgtccagtacgttattccaaactgtgtgcacctggtgtagtatttagtttttttaaaataatgttgaacgaagtttgccaacatgttttattatgtttgccggggaacggttgctgatcatttccaaaccttgttcatcctcgtatcctttttacttttttatctctagctctgcccctgctatccgagaaaagtattcttgttaaactcttcttgatcatggagcaacctctttttgagctgtccgctccttgaggcgaattctatgagccatctccttcatcggagcccatatatacaactggctatgaaattcgccccgagctaatcaatatggttaaggaaaatcctttttctaactttgatccagaaaatccctaccatcatctccgagactttgagcaagtctgctcatgccttaagattcgtggcatgagacaagaaactgtgcggcggaaattgtttccattctctcttccagaaagggcaaagcaatggtacacctctaccgttggatgtgtaaacggtagttgggaaaagttgcaagacagattctgtcttgccttcttcccagttactcgtatcactgcccttcgagtagaaattctcagttttaagcagatcaaaaacgaattaatcggtgcagcttggtccagattcactaatttagtgcagtccggaccaaccctgtccttcctcgagtatgtgctactacagcatttccatatgggtctagataaggagtctgcattttatctggacataaccgccagaggatcgttcatgcacaaaatgccgtcggaaggaagaacaattttggatcaaattctagaaaatacttccttcatgacgcaatccgatgaaccccagacagaggcatctgtgtcaaagatagaggaacctctaacgattgagccactctctgaaccatccacttttgctagcttgattgatgagaaggttcctgagcagccgtccgtcgaggatgaagaaattcagactccggatcatgccgcaattctgtttagggatggttttgacgaagattatggcaataccctgaactatttcagtaagaataaaccactcattcctttgtcgcctctcgatcctatggaacttggcttcttaagggaaactgttcgggagctaacatccataatgagcgatgaatggctaagggaggtatagctttcatccgaagtaattcgggtaaataccgctccccgaatcattcgctgccatctggaagggaacgacgtcggtattctctacagcccgatcgtcgaggtcaatctcatttctgagtcttttgcattcgcttatctaagcgataaggcaataaccccaacgaacaaattcttcaagcatccgaacgggaatatcattgaaggatttgggattgtacaagatgtgcatgtctgctttgaagatagggaggcgatcttggatttccacgtctttggaattcaagactttgacatcctaatcgggctacccattgagcagcttcttattaacacaccccgattagacagcctcaaaataactctaggaggaaatgaattttcagttccattctcacgggcaaggatcgccctaaccgaccctctcccagaaattgagtcagcagaggaggttaccgcagttccccctcacaagtctcccgaggcccttctggaagatgaagtccccgatttcatcaaggaagaagcggatcccggtgagactctcgatctgccaatcatcgaaccgctacctcgacttccgcttgagctaaaacctctacctccgggcctatgctatgctttcctacacaatgacagagaagctcctatcataattagtgacaagctctctgaagacgagactcaacgtcttctcatcgtgttggaaaatcatcgttctgttcttggctattcccttcaagatctcagggggattaatcccgcactttgcactcttcgtatccctattgaccccgagagtactccctttagggaacctcaatgacggctcaataatgcgacgcgagaggttgtaaagaaagaggtcttgaaactcctacatgccgggattatttatcccgtaccatacagtgagtgggttagcccagtccaggttgtgccaaagaagggaggaatgacggtcgttgcaaatgctcaaaatgaacttatcccgcaacgaaccgtaaccggatggaggatgtgcatcgactacaggaagcttaacaaggctacgaagaatgatcatttcccactacccttcattgatgaaatgttggaacggctggcaaatcattctttcttctgtttccttgatgggtattccgggtatcatcaaattcccatccatccagaggaccaaagtaagactacgttcacatttccatacaacacctatgcctatcataggatgtctttcgaactgtgcaacgcgcctgcatcttttcaaagatgtatgatgtctattttctcggatatgatcgaggacattatggaagtcttcatggatgacttatctgtctatggaaagaccttcggtcattgtctgcagaatttagacaaggtcttacaacgatgccaagagaaggatctggtacttaattgggaaaagtaccatttcatggtccgtgaagggatagttcttggccaccgagtgtccgaacgaggaatcgaagttgatcgtgctaaaatcgatgttatagatcagcttcctcctcctgtgaacatcaagggaatccgcagcttcttgggacacgccggcttttatagaaggttcatcaaggacttttctacaatcgcccgacctctgaccaatctgctagccaaggatgcaccctttgagttcgatgacacgtgcctgaaatcttttgaaatccttaaaaaggcacttgtctctgttccaatcattcaaccgcctgattggactctgcccttcgagatcatgtgtgatgcaagcgatttcgccattggtgcagtcttgggccaaaccaaggataaaaagcatcatgcagtctgttacactagaaaaactctaaccagagcctggttgaattatgcttctactgaaaaagagctgctcgcggttgtttttgctattgataagtttagatcttacttagtgggagctaaggtaataatttatactgatcatactgctctaaagtacctactcagtatgaaagatgctaagccacatctcttaagatggatcttgctactccaagaatttgacttggaaattatggataagaagggagtagaaaattccgtagcagatcatttgtttaggctgcagaccactgacacacaggaacaaccgataaatgacttcttgagagatgacatgctgatgacggttcgcgactccaacccgtggtatgccaacatagtaaactatatggtatccatgtacataccaccaggggaaaactagcgaaagctgaagtacgaaagtcgctgtcatatatgggatgagccatacttatatcgagtctgttttgatggcttatgcctcaccctatggtggccattatggtgctttccgcacccaggctaagacttgacaaagtggcttcttctggccaacaatgtatgaagactcaaaagaattcgttagaagatgcacaaactgccagaggcaaggaggaatcactactcaagatgcaatgcccctcacatacaatttgcaagtcgagatatttgatgtttggggtatagactttatgggacttttccctaagtctcgcaactatgagtacattctggtggcagtcgactatgtctccaaatgggttgaggctatgccgtgcagcgccgcggatgcgaagcatgccaagaagatgttcacagaaaccatcttcccaagatttggtacccctaggatggtcataagtgacggaggttctcacttcattgacaaaaccttccgagacctcctacgagagatgggagccaaacacaatgtggccactccataccatccacagactagcggtcaagcaaaaacattaaacaaacagatcaagaatattctgcaaaatacggtcaacaaaatgggaacatgatggaaggatagattgccggacacacttgtcacgccctaaaaatcgtctaatgtaaaaatacattgtttaaatcatttttagaaattaaaattaaaagcctacaagctaaaccctaattatctaggaaaattttcaacataaaaatgagctagataaaattttattaaatactttgcttgttcctctattttctagaattttctgggaattgtttgagcaagggaagtatttttaataattggaacaacatttcacaaattattttaattaaaaagttcaaaaaacccttccttaagtggttgggccgtttttggcccaactttttccccctcccgcgcagccgagccggcccagcgccgcccaagtcggctcaagccgagccgcccgcccctcctctcatgggacaccgacatgtggggcccacatgtcgggcccttctcctacctccggccggccggccttgctagcccgagccgccccttttcccctccaaatccacctcgaatccggccaccccgagtccctttttttgaggggtttttatcctctcgttctcctctatctttaacctcaaaaatcggagcaaatcgttgagtattttatccgaatcgaactcgttttcgagtttatctctaaaaccgagtttttgatttcccgagtcgatttcttgcgggaggagtccgatctcttcaatccaaggctatatataggaccccctagccctcctctttcgtttgccccatcacccgtcccctcccgtgccccgtagctcgccgccgacgccgcctagcctcgccgtcgccgccggcgatctccagccgcgccgcctccgccgtcgccgtcggtcgtcgccaccgtcgtgggcttcaccacgccgtagggaagcacggccaccctctcctttccgccgccggccgccgtagcccgctaccaccgcgcaagccgagccgccgccgccatcccctcgtcaccggccgtcgtcgttcgtcggtagacgtgttggtgagcaccgttgcgttcatctcgtcgtcctccacgtgttcttgtcctcctaatccgcagccggccgctctatctccggcgaggtcgccatcgtggttcggccgccattgatgaagtcatcatgtcatcatcggtttttttctttttcccgtttttctaatagattaaatcttcggaaaatcataactaaataaccgtcgatccgttttaggtggttcaagttgctaaatttttctaaaaccgagatctacatgttaaaaatatccacatgtactgtttatgcttgtttttatactgttttgttgatttttgtttaattgctttagtttccgacgttccggaggagagtgtttccgttgaggaaggttccgaagcgtttgcggaagcccaaggcaagtcacacagatcccaaacaaccatttgagcatgttgaacccacttaaagctattattttatttcaactatgcattgtttttgaatgtcatcgggtggtgaaccttttccaattaattaatggccgaagatgatcttattttcctatgggttataatttgattagcatgaaccttatatgttggattggttcagctaaatgctatatgtaagtttgcttagccatgcttagaaacattagctaactaaagggattaattataaactatgttatattattattaattatggttacattaaatggtagctcacgatggttaatcgtgtgatgttaattaattgataattaaaacctggttaaggtgggttgtgagcatatggttttgatggttgtgctcatgacaattaaggaccggttcgcgagctacttttgtgaaacatttatcgtgccaaccacaagccagcgtgggcaacagctttatcttttgtatagcatgattcattatagtgcgccagactgtgaagcggcgagaagtccgtgggggtcgctggggagtccattgcctctggttttgagggggagattatgatccaggaacggtgcactgcggtgagttgtgttgtgcaaggggtattgtcacagttcctttccgaggtatcgtggtggtactaaggcgcatggtaacatgttgtgggattgtgtcttgtgggtacagtggtacacctctgatcagagtttaatctattcgaatagccgtacccgcggttatgggtgagttgagcaatgtttttcgtgattagtctcacactactcatcaatgttaataatgtgataattaatttgactcctggtttggaatggataattcctagtttggaggtttaatttgttcaactggggttggttgttcaaatgtggttgggcctatgcaacatgggtgtgttgtatggtgtttatttaatattgattaattatacaactgttttactattctcttaaatatttgttaaatgctgttatgcaaatgagctatattatgccatcctttgttatcttgtgcacttgcatatttgctgtgtggcttgttgagtatgttatgctcattcttgcaatattcaatcatcagaagaggagtatttcagcgaaggtgatgatctgaaggattgagcttgttctggttaagatgcctgtggagtggagtcgccatagctgttccgtagtttgttatagttttatttttccgctgcgtagaatgttattctttgagaggaactatccacctctgtaataatttattatttgtgaatattaaatagttatttatttgtactctattatcaatttgttattgtgtgcctcggttgattcctggacgagggtttaacacacatgtaagcgtttggaattttggatagaaattccgggcgtgacaacactgtgggcataccggacagcatacaagacacccattggaatgtcgccatatcaggtagtctatgggaagtcatgttgactacctgtagaactcgagcacagagcatattgggccatcaggaactggaacatggactttgagggagcaggagaatggagaaaaatgcaaattgctgaacttgaagaatggagagagaaggcttaccacaacgtaaggatatacaaagaaaggatgaagcgctggcatgacaaaaggataaagatcaagaaattcaagtcaagagacaaagtactaatgttcaactccagggttaagctttttggccactgaaaactgcgcagtaaatgggaaggaccgttcgacgtcatcgacacctcttcgcacggggcaatcacactccgcgatgactcaggttttgaataactgtgggggagatatcccagcttctgacgtgcatatactctgaaaattgttgaatctctgaacacctagaaggaactgaactcagcagaaaattgcagagggattaggcaccagagtggttcggccgaaccagtgttggccctaattgcccacaatttttacaggtaagtaggtaagcacgtctattatctgtatatctctaccatggtatagtactagaggtgaaaatttaggaaacacttggttcaagcataagtgaaagataaaatttccaactaatgaaattcttcatatgattgatcttgtataatcattattctcagccgaacttgtgcttgtgaacaaccatccatgtgtagggaaccttatgcatctaggtaattgcttcatgtgagatgatttatgatgaaaggaatttttgcaactcttgttatgactattgggaatttgttttcaaaataaaatttgttttaaaagctcattcctccaattgacttcattttatacctactaaggccatatgcaagtatatcaatgatcaaccttattacgcatattactgcttgacattatattgagctttgtcaaatttgtgtgactcgtgttagatatctttcatactctcatgatcaaggggtcaatttcactttcatttccacatacatgataaaaagctaagcttctacactggaagttggcttctcacgaaaaattccattcgaataaactcctacattagactatgctttcttgtcctagaaaagtttttggtaaaaagaaaatgagaaaagcagggaaaggcatggctatgaaataaaaagagaaggaggaaaaaaagagaacaaaacttgctctcgaaacattgagcatgatgagaagaaaatatagccatgccccttccataatcatgccaaaagaaggagaaagtgtaggaaaaagggagaatcatttctttatgccaccatttcacaaaatattttacttttccatttctcaccacacataaagacccctgatctaggagtatgactgatgatcttattaagtccgtaattttggctttgcaatatatatttgatgcaggtatgtcacaatttgtcccaccgagctccacgtatcagccttagaatagaggtatattctggcactctttgccctggtaaggatcaaaaaagaaaatccttgagagataagagagaaagtcaatataaggaaaagagctggtttgcgaaaattcataaaaatcccatgagtctgacagagaagcaagaaggactggaatcaggatcattccatctatcaattactcaagatggtaagatagccactgataaagttcacaagtataggtatggttatgaatggtgtatatgcatgatccagagttgtcggtaatcttctccaatttcttttattctgtttattactctgaattcaatataatattcttcctgagtaatttagatttatcttgtgagaattatctcttggttagttcctaaacaacatacgggattattgtttactgtaaccaactaaaatatagtgattgctttggtgagtttttttttttgcggggaacgggagatatattactcggcaacagcctccttacgagccacgtgagaaataaagttacaagagttatctggcctgaacttagttaagctattactacggcccaaattggccaacaagtggctcagatgattttgatttctatgaatcttgcacagctttacctccctgcttcccatcaagaggtcacgaacctccctgactaagaacaccatgtctgaacgcaccattgaatcggactgaacaagttgcttcgccatcagactgtctgtctctacgacaatcggaagaagagtccattgtagcgccaaggaaagcccatctctgcaagagaggagttcagcttccagcgcactgccgtagcgatccacaaatccagacgctgcaaaaattacttctccttccgcgttccgcagtactgcaccgattcctccttgcccgtcgctagcttggaaggacccatccacattcaacttcatccagatgcctgtggtatctgccattttgggctctcgtcacactgtatctgaactgacacactgggcttcgacgcgcgagcatccaccacatgtttgcccttaacaaggttggctcttgatgttgcttgatttctgccaaagagtggatatagctttcaatgaatctttttgatgctgcaatccccggaacaggcttgccatgggtaacctcattccgcgcgtgccagatacgccacagtgtcatcagagtaacagccctctcagactctgcaatccttcctaggtgatcaagaatccctggtgtactccccgcggcaatgccggacggaagcaccctacgcagatcaacccccatcgcttcccaaaacagacaagcgtgtgggcatcggtagagtgcatggccagtgtcttcagtttcaacaccgcatatgctgcacacgttcgacacctccagcttccttttcttcttgttctccagcgtcggaaggcagttagtgactgcacgccacacaaagattttaactttttgtggaacattgcacttccaaaccatattccatgccttacttaggttgctgtctgacgagcttgacccctcctcagcacgcgccagtgatactgccaaactatatgcacttcttactgatttcttttattctttttattactctgatttcaatagaattatcttcctgagtaatttagatttatcttgtaagaattatctcttggttagttcctaaatagcatatgggattattgttcactataatcaactaaaatatagcgattgttttggtgagttataaacactaaagtatatattaattgcttagacgtggtgttttggtagttgttatccagtaattgctgcgtatcccacagtacgtttgaggtaggtatagaggtggtgacagccctcgagatcacttaagtcctccctgtccgggtacgtagtagagcgacatctgagaacagcgggttgccagtgcctgaagtattgcattaggattaaagttaagctttccctagacactgtttctcactactaaatcctctgtatccttgcctatcatctgcttggtgtcctaggatgaaccggaggaagatctgaccacacacgttcccttggattcgatatccttggaatactccgtaggggaagtgctacatcggtatatccgtgcgcttgtggattctatctgtgatcgtaagaaataccaacaccagtgaagatcggttttcgctggcagtcctaagccccccacccttcctgatgttgttgctggcggtttcgcgtatggccgccagcgaaaagttgtgtgacgccatgaaaaattatttttctagtagtgattgcatatatcagtcatgcagggaaagtttaattatgtcccaaaatgtccaaaacccagaatgaaatatatattgattagtgaacgtattccgtatgtagcaaataaaactaagtttttttggatttgataacaatattgagccttcagatgccagtctccagtacgttataccaaactgtgtgcacctggtgtagtatttagttttttaaaataatgttgaacgaagtttgccaacatgttttattaagtctatcattttgcagcaataattacattttaccaaatagaactattaatttttcactctatttttatcaaatgtgataacatacgattgccaaatttttttccgaacatttatataacagaaccaacatataatctatacttcttgaaaaaaaaagttattgttggtggcagtgaatctgccatcccatctactaccattgtaaattttacaagttaatgcctgaacttcttaataacaaaaagaatcaaatcttaactaatgaaaggtaaaacttaaaatgaaacgaggataaatgaagataaatgaaatattagccgttggatttactacaaaacaaaagaggataaatgaagcttgaccgttggattagatggatggtgaaaataataatttaagaggtttctgaagatgaaactactagaaggaaagaaagaaaggaatgggaaaagctaaagaataaacatatgaaggtataatgctatacatataatttacgatttgcatctattgtaaaaactattttactaataaaccctcatcataacaaaagaatcatgggtcaagaatcaagattgagctatttcaagtatatacaaaatgtatgttcatttgattaatttttttctaacaattaattttaatatatttgagaaaaaaaatacaataagtacatgcacaattatggtcgcccaaatataagtttaatgattttcacacgaatttaaatgaaatcaaacccattccttaaaaacctacaaaatatttgtgcatagactaaaaaagcacgtgccaaaaaaagtaagagggtcctgcaatcacgaagacctacaagactataataaaatttgtaacaaatattaagctatttagtgtattatcataatattagtcaatctaacctatgttttttgtatgagcaacgagaaactcatacaaaagattaccagtggtttttttgtaattttaatatgtttttttttgtaatttaccactcccacataccacataatagaagacctagagtcgcgtgaatgtgcgatatcataggctagtctaaatggattgccatataaaaaatcagaggaagtctctatagcaaaaagatgggtaacacattaatacattttttttttcttttagctagttaccattatagcataggcaagcagtgaattagttctcccaaaaggcaaggaaaagtgatcaaagtttttttttgagggaaaaagtgaacaaagttatgcagaatctgctagcttgcacataatgcttcaaaagtctgtaaggatatgatgtatatataataccgtgttgtagatatgtactcttgtagcacaccatgcatgtccatatgtatgaatttctcgagccaattccccgctagattttccttttgttcattcagttcatcttcttgtacacactagctagtattccgtttaacaacaagctgaaagtgtttaatggtagcttaacgtatttttgagttactctcttttaccttaattactcgagggagcatagaaagttgttaagtacagtgaatttcgagagtaaaatcacggtcatactagtacatataaatgttgatagtactaatttgggcacatgccatacaaagtttaataatattattatgtgtacccatggggcaagatgcatgcatcaagctagctagcttttgggaagtaggtccttgtgtccgataaagacataaagttcagtccccgcccaaagtacacaccttgaaaatacttcagcatgttgtgcgtataatatggtggtgaccaccaaattgttgcttgctccagcatgtgttgcattgtctgcactttattggcactctagagagagccagacagcaagtagtaggatgcaataacacacatgcatgtgttcaagtagtacttgcagttgcatacttgcatgtgttcaagtagtacttccagttgcagttgcatacttgcatgcagctttttgcagtttgcacgttccattgcaactgcatgcgcgcgaaatgtaattcgcaagaggtgccttgcaaattgccaaccttttggatgatcagtcagcagggtcactaccaccattgatctccgacagccagagaagctcctccaggtactcggcgccgaggtcctcaagctccacgacgaaccgcttctgctcgtccgtcgtcgcagtagtcaattccgtgctcttgctgatcctccgcgtctgcggcgtggcattcgccgtcgcggcggtggcggcggcggcggcgagtagttcagctttcttgcgccgctttcgcttcgagtgccgccgcttcagcgccagcacgggggagcccccggccgcgccgagggagagcgcgtggagcgactcgcggacgcgctccacggggaagttgagcgccgcggcggcgccacgcgccgagagcgcggcctggtcgtaggccatcgcggcggcctcggcgctgtcgaacgtgccgatccacacccgcgcgccgttccgcgtcgagtcccggatctccgccgcgaacctgccccacggccgcctccgcaccccgatgaacgccgccgccgcctccgtctgtccccgaccttgacgatgatcaccgcccgcgctcctcctcctccccgccacggaggatggcgcaggtgtctcgtcgggccagcccgtgtcgaaccgaagcatctccgaggaggaagacgacgaagacgaggaggaggaggaggaggacgcggcggcgtctgccgtgtagccgatgtacatgccggcgtggctgaaatgctctgccattgatttgcgcgcttggattggatagagagatcgatggtggcgtggattgacttttagctgctgattggttccaggaaggcagcgaatcgggtagcgaggtttatatagagctcgctaagagcatgtacaatagcatgctataagccagctgtaaacatattttaagaagataaataaagagagagatgggcagcgggctacagatttgtaaccagctgtagcacggactccaagatgcagtgtgtgtatgacagatgggaccaagtattaatagtgtagtatgtaattattatatgaatgagctattagattggctataaataaattggagtccgtagttggctatactattaaacttactctaagtgcagttggagggattaatatagtgttcatagggcattagggcggcagggttgtggggcccataaatgggctgtcgcttttaacgggaaaggcgtctggtcgtgtagggcacatctggcatgtggctgacatagggcggctggataggacaaaagtatatgacgtaagcgatcccactgtgtgatagtggtatgtggagtactggagtgtgctgttgccttgttcgtacgtgaagaagcttttgcttactaggaacagtgttccccaatttagatcgagatatttctgaaaaagtaaaatgtataggtgctctcttgtagctcctagtacatttttattcttaaacattgataataatgattggaatttaatcatgttaaggctggtttccattggggttgggagcccttctcaagtacgtaaaatggagaggtagattagtgcatgcttgattaagtattagctaaacaaacttaaaaaattaattaatatgattttcaagtaactttcctatagaactttttttttttgcaaaaacacaccggttagtagtttcacgaaaagtatcagtggaaaacgaaggattagaaattggattttaggctagcagtggatgcgatatgccttgcatccccacctcttccttccctatgttaacctcttccttccctatgttgtgcgggaatggctagcctagatttcttacaatttaatcttttctaaaacttattttataaacaaaactctcaagaaaacttatgatattaataaatctttttttggtgcaaatgacgctgacgccgtggccattcccctgccaccatggaatcccggtcgacggggcacccgggggatgacgccaatgacattggcaccttgggtcaacccataatgctagcatcatttgtgccatccactgagaaggactaagccgcgcgggatctcccccctcccccaacctcatttcccccctgcctgagtgaagaacagggagggttcctcccttccctctctctccttcctcacctcttcttcttaaatgtgatcgatttggagatgttttttatgggatttgttggcggaaatcgaagagcgcggtatactcacattctccttggtccatccaagaacatctttcacttgcaaccttagttcatctatagtgggatgggtgggaataaaaatgtccttcaacatcatatcctcgaactcaatatgtgcaccaatataacgtttaattaaccaacctacaacgtagtaaagacgagcaagtctatccatctacaccgaaaacgtattattataatcttttgaaaatagtctatcattcttcctaaatgtcgtacaaacccaaaagtttctttatcaatgcataaattaagattgaccacaacataagcctaaaaaatgttatcaactactagcctacaacaaatatttaattgacatggaaaaaataccctaaaaatataaatcgtgtcctaaccatacattagtctatcatatatacaatgaacacatacaaaaatcaaatgcatggctcacatctatcatatcgatccgtacccaacaataaacctaacacatatgctctcaatttaactagcgagtagagttgcgcgttcgcgcgacccaagcctcctgtctattagatttggtaggaagtgttgttacatttttttatctctaataaacaatattgttgtgataataaatagttaacatgtctaacgtgtaaaaattattgtaaatataatattggaaggttctaaattatgtatattattagcatgtattatattttaaatatttgcccaaatattttttcatttaaaaaattattcagacagatatttaaaatataataactgctaataaacttgtggagaaccctgttgttttgtattataaactttagtttaagtcattctattgaaaggaagcattgcacgtgacaacacaagcgaaaagaggcggcaccactatctgttggcatgcaatggcaactcctcaacccttttatcttgttcattcatgttttatttctccatgtacaccaacgcttcttccatcccaactcaacacgttccaccatctcctctctaacctgatattttttggatgtagctgtatttatggcaccatattttacaccaaaattagtcataattgtttttacagtatgtaaattacatacacccacattgtaattgcaccgtaaattttaaaactcaaattgtaattacattgtaaaatttaatatttacattgtatacttttctaatacacaatgtataagagaattagaattaaaagtaatttattatctacttggaaaatgagactggagagataaaagcatagttacatatgggagaaagcaatcatatggagaaaaagtgactgaaattaaataaaaaatgcggtgccatatttttttgcaaacccatattttttttctaattttgtatttttttaatgatatttttgtttttgccaaagttatctatgattgtgtttttactcccacatgtattccctagatccttctaatggaagcctcctcactgttctccttctctccatatttttagcccttctttccaaatccaatggctcatattttaaagcgtacgtggctcaatcaggaaatgaataaactttcgtcattcaatatgatgatgcctaaattcatttttccatatactccatacacatagtcactaaacaattccagtggcaagtatacatttgaaaaaaaaaatcgaagagtgtcacaacctgaagtttccccccttttcttgctttaaaaattggataaataaattgcccgaagaaattatcttaattaacctagagctaaatccctagttaataaatgcaattaataatcggaaatagcgtggtggaatttttcttgagttccccatgctccaatgcattaataagatttttagtggaattttcagagccttggaaataattttaaccaattaaaaatcaccaaagtgcaattttaaatcccaggaaaaatcctttcttctttttctttttcttttccttcttttttctcttttgggccgtcggcccactccctcccgcgctcggcctccttcctttgggccggcccgttcccctttcccctctcttcgggacgctgacaggtggggcccacctgtcaggtcgtccccttcctccagccgccagccccacgacggcaaccgccgccgaaaccgtccgcgccgccgccttctccgctccacgccgcgcccccactccgcgtccccacgtcgccgccctccccgccattcccgcccgcacgcgcgcccgcaaatgggcgggattcaatttgaatccccccactctctctctctccctcccacgtcgccggccaaatcggggggtttcccgaccatgtccgcccctctcgagcccctataaagcttccccgcatctccctctcccttttccccttttcgtcgcgctctcccgtgcctcctaccggtcgcgcgccgctcgctactagctccgccgcttgccgccacctccggtcgcgcgccgcagccgctagagccgccgccgcgccaagccgccgccgccattagcattgccgccgcgtgagccaccttggccgccgctcggtttccgctaaaccccaccggagcccggttctcctcgcacaccggtgccgccgccgcccgtccgcccctcctcgtcgccaggtcgtcgccgccaccttcatcctccgctccggccgccatactcgccggtgaggatccccccctcctccctcttcccctctctctcgtttgcgccgcctctctccacgcgctggccgtcgctttcggtcgacgccgccgtcctgtaccccgtccgccgtcgcttcccgcgccgccgattgccctcgccggcgaccgtgcgcgtcgccgccggttgccatggccggccggccggttttgaagctgagccgagccgtgcctagccgccgccgtgccgtccgatcggcctcccggccgatccggaccgtcggtcccgtggaccggcggtggaccacccgtgtggtcccggtccacggtagaccggccaccttgagccactgcccgtggggcccacatgccggcgcccccttcctcacccctttgagccgctgacccgtgggccccgcctgtcggcgccgccccccccttggatgacgtcagccctgggtattattgcgcaataattaattaagtactttttctttattagtaaaaacacagtttatcttctaaaattcataagtaattcatccaagctccgtttaagtccattcaagtctcagtaaatcaagaaaaatgcaaagaatccattaaaaatggttttgtttcctgtttcagtagtcttatagcatgttttgcttgtgtgctttgtttgtcgcgtaggtttcggccgtttcgtcgatccgcagtttcttgaagacattgctgaggtctcatcagttcgagagcaaggcaagtcatgcaatacgtttgatcatattttacccaatttaccaatatcccgcatttctattaaatgttgcattcttttacaatgtaatgtgggatgggtcctattccttagccacatattggttaccttatgccattgataacttgggtatcaaaatgactagatgttggcttaggaaatgcttagccatgcttagttcaactaggacacaaatggggatcacattattacatagactctgactattggcatagctttagattggtgccaccgcaagggtgtcagttaattaaaatattctgaatggcgggctgtgagtgcatggttttgctggtcgcacccatggcagttaaggaccggttcacgggaaaccctgggagacttaccgtgcttactacaaacgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagtcgtgcccgcggttatgggcgatcaaccagattcaccgtgattagtctcacccctagtttaacttaatgaacttgtgtagttcaggtggttggttgggcctgttgcaacgtggtgtagtgttggacagtgattggttaatattgattaattactacagctgttttactgctttcaactactgctttgaaatacctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgcatttgtaatcttttatatttttgtaagacgtgggtctgtatgtcaacaattgtcgtttgtgtaccctggctggtcctggacagggatttaatgcacattcagcttagaaattctggttcgagaatttctgggtgtgacaaagagcctaccagcacattgctcacaagtaacaatacaagcctcaaatctcacattgcaaggcataaaataacaaatttgagcaaaaagtgattcctagggctatcttccaaactccaatttcaaccgattaaaatggaaaaaaataaggggaatttaggagtataccttgctcttcaatttccgcaagaaataccgcggaaaacaacactaaatcgaccggatttgaggaagagaggtgacagggagagagaggggagcaaaacgaagccgtcttcagttatgtatggtgtgcacaatgcgtaagattgtgtatgtcttatccttgagcctatgtagattagcgtgaatgcacgcctcgtgccatcaacagcatcaagaagcaccgcattacccagaggggatacctgctttatctagatgtgaccgagttcaaggaggattcgacatggcagtttatctattaattagaaagagtttgttagtttccttttaactctaggaaagtgtgtttagtatccaataaggacttcatgtttttcttttatatttagggaagtttctttcttgtccaataagaactagtatctatccatgggtataaatatgtacaatcggggtcattgtaaactatctccacgattaatacaaattcggcgcatcgccacccttttttacctttctatttttttcgacaagtttatgctaagacttgtcatggttgtttacatcggcggggatagtgctttgacactctaatcttgtcaatgtaagcacttacctattatatatcttaattaatctagtttggtagttcaatttacttgtatcggctgatattcgttttagggtttatgccggtatcgactaaattgctttaccagattatattagctaaggtatctaccatcctgaaaatcagtcaagggcttgattgtctagatattatgtttcttttcatacttagtgttgtatcagttaagtttgatctactaagtcgtgtttagaaccataatctctagcctgctttttgattgccaataacggtttcatcggagtttcagccgatgaggtatctagacgttgcatcggcttataaggattatatacaagatagattcagtcgattgcgacaaagatttcattgtttatctaattgtttggatttcatgacatcggtcctccagccgatgtatgctttaaccttcggatcattgcttattctatcatattattattagccgattggtttctactagattatattgctatttatcatcatcacctgattgtctttatattattatatatattggacatatagctgatagctcaaaatcctatcgatattggctggcatcggcatcggcattggctgaactactccattggcttgtcaatcgatcggctctttgatctgttatctatatatcttgttagttgcaggatcaaactgactggcacgtccacatctcaacaacctttggacctgcactggagctaaggagatctctcactctctcaggacgttgctgttgtcgacttagttcgcgccaacacagatatggtattatcggccaagcgtagatttttcatcaacagtgtataaatgaacttttctctttatctttgtaaaatgatgaactcttttcagcaaatgaattaatcaagaacacactaaaagtatccaatattcagtctatgatcatgtgcaggttgcagcgtttttgagagaacttttaacagaacatattctgaaatcaagaacaattaacattaagttcggaaataaacaatagaaacggacatttagtctaagatgatgaaaaacaaaagtgagaataatgaattttaaacctatctccaacttattttcagacttggtggtggaccaatatccctatggtttgggggataatgagccctgatttccaccttcccgggccaaaccgaatgcgatttttgtcagcacaaggattttttccccacgtggtgggcttccccgaaggggcagggcaaaaggccggtatcccgcccggccttttgccctctatccgatcgaacgaggcctaatcaattggtagagagatggttgagggaggctaattaattggtggaggtgctacactagctagttttcactagaaagagaggaggcagtggctagaggatgaagatggcctgatgagtaggtctaccggtgatcaaagaggatgccgacagaaaactctattgattcaaattctagaaaattttagtgtcacacatcttagctttcacaaatagcaatattattattttatcagaccggtaattttttaatggtatgaattcaattagctctctttaaaaatgtttaaaaatagaaaattgtaatatcaatgcctgtagtaatgctcgaccaggagtaatccattgtcgatcttcttaaattaaacgctctacgcaggtagtcattgcttgatgtgatggtcactattaattattttggaatgaccctgcaagacttattcagcaggttgttaccagaaaattttaattaattttgtttccttgaactattagcgcaatatgcaaccaagtcgtctaagaagatgctgatgcacttaacaattgagaattgtactgattaagtacataattgataattatatatatgcaatataatatgcttacgtgtagtaatgcatcaacttgttcgccgagcaatcataaggacaacaaaccacacaaaattcgataattagttaaatgtcacagaaaaaaaaaaacaaaatctacgtacatgaaggtggtgtttgaatcttctgaagatgaagatgaagataaagattaagtgtttcacgaaaaaagaggtggtaataacgtgtgattaattgagttttaattattacaaacttgaaaaatggattaatatgatattttagagcaactttcatatagaaagttttcacacgaaacgcaccgtttagcaatttaaaaagcgtgccataagtatccaaaatttcatccttgttggagaaacgaacgcagctttcggtgcgttaacgaaatctagtgatataggagtattccaatcaagccatatacaattcacaacctgcatgcacccccaatatagaaatagttgtcgtgcttattggacaggattaatgaaatgctcgaaaaattccacaaagaaagatataagttaaacgtacgtagacaaaaggatcttgccgaaaagaaggttccgcgatgcagagagaacagtcgatgtggacagcaggagccgcctcccgacttttctccgtggcagttgacacgccctggcaataatcaatattttagacgcatggtctcaaacaaatgcttcactagccaaaactgacctggatcaatattatctcggagattttgagggtttttctttaaagtcatgtacgtgatatatagggtaggctgcgccttactagttactactggtcatgttcaagtcaaaacatgactggattaaaaaaagttcagtgaatgagaacgacgtcgcaatcaccggtaccatttctcggtggacaaggccgtgtcgcaacaaaagaatgcaagatttgtgatgctacatgtttaaccggtcatggacttttggacttctttttggctcattatatatccataagatttggtttataatgagtcgacttttggactcattataatgacttctttttggctcattaaccggtcatgtctaagatttgtgatgccacatttttaaccggtcatataatggtcgacgcttgcagttttaggtgtggttaggggtagatatgtattgagtcgactcagctagataaaactccactcgttagacttttttttttgttagaattaatagatgggctaaggcccattcgaagattaattctttggaaaatcataaaaacccaccttatgggatgacatgcatatgaagtttagtaccaccttgcttattctaggagagggggacctccttaaaagggaggatgccctcctagccatttaaagcatgtgtggtggagagaagaggggaaacacacacgcgctcgctcgcctggccaggcacagggtcgaatggtccgcaaaattggctcctcacctttgcgcaggcggcgcgcgtgcagacgtcgaatggtccgcaaaattaaaattggctcctcacccttgcgcagatgtagcctccttttgcagttttgttttgctgcgggattggattcggatttgttttattttggaaacatttcgaaaaatctggtgcgtgaaaacggcatggagtccggataggttacgcgcgacttatctggttcggtttacgcgggcgccctgatcagacgatctatctctatataaaccgagccgccgccttcatgcaatacacgcgaaatcaatttagggtttgcctcctactctgtactgcgccgtcgctcgtagactactccatcccgctcgtcggcgtgcaccggcgatcgggagatcaggtctccggaacctctgccttcgacgtcctgcaccgggagaaggcggcaataagatttttgggaagcgcttcgcgcgactgctccctgtttgtctacgacggctcgccttcctctccgctcgcgtgcttcgcgactttgtcgacgctcgcaaccgcgagtagttcctgccgagcaaccggtctttccgccacctcggtacgtgttcgacatgttgcgcatatttgatctgttcatgttttactgcttagtttatatgtgtagatctaatgatgcgttcaatctagtttacatatgcaatgtcatgatttatttatggaataaattaaattattatgtgcttataatttcaacatgaacatgattgcaaatacacttaactgcgtcggcaccaatcatcgctgcaagagcagatcaagatggggaagtgcagaggacgcggagttttctgaaagtatatagctccatacctacctacaacctatattttgctatcataaaattgaatgcaaaccattttaatccagccatttatgtaatacattttagaagaaatataacatgtcatattccatatttctgatcccacaattatctcaaatgtaaatgatattgaagtacctatgtgtacgatgtttctcatccaaatttccaattaaacaaataaactcagcaaaatattgaagtataacaacatgaatttccagcaatccaaaataaaacgtgcgctggcagcgaacagcgaacagaaaacggcaaaaagagaaacagagcgtgcgccccagaaaaaaaaacgtttttttcggttttttttcccttccacgcgatggaaaagatctacgtttcatttttatagttttttctgttaggatgtttgttcggattggattataatttttttggaaaaggtttcagtgatgatcagtatttttttatttgtagtaaaatttatacactaaactttcaaattatagatataattctatgtaaatttacatatataaagtttctctctatatagaaagtttcctagtaaattgttcctttaaaaaaatccatcagcattttattatttctagtaaaatttacgcacttaactttctaactacagatgcattttctacatgaagtttacatatacaaagtttatatatatataatttacatatataaattctctatataaaaagttgaaagtttccacaagaactgtgttcaaaatgctataaaaaactataacgaaaaaaacgaaatatgaaaaaacggaagtgaaaaaaaaaacagaaagaatacttgcaacggattacgaaacaatcacgtaaaagaaggaaaaggaaaattgaaaacggaagaaaatagcgtgacccgatttgatttccctcttctaaactgattcgcgtgatccactgatggcgaacattcgcctacaaccctgttcgaacacaaccttgctttcatgctgcagcctagctactacaaaataataatttagatctcaacaaaggggccaaaatttgcacatccatactctttctatgtactgtcattaggatcaattagtagcggtaagactgtaatgacctgaaagttcagactggccgtgtatgtacaccaacatcaaaaattacatcatttaataaataatggagatgagcatattaagttttttcccctgaagtggagctgaagaattaatgagatgtggttgagaaggattattccgtcattgatagcaatggacccaacctattgtgcaacaaatggtggcatgagcaataagtttcataagtaacaactgaaaaaggtaccacaaagaaagttatttaataaaatgaatgcatttttacataagtaagacaatgtggcattcgagaggacaatttcagattcaccaaccatctgcacccgaaaccaacaaacctggccatgttcggtgtactggctcatccatgatatcatcaagcagaagaaagaaagcttgaaggtacccagactttctctgtacatcaagaagctcattgctgaaaaaaaaagagagaagaaatcgatgaagaagtcagatcctcctatagtagccaaactgcaaacaaatatgaatggaaaaagaacacagtgagtaaggtaggagaacatctattttttgaagtaaagacatgagtgatgtgaattatactgagaagaagttgattacagaaacaattggaggatattacatagaacagaaagcaaactgaattttcatgtcaagaaaaactcctaccagcttgtcgaaacaagattttggtaatactaaaagggggtggctatcaagctggaaaagtggatgggtttggagacaaggaattttatacaggttcaggccttcttaatcaagaagtaataccctactcctgttcgggatgattccgccgagtgtattattgatcatatgatctgagaaaaaatcgtgtcctgagaaggacccggaccactccttatatagaggaaggggtccgtattacaaaatacagtccatatccctaacggaatatgatattacagataaaatacaatcgtaaccgactaagaccccgggtacttccttgacatacaagttaagaaactaacccgagttcccataaagatattctatctatattcggtaccctgtatccaacctaactataactgccatgtagatatggggtatccataatctccacacagcttaactccgccacttttctgtcatctgagcaaacgccctagaagatccttctattccgctgaagctagatattccaccaggttgtgatctctttctctctttctttcaatctttggcctgatgatacgagcgaaagcaaagaaatcagtcagacagatattatactcgaattgcataggggacaaaaccaaacttctgttggaattaatagatgggccttagctgattcgaagattaattctttggaaaatcaaaaaagcccacctcataagatggcatacatggggagtttaataccaccttacttattctaggagagggggacctccgtaaaagggaggatgccctcctagccacttgaagcatgtgtggtggagagaagagggggaacgcacgcacgcgctcgcctagcctggcagggcaggcggcgcgccgcaaaattggctcatcacccttgcgcagatgcagcctccttttgcaattttgttttgctgcaggaaattcggatttgttttgttttggaaacattccgaaaaatccggtgcgtgaaaacagcgtggagtccggataagttacgcgtgacttatccattcagttacgcggagtggagatcgtgcgggcgctctgatcaagcgacctatctctatataagccgagccgccgtcttcacgcaacacacgcgaaatcaatctagggtttgcctcctactctgtgctgcgccgtcgctcgtagactactccatcccattcgccggcgtgcacaggcgatcgggagagcaggtctctagaacctctgccttcgacttcctgcaccgggagaaggcagcaataaggtttttgggaagcgcttcgcgcgactgctccctgttcatccgcgacggctcgccttcctctccgctcgcatgctgctgttaacaaccaaatttggtaatatcggcatcgggaaagaagattagatcgaagcaaagttagaggcggagatcgagttcgaaaacagagcaggaatcggctagagtccaaatcggctgcgataagatcggctgagtctgagtcggaataggtaagccgatgtagccgatctcaacaatacaacttgatgtatggtgtcaggttggattgaggtgcttcaaggtgattgccgcacatggatagaatcctaaggaggcaattgtatctattaattaggatgttttatgtaatttccttagagatacgtttgggaaaaagtctgtcgcaaaaacttatggtatcttagagtttgttagagatagcagttgtgtccgttatggacatatcttgtaattctcgggtataaatagacccgagccctatgtaatttttaacacacacgtccaatataatttcggcgcatcgccactctttttcctttagttttgtttcgacaagttcttgctttcgggttgagccgcattggtttcgatcttcaacaagaggtaaaacttgttatgacgacttgtgttctcgggattagggcttccatctttatgacactctgatctcgtttatgtaattcattgagttatcttatatcttacataatccctggcaatatcgttatctaatctacaatcgactaacatctgtcggtagagggcagccgattaggttagatatcgatgttgatttagattatataagatatctacaactctatgaaacttccagcggcttgattgtctagatattgttcttcttttcatacttaatgctgcatcagttgagtttgatctattaagttgtacttagaatatcaatctctagcctgttttctggttgccgattagggtagcatcggagtttcagccgatcttatttgacttaactacatttgctttatatgcttcattgacttgttaaatctgcccttttacgtcaaaatattgttgtatttaagtatattagacctttgtttgatatattatacttgttttaatatcatgatatagagtagtatcggagtattagccgatacatgttagatctatctgatcggctatgctataaacatatatagtcctgttattaatatatattttgatctaagtgatttatattgtctcggcacagcgaccgatctatcccaatcacttgatttaagtatatatcgatgtaagaattatatattggagatatctacagccgatcgaatagatttagtttttttattgtttatttacaactgccgatcgattcacacatgacatctgctcaaagataaatgatacgtcatcggcacctagccgatcggctatcatttatagatttaaccgcggtttctttgcttctatttcttgttgattacaggatcaaatcaactagcatgctagcatacccgaaggcgagctttggacctgcactggagttaagcagatctcccaggcctcgtgttttctgtcaacagctgcgcgccttcgtcgacgcccgcaaccgcgagtagttcctgccgagcaaccggtctttccacaatctcggtacgtgttcaatatgttgcgcatatttgatctgttcatgttatactgtgtagtttacatatatagatctaatgatgcgttcatgctagtttacatctgcaatgtcatgatttgtttatggaataaattaaatcattatgtgcttataatttcaacaatccaaaaaccttattataggccctgtggttttactatggctggttttgccgatgcactgaggccagataaattcaccggtgtgcactttaagagatggcagatcagggtcactctatggctgacagctatgaaatgcttctgggtgagtactggcaaacctgtgggagttcttactgctgaccaggagaaagaattcgatgaggccactactctctttgtgggatgcattcttagcgttcttggcgatcgtctggtcaaggtgtatatgcatatgaccgacgctaaggagttgtgggatgcactgaatactaaattcggtgctactaatgctagcaatgatctgtacatcatggagcagtttcatgactacaggatagctgacaatcgttctgtagttgagcaggctcatgagatacaaaccatggctaaggaactcgaactccttaagtgtgtcttacccaacaaatttgtggccggctgcattattccgaaactacctccatcttggagaggtttcggtactgcactcaaacacaagagacaggaatactccgttgaggggttgatagctctcttgatgtagaggaaaaagctcaggaaaaggacgccgcgtctaagggcgatggtgggcagtccagtgccaatgttgtgctcaaggcctagaacaagagcaaggggaaatacaaagctccacagaccaccaacttcaagaaacagaagaataacaacaaccatcttaacctggatgagaggacttgctttgtgtgtggcttgactggtcatctggccaagaagtgtccacaacgcaaggggatgaaggcacctacctgcagggcagactttcaagtctgaaaatgtgactattggcaacactggagatggaagcgggtatgctaatttacctactattttttcagttaatcagtctactaactagtgggttgatactagagccaatgtacatgtttgtgctgacatctcattgttttcttcttatcaggtcgcacggggttccaccatcctaatggggaatggggtttcaccgttcatggtgttggcacggtagatctgaagtttacttcgggaaagatcgtgcagcatgtccctactatcaataggaatcttgttagtggctcccgtctgactagggacggatttaagttggtttttgagtctaataaagtagtcgtgtctaaacatgaatattttattggtaaaggttatgagtgcggaggcctattccgcttttccctttctgatttctgcaataagtctgtgaaccatatttgtggcagtgtggatgatgaggctaatgtttggcactcacgtttatgtcatattaattttggcttgatgtctcggctatccagcatgtgtttaattcctaagttttccattgtcaaaggttctaagtgccatagttgtgtgcaatcgaagcaacctcgcaagcctcacaagactgccgaggagagaaacttggtacctctagaacccctacattcagatctttgtgaaatgaatggggtgttgacgaagggtgaaaagcaatatttcatgacgttgattgatgatgctactagattttgctatgtgtacttaggtaaaaagataaaaagacttaggtctgatcgtgttggagagtttttctcaaacgagtttgacttattctgtaaggaacatggtatcatacatgagaggatgcctccctattctcccaagtctaatgggattgctgaaaggatgaaccgcacactgactgacttagtgaatgccatgttggacaccgcagggctacctaaggcatggtgggggaggcattgtttacctcgaatcatgcgttaaacagagttcctaacagaaataaggacaaaacaccatacgagatatggattgggaaaaaaccatgactttcttacttgcgcacatgggagtgcttggcgaaagtcaatgtaccaataacgaagaagcgcaaacttggacctaagactgtggcatgtgtctttctgggatatgctcatcatagcattgctcatagattttctatagttaaatctgaggtacctgacatgcatgttggtacaattatggagtctcatgatgctaccttctttgagagctgtttcccaataaaggatacacatagtagttttagccaaccctctgaaataattcccagtttaatcacaccgccagaacaaaactgaacatacacatgaacatgtcactgaggaggatgacagtgaagctcctcgaaggagtaagagacaaaggacggctaagtcttttggtgatgatttcactgtgtacctcgtggatgacactcctaagtcaatttcggaagcatatgcatctcctgatgcaaactactggaaggaggttgtccgtggtgaaatggattccattatcgctaatgggacttaggaggtgacagagcgaccctatgggtgtaaacctgtggggtgcaagtgggtgttcaagaagaagcttaggcctgacggtactattgaaaagtacaaggctaggcttgttgctaagggctacactcagaaagaaggcaaagatttctttgacacttactcacatgttgctagattgaccacaattcgtgtgctactttccctagcagcctcacatggtcttctcgttcatcaaatggacgttaagacaacttttcttaatggagagctggatgaggagatctatatggatcaacctgatgggtttgtagttgaaggtcaagaaggcaaagtgtaaaaattgttgaagtctttgtatggtctaaaacaagctcctaagcaatggcatgagaaatttgacaaaacattgacatctgcaggctttacagtcaatgaggcagataaatgtgtgtactatcgccatggtgggggtgagggagttattctgtgattgtatgttaacgacataatgatatttgggacaaaccttgaggtgagaaatgaggttaaatcattcttgtctcaaaattttgatatgaaggatttgggagtagctgatgttatcttaaacattaatctgattagaggtgagaatgggattacactcttgcagtcccattatgtggagaagattttgaatcgctttggctacattgatagtaagccttctccaacaccttatgatcctagcttgttgcttcgcaagaacaaaagaattgttaggaatcaactggaatactccgaaatcattggctcgctgatgtacctggctagtgcaactaggcctgatatctcctttgctgtgagcaagttgagccggtttacctctaatccgggagatgatcactggcgtgcgcttgagcgagtaatgcgctatctgaaaggtactatggaattggggcttcactatactgggtatcctgcggtactggagggttatagtgattttaactggatctctgatatggatgagatcaaagccactagtggatatgttttcgcactgggtggtggtgctgtttcgtggaggtcttgcaaacagaccattttgacaaggtcaaccatggaagcagaactgacggcacttgatactgctactgttgaggcagaatggctgcatgatctattaatggatctgcctattgttgaaaaaccggtgccggctatccttatgaactgtgacaatcaaacggtaattgtcaaagtgaatagttctaaggataatatgaaatcgtctagacatgtgaaaagacgattgaagtctattaggaaattgagaaacttcgaagttataacgttggattacatccaaacagctagaaacctggcagatcccttcacgaagagactatcacgaaatgtgatagataatgcatcgaaggagatgggtttgagacccatgtgagttatactatggtggtaacctagtctatgtgatcggagatcccgtgaattagaacctgggaagaacaaaccattagtaaactagaggagagtaccaatctataccatctccaagtgaagatacatgtactctcatgagctgcaaggcaggttggctatgccttaataagttctgttggctttaattagcgaagatgctgtcctgcagagcattcttgaaagaactcacctttgtaagcttgactgttggtcgcagtctatggagattttgggtgaatcttgtaggaagcttactaaagacctaggagtatgacttatacgctccacccgaggggtagtctacagacggtctagtatcagataagactctaagtgaaacttgcttgcacaagacttgcaattcaaggcgtagtccattgttcaagttgtgagtaagtgtagcttggagttctagatggatgttcaaccttaatcggtctccatgttcaaccttgcgtccagagaaggttgctgatttcggaagacaacattgtatgccggttgttctaaagagaccagaagaaaaggaggtagaaaattgcatggtgctttgaggggagtcgtgggtgaggctgcagcatggaaatattttgaacattggatagacccagatcaattccaaccctttccaagaagctcctagcgaacgaacatgttacactaccacagaaaacctcattggtgccgtttggaaaaccccctaggtccctggaaggcggcattgatgtagaggggaaataggtgcctgtttagaactgacacctttgaggtttcacaaataaaaaaaaagtcagctcgagcagctccccttcacccctccatcccgaccaatccaagaacacatgaagaatattcaagatcaccagaacccaagaacacaaggaacacaaaaacactaagaatggccagccgacgtcggggagggcgccgcccgctgttgccgcctcccttcctgcagccgcccaccactgccgccacccttcctgccgttgccatcacctcccctcccaccggatttggtggaggggtgggcgccgcctgccgctgtcgccaccgcctactgccaccgcacgtcgccgccgccgcttccctcccacctgttgatgagaaacacggtggactaggagatttgcttcactctagtgaaggtcctaggcttgcctcgagtgtcaagagcgtgccagctagtttgatcttgcaaccagcaagaaagacaacaatcgtaattagatgaacgatagtcaatcgggtgacagagccgatgacgtatcgtcaggacccgtcacatgtaataaaatcattttctatatgccttagaacacaattttcttttttcaattttatcaaaattatccaactgaatgttgtggtttgtcagatgcaaattatattactagtgacaattttctgaattacctgaactttgcatattaacatagtatactgattgtccccccatgcttaatcacagtaaaacaaaaccaactctatgatactacctttggtttttaatatatgatgccgttgacttttcgacaaaagtttgactatttatcttattcaaattttagtgcaaataccacctcatgggatgggatgaatggggagtttagtaccaccttacttattctaggagatggggacctccttaaaagggaggatgccctcctagccacttgaagcatgtgtgatggagagaagagggggaacacgcgcgcgctcgctcgcctcgcctcgtagggcagggcagggcaggtgcgcgtgcacgacgtacgcgtcgaatggttcggttacgtggagtggagatcgtgcgggcgcgctgatcaagcgactattgacggtccttaaatcataatatctgacagtgttggtgaaatatgtgtatgcaggtaatttgaggagaaaacacatccgtcatgcgacaaaatgcacctccacgcattcaggacacgtttacatggattggaggccccataactcaagtaaacacctccaaatggtcccatctaccatgccaatgggctgagggcctcaaaattagtgtccacgacgaaaaacgggctgaatggagtcctcccgggttcggccgaaccatttcagaggtcgttgatcccgagattcgacgtagatggccctgattacatcctgatggtggttgcggggtagttgggtcatttcccatagcaacaaccatcatttggagcctatataaggaggagttcactctaatttccaacacacaactttgagctgaattacaagaggctctattgtatcttttgtacattagaataaggttgacagtgagggaaagctctggaggagtgcccggaagtttggtgctcatccaacttctacctcgacgagtgtagcttcctaggaggaattcgggagaagtaccggagctgtcggtacaccctgctctgggttcggagaacttcttctataaagtaagcattcgtgttcctttgttttgttatttaattactttttgtctaagtaagatagatttccatctttgcgggttcattgtttagttgtcgtactaagtgccctagtactgggactccgggtagaaaaggaagttcctacgcaagtattagagtagtaattaataacttagacgtggtgtctaggttagagattacctttgtttgttgtgtatcccatagatttgtcataggtagacgacaggtggtgacagccctgaatcctgtcctagcaatcctccacattcggatacatcatagagctatagccggaaccacgcttgcagattagcaggggtcggtgcccgaagcaacagataggaatttacctttaacttagcttagataattaaaatgcatagaaagtcctctctaacctgcctagcctacttatagttgttttccttggatcgtcttagccttagatagattacacacgttccctgagttcaatatccttttagggtcacccgaaggtgactgtgctacagtggtattccgtgcgcttgcggatttatctgtggtcgtaagaaataccaacaagcatttctggcgccgttgccggggaacggttgctaatttatctgagtctaggtcatcctcgtatctttatttttatttcttcttcttttattcctttctttgatggagcaacccacaattcaaaatctctctgctcctcgggctgatctatgtgagccatcgtgttattcaaaactaatcctttcggatggctaaaaaatcggtcctggctttatagccatgattcgagagcaaaccttctctggtggtattagtgaaaacccatacctccatcttcgggactttgagctagtgtgttcatgcctatccatcgtaggcatgacacatgaaactctaaagtggaagttgtttcctttttctcttagagatgaagcgaagcaatggtacactatgtctgtcaagaaattccacggtgaatgggaggagcttaagagcaatttctaccttactttctttccattaacccatgtaatcaatcttcgattagacattctttctttccgacagaacgagaaggaatctctcggtgtagcttgggccaggttctcacagttaacttagtctggtctagacttgtctttacccgaccatgtgttgttacaacattttcggtatggattagacaaggggtctgccgcaaatctcgatatttctgccggaggatcattcgcacacaagacaactgccgaaggaagagaactcttagatttgatcttagagaatgattatcccggatgtcgagattatccatgaggaacctttgcatgtggagtcgaaacccgactcaactgtcgaatcctcattccagtcgttggagccggaggaagaagaaattcatcctccggaaattccattccaattcagggatgatctttatgaagattatgagaacaccttgaattattccagcaaaatcaaggctcatcccaagcatgagccattcgaggaggtgatgtttgtatcttcgttcatttcttctgaacctattgaccatcttcatgaaactgaacgaccctcatcaccctcgatcaagtctaagccttgtccctctggccctcataacgttgttcttgtttatcatcatgaaacaacccgattcttgcatgatgtatctcttgagaaggaaagccttcaggccacaga

SEQ ID NO: 59559 - DNA, 35463 bp, Oryza sativa
gccgctgctcccaccggagaatatcaacgggccagatccgcaccgccggtgcccgggcagccgcgggggcgtgctctccgccgtcagctcgccggagtggctcctcccgcccgccagcgccagcgccccggcattgaccggcgccggcgacttagccgacccggacgacgacgacgacgaggtcgccacgctcgaccgcgcccgcagcggggacaccggcgagccaagatcggcgaacacgtccgccttcgcgtccggcttgtcccgcaccgcgccgccgccgccgccgtccagcgccagcgccgccgcgcgcacccgtatccggtccgcctccgacatcgccggatctcccgctctccgcctcagcaatgccgccacctacacccctcaaatcctcctcctcctccaatcccgagcaagcaagcaggcatagaaccacacccccccaagaacagcacagcttttgcccccaccttgtgcgcgcccgcggcgagatgaaccaccaccaccacccagcaagaactgcgagcaataaatcgccgagcaaaagcgcgagcggattccccgtgaggaggagaaatggaggatagcgtcaagggaagaaaagggggggggggggggggcagaagagaggagaagagaaggaagaagaaaggggaggagtgggaagcaggggggagaaatagcagtgggtggggggacttggggaggggctaccctggaattatggaagaaatccagggggcagagtgcaaaatatgttgtgtggttatttgggtcatctctggtgtgggttttgtggtttttggtctctagtgtcattggagtttagggtttttctggtttccttcttccgtttttgggtttttaggtgctggagtttcaattgttcttgttatgtaaaaacttttaagctgggtttgagtggctcctagtagtttttttttctttatagttgtttacttagatgaaagggtatagttgtttgtttggaaaaaaagggttagtttcatgttgttttcgtaacgtcggcgtttttattttatcgtgagtaatggattttctcaggtaagtataagccacgtcattattcgagcatctttacagctatgttcaaccataattattaattagcgttgtttttattgaaaaatcacatgtggcaactagtgttctactgatgtcaaagtcggtcgtgcagaaatcgacaagcgtaggcacttaaaaagtcatggtcaatgatgttctggtcttgttttgtagtcgtgttgttggttgatatagtgataagctttaaacacgtatgcatatatcttttattacatatgtcctaaatttttctatcccttattatcatcacgatgtctatatgagtcagcaagcaaaatacgtgtaaagagattatctttttacatatacgctcattaacattatcgtgtgatctgaaattttccatccttaattaatatcacaatgtccgcggggatataaaagtttgatcacatcaaagaagctttgaaaattacgtattagataatatggcaataagctttctacaagcgtgcatatctctagttacattgattccttaatcttccataaccttttaggtaacaccatgacgtttaaaaaaaaaacatatttcatcaacacaaaggtttcttatacaatttctgaaatggagtggcaatcttccagttacgcccacgtttagattttacgtccgcacgtattagggtctttttaacatagtgccagctatatttttacttttcttgagctatagttcagccaacagtttatgctcttctcaaaaagagagtggagatggctgaaactctcacaaaatgaatttgaaatgtagtgttgtgtttagaacgctccacaattttacttgagactcaactttaataagagatatctaagttatatgggatacataaatttcataatatggtaacaaatacatagttcaatgataacgaagaaaaaaccaatcatgtttttcatctgttttcactgttcttatgcaggaaacaaatgtaaatatgcatttatgaaatcttcaaaaacggatgcatattgcattttccgaggccatcaaaattcatgagagaaagagagagagggaagcatggagctcggtcccgaagctttccagccttctctctcacactgcatacgcaagcataccctaaaaaccagagaatctgcttcccaaaaacagagagagaagggatgagaagagacagcacaccatagatttccagtggacgccaaaatgaccgttctgcccccacaacaaacactgtgcttttcgctttcatgttcttgccaaccacgcacaccggaacacattccttcctaaccgcttcctgtgtctcaatgttatccttgtataaaactaaataaaaagctatgcactatgtcatcatatgtaaataaatttctaagttctggtgagaaacatcaacacaacattcctcattataactgtatcactatacaaaacaaaaaaaaaattggtcttcgcatgtaattcagtctaaaattattattattttcttcagcaagctttttggctcctttgaaacaaagtcatgaaatattatagaaaatttgcatatatagttctttggattaaaggaatagttaaaaaaatcatacgaaattcctttgtgttgggtcaaaacaggaatatttaaccatttgccacatttagatgtggcaattaactttttgccactggacccatatgtcattaagataggggtgacaaatatttatttaccaaatttaaaagtgacaaatagttaaaacccctgtcaaaacatagtgatcttggaagaattttattcatggaaaaaaaattgtctgtgtttatctttcctctaattgctacgcttccctgcattccatcgaaacagttatttctatctttttagggggggttttaatcaataggacactctaaaccatgtattttccatgttttatgatgaactctttccatcacaaaataattatttttctagagttcaaaaattgtctcaaaatagttcatatcatcctatctatttgtcccatcaatcatctcctattctagcttctctccattttatccccactactcacctacttacatttcaataagagatattgcagtattttctttttaaactttaatttatactaaacagtatagaatgatcagtattataggatgggagggagtgagaatattgtagtgtaaacgagccctcaatcctaagggcatgttagatctcaggagttgtttagatttcaacttttttcctttaaacttttaactttttcatcacatcgaactttcatacatacacaaattttcaactttttcatcacatcgttctaatttcttcaaactttcaattttggcgtggaactaaacacacctcaccctaaaattttacaccatatcacgtcaaacgtttaacacctacatgaagtattaaatataggctaaaaaataactaattacgcagattgcgactaatttgtgaaacgaatcttttaagcctaattgctctatgttttgaaaatttggtgctaaagtaaacatgtgctaatgacgggttaattaagcttaataaattcgtctttactgacggattctataattagtttttttattagtgctgaatattccatgcaacactctatataatatcacatgtgacacgccaaaactttgcactcctgtaccaacaccaccaaaaacaccccctaagttgatgtttgtaaaatttacctacccgctaccaacaaaccatacatgcaaccaagaaaacacggaaaaaggagagcgaagggcagtatggtaaattgacgttccccacgggacagggtcagcaagacatgcgtggcgcgtccggggagaacacccgcactgccagctaagcacgtccacctcatgtgggcagtgggccccactcagggtaggctcgggtcgtcaccttcacgtcggccgtggagtggagatcccgacggaatattccctccgcatccacgtggcaagccctgccccctgactaagcggcctccgtggatttaatcgaccacatttcaacttttcaactttcactctgtagaactgaaaagattaatagagcagagtacatttcagagtattgagagattagcctcttggcttactaaaaagataattaacgtacgattaatgttaaaacttctataatacaaacttaaatattgcatttacttgctaaaaaagcacttctatacataaagctcttttaaaaattgcaccgtttaacggcttgcaagcatgcacgtcataatatagtagctagttctctgtaatctactagtatttgtgttagggtaaatataaaattttggagtaattttatgagtattaaacttatttctacgaaaatcatgtattatttgtgttgctaaatgtgtccttttggccgtatgttcacaagtgatctccattactttagtgttttaatggagataaggtttggatggcataacacaatattccactatgaaagtgagccataggtaggattaagtactgtttaagtgcccaagccaaacgttaacaccatcaccaacaaaataattaggtaggtgaaccgctgctttccgtttaggattaagagcaacacgacgcagattgaattataaacagcagcgtttatattaccggtgtaatgcccatgttggcccctagcatttaccttaatctcaatactgccacctctactaaccacaaccccatcttttgtcttattcgagtttgcaaacgaaaaataatttataaatataacttttacatacgtcttcataatgatctaaaagcaaaagctgataaataaattacgatgaaaaaaaaatcaaaatcaactctaaatttaaggttaaaaatttaaaatttaactgataaaatataaacataaatataagggaaaagatgagtccgtacatctcatttttaacattttgaccggcaactctcgcaactgtgcatgccatcatacgtggcgttttgatcatgccctcgtgccagctggacgcgatctcctgtagcgtccacagcggccgccaagtacacggcctacccgttctgggaaaaaagcccaaaactttaccattattagtttattattaccggtttgttacacactgcatgcgaagccaccggaaattttatgcgagaaggggaaaatttgcacggcaattagctgtaatccggctgggaatttccggctaagcaagtacttaatgtgtccgatcatatcatatcgccagctatgttcggtgcaattagtggcttaagtccgagagaagtttttatgtgcgtgcttaatttgttggagagggtactggatgggcacagcagaactcaacccggtgcaattcacctgcaaaatggtgaggtttttggagatggagaggtgcggtttaaattgtaaattgtgcccgtcggattttattccttaattatgttacgtccatcatacaaaagtagttgtaagcatatgggattctaaagattatgacaataacaaaaacactgacggaaggaacataaatgatatagatggtttgacgtatataacgacaattttcatttcatatctatatcatttatggtcatgcagtcatgccctcatataacatgtggtgattcctttagcaaaactttcaatatttgagtttcgatcattttctattaagtaacctagataaacgaaaaccatatttgtatattaccattggaaatactttcaggatgacacagttaaatagctcatgctgtgatcctattttaaaaaaaaagttatcatggttatatcttaaaaccccgcgtcatctatttggcatttgtcatgctaaagttttacgatatttgtgctgacttaaattcaccctccactaaaaattaattggtgatgaattgcaacactgaaaatcattccatccctacctaagcttggacttcatgtctacccttccaatgcttccgtagttccattccttaagttttctatgatgatgataaagctagcttccattctactactgccaccaccacgtaccattgcatacgcacacatattgaaaccagcgaagctaaccctcatggatggtggtttacaatcccatcatttagcctttagttcatatgcataagcggaaatttaaaattttaattttaatcccagagttacttttgggtgtttcgtattgtacattctagcgttaaaaaaaacgcgttaaatagttttatttataaatcaattttattgctaataaacagtttcactataagcataagagggacaataattatattattctcttctctcatgagggggtttgatctgttcaaaaaggacaccacagtgcaaaacaaagccggaccacgctatgtgcttgggctacatatatagtcctttccttgccacgcacatatataggggagactggtcgccactgaccaacaactattggatcctaattaaaaagcctctccatggccggtaacacacagtggcggcgtgcatggtatcgtgcaagtcagagctaaaaagctggagtattgtgttgttgccagccaagtcggatgatgatggagacaccaaggccaggtcgtcgtgcacacatggaaaaaggagcgaagaatattgattttgggctttgtttacacgccgtgccggtattattttctttcgttatctgagatacgacgtgtaccatatactatcttttttttctcctgaaaaagggtgtaccaggtttgttctaactttcttcgattatctactacgcaatagcaattaatacgaaaatattgacttctataacttttttttttattggcgataagttgggatgaaaaaaaaatcagttctagcctgatgattgaggatgagaccaatgtcggagaaataggagtgataacattgtcggattaggataaaaccagtttttagttacataaataatactatatgtaatatttgatctatttgggtggaaataagaggtgaggtgcaaccaacctactcttctctcccagctgtacttgtaaaactcctggtgcatcttgtttggagctctataaaggatagggtcttgtttagttacaaattttttctttaaactttcaacttttccatcacatcaaaatttttatacatacgtaaacttccaacttttttatcacatcgttccaattttaactaaacttctaattttagcgtgaactaaatacaccccacgttacacacatggagagcggttttaatgaagaggagaaatgggaaggcaagaaagaagaatactagaattcaaggaggtcacattggccatgtcatgtgcctggaggccgtagacgagtcgtagtagattctctcctctcttctctctgtgtatgtgtgtgcgtgtttgtctttctgggctctggattgcagtcttgcagaggaagcgaggccatgatctgagcacggaaaacgctttggctgcacacaaaggctgcccctttttagctgttctgttcactggcctgcaggccatgacacaagcctcggctccagcacccacttcttccagggaggcacaagccctgaagcaccgtatgtatctcattggatgccttcgtctcttctgatattctcttctccggggtgtatgaactatgaagaatgtgggcactcaacgtgccaaaagcttgaccagatgtttatgttcgtcttgaattattataggttggccatgtctcgaccgggcagtgtgcgttatttatacttgcatgattacatttacatcaaagataacatggcttgtctgttaaattagactttggaaatgtcatgtgttcaaggtatcaataatgtaccgtgcatatcaccgtgtcgatatgtcgcagctcagctccatgaaactctgggcgtcagacgtgcatggagctactatagccacaggccacagctttctattctcctttaattaattaggaataccagatactgagtgtgtcggacagggaacagagcagaggaccgatgcgaaactcctgaaggcatcccggcgatgtgatgcaacaaggacctaggccaggagataaaaacggtatattttcgaaaacaatgctccgtcgatcaataattaaccagatttatcaattaaactatttagtattgatatcaatatgataagatattatctaaaaaatcaatatgataagatagaaattagaaaacctctcttacgttatgtggtaaaaaatatcggtcagaaatgatacgctcggtcagtagttgcaatttgcaaattgctgtgatcctatactcttcagtaattagtagtactactcgtacagtactccagtatatacacactcgtttattcccgatgcacacaggcgtttcttccggtatatgtttcgcggggccaactactctgccacacaacgctggctcaacaacccccccacggtaaacgaccgacctcgagtcacgtacggttagcgccataccggatgccaccccccaccccctccaccgcgcgctcatacgcggcgtggcggcggcggtgccgaacgctgaccccgaccccccgaccgacgacgacgagaacgcacacgcacacacgcacgcgcggcagcttgctaggctagcccgcctctcggccgcggcccgcgcgcgcgcgcatcatggcggactggatgcggtgatactgggatggcgcgtcgctgcatgccgtcgtcgatcgtcactactcccgcgtgcccgtgcccgtgcgcgcccacccacctctccagcgaggtggagcgagctgcgctacacgcggtacgcgcgctagctgcagctgctgcatgcatggcggctgggtggctgcctttggctggccgcgggtacgtacgtatagcgaccggaccgatcgacatatatgcggggtgatgggcggccgcgaccgcgcgcccatcacatgcacgctgcgtgtgcgtcggtacgtacgtacgcgcgcgccgggtactcgaaaggctgcgtgatggatggggtgtggcgcgcgcgggaggacgggacgggcgccgcacaacgtaattgcccatcggctcagctgcgtgcgtgcgtgcgttcgtgacgttttgcaccggcacgcgataggcgcgcatgcagccaccgaccttcacggggccgggagacccacatcggcgtttcttctcgacaaacagctcttccagtcttcttcttcttgtttttttgaatggtttagcgaggtttcagatgaacacaattaattatgtatacattgcacgagtaacttttcatctatgttatacacatagttattttcagcagaataaagaaattaatatttaaagactccatccgtttaatattgtaagttgtttttttttcaaagtcaaacttttttttaactttaacaaagtttatagaaaagaaatagcaacatctataatattgaatcaatgccattgaattcaatattgatatatcttgaaaatgttgctattttttctatgaacccaaccagaagtttgactttaaagaaaatcaaaacgcttatgatatgaaacagagtactatataatacttcatccatcccataatataaggcgcggttaaagttggtacggtctccaaaactaatctctagcttataatttctcataaactataaggtctgtagcaacaaaattataactatatgaaagtaaatttatatctcaatccaatgatataatttttaacaaataaaatctatttcatattatattaagtattggtcaaatcttttataggttgaatcttgaaaacacttgtacgccttatattataggacggagggagtatatgctaatttatttcttttaaaatagtggtagtattactctgaacctttatatgacctgtgtacaaactaaaatgtacactatcatattcttggataagaagattcgaattctaatatgttcccacgacttcaccatcacagaccatactaatgatgcttttccatgcatgccaatcgattcgatcataaaacggtggtgtgtaacaagaaaaagggggtgggtgattaagcgttcaagactgctaaaagcctaagatgctttctgtgcacgatgtgtacgatgattttgcctaccgccaatgattaatcaggcgattaacaacaaacttttccacacaccaccggtacatatttctctcttgcacatgacaggcgaaaaaaaaaaggaaagaaaagtcagcacaagagaacacgacaagtgtctcaacctaaactcatcgatacgataaagcacacgagagccattaatacgtagctgctttaatttcgtggagtattccttactacacatgaaccctactcctgttaagtacgtacgacgaaaccactaacaatttaattaagcaaatgcctcgctggtttccagccatctctgtgtgctgatacccaaactgcccaagttttgaaccacctttttccagacacaagctttaacaactaagagcacccgcaatggtaaagtagggtgctctctataaaacatgtacatctcagcaatagactagattaatagtaaaccacctcaatagtatgtctacataggtatctatagctctctcatgcattgcctcgtttttctctatagactatctctaagctagtagatagctttgctctctctcttcatttaatatcttccaagtaggaaaatatgctgacatggatctcttgtagatagcttatagataaccattgtgggtgccctaattaaggggagtacttaattacgagtactactcaaaagctggcaaaggtagtacgtaccacgtattagctaattctttctttccctaaaccagcgaatagtcttacactccctctgtacatcatacattctctttcctgaacgtgcaggtaattaaaagagaatagaaattactgttgcagtcttagttatgttctcctatttagaacagtaataatgtactagtattattgttatgtggctttttggaacgtgcgtataaactttcccagtgattaatccaaaattgatctctctaatgaaattaaaggtacttgtatcaatctatctatctatctatctatctatctatctattatcttctattatatactaaaagttcattaatcttcctacaaacactcttaaggagccacgtggcttcctaaaaacgctctcaagccgccacgtggcactctaataataaattagagaaaatcctacaaattctgagaaaaaaaacaaaacatctagcacttaattttcacttaaattggtgggacataatatttcaggccattagattaaatctattaaaatcattccttctaatatagatacgatgcatggagaggaaggtacgatgtactattcgtaaacagaaaaaaaaatcatatgcgatgcatatggaaggagaggaatgtacgtatgtactacctaaaaaaacaaaaaaaaaattacatgatatacgtttatatgaacgtaatgtaagatcgtatgatcggaaattaaaaagcataaagcgaaaaaaccaaatatatataaaagtccactaaactttctacaaatgcttttaagctgtcacgtgactcctacaaacgctactaagccatcacgtggcgctctaataaattagagaaatctaaaactttttgagaaaaaaaggaaaacatcatatcattgattttcacttaacatggtggacccatcattttatctcctattatctcacctgctcacttctttatccaaattttctagatagcagctcagtacataaacaataagaaatactatattaactatctattatatagtaaaaatcaaataaactccgtacaaacgctttcaaccaatgaaaaaaaaaaccaatgaaagtttgttgatatttcttcacgaaagagatatataaagaacactcaattcaaaattgaaaatacgttactttaattttaatttttttgttagaactattttcgaaacaaactaatgcgcggattatcttcctggttgtcatgaaaagacaacctttgctatcatgattatgttctcatatttagagtgtgaacaatgtattgttgtctctgattaacttaactagcaggtccattaagattataacgatacgacggtgcccaatgttaaagcaatgtaatgtacttgtaatgtacttagcacatttttaaacagtcaagggaatacagtaggtgctgccagtagctagcccagtcagtatacaatgcgactatctaatctaaaatccagtgatttgatttataataatcacatgagtacgtagtacatatggttgtcgcatccatggacgtgtacgtgttttgtttagaggagacagattatctccaagcccccatggccctcctgctttcggtttggtcggttgttgcagtaattaaacatgagcacgccttaatcctcaattagcaagccgtattaagctaattaacaagctcctctctctaattaatcttaattcttctctcatgagacaaatcttccaaagcgtccatctgatgatttgattaatccgagcctacacaaggctgggcatgcaagataggtgcatggaatattacaggcaggcaggatcagaaattcagaagtactacacatgtgcagtccagctgacactggctcttataatctcctcccttcacattaatcaaatcactcacaaggtgcatgcatggattgttcattagttggttagtagttaattagggcactcgttgatggagattagaggtgaagttatgtgagtggatggatctgggccgtccgttgctcctcgagatcggtgttgagagccattgatcggatgatgcatgcatgtactgctgctgtagtggtgtgtccagtgcaggagaatcatgtgtgtgtgggtgtgcggttcttgtcttgtccctgagtttaaattagggctgcagattaggtgctgaactcatgatgtttacaataatcaagctcctctcagacagatgaaatgtactataattaagaaggaaaaacaaatgcttcacaccagcccatgcatggtccctaacagttactgtttctgctcttttaaagaaaactgcacgaatcgtaaagcaaattacatgtcttgctaatactccgtgataaggaattttttatgttcaaaacatgatttctttgaaatttaaattttgacattacaataatttataaaatgtaataatttttatgatatcatgacaattcttttaagcaaatctactaatactatttcttgtttttaaagtaagcatttcagatgttattggtgatcaaagtttcaaagtttgatcaaatcttatcataaatgctatatatttataacttgagggagcagtttcattttggcttgtatcagagtagtcactacagctctcttggtgaatggtgatttcaagtgcctatagcagctcacatggaagatgaagtcattgtacgtgttctcttagccaattaattaagctgtctctgatctgtgagcatttgaaaagcacccgagttaattaaccaaaagatcagttctagttgggcatatggtatgaatgccagcaatatagtactcctagtgtgcctgtgtgtgtgggcaatgcaagccaccatgtttgcaagatttgcaaggttttaaacaaatggatttgatccaacaagaggccatgtgcatcctgtcagcaaagagaggggataactgcaccctcattctgtgcacttaccagaactgagacctccatagattccactgcactgtgcatgctgtgctcacaaaacacaaaaggaaacacaaaataattagttatctaacaaatcgtcctggcacaagaaacagagtttgcaggccagccattggctctggctgctgcttaatcagtgagaaaaagcaagtgattacagagatggatggccttgatcagttgtgtgcttgggatgacagtatctcctctctttggtggcttttggcttgcacaatggtaataaggttcagagcttttcatgtgggaggttcagtgtatgcagctgatgaagaagctcttcttttgtgcagagcatatttatagtttacctgtggcctgtctgtctgtcctccatggaaagataaagcgtcaccttaatcattgcatcccattattattattgcacactacagattcttgtgtgtgtatatatatatatatatatatatgtgtgtgtgtgtgtgctgtgtgagaggatttgaagccattgcagttcttgaccttggcagagtggacgttcagaaaactattgaattcaaggtcagatagatagatagcacaaaaggtgaatcaattggagcatggcaacagcaagcatactaaaagggagcaggtctgcttgacccagattgaggccatggcaaaatctatccaatgccaataaaagttgtcatgcaatgcaatgcaagggatgtttatggccatggtggtggtggtggtggtggtggtggttgttgttgcagcagaagcaagcagcagcccagcatgtgagctgagtggccaaggcataaatgttgatgagaggagaagatgtgtgagaaagagagccaatattgccaagggggttaccctacccctcttgtgaacccctaaactaaagagttgagaaaagtagatggggttgcacattgcacacctgtcctacttaatgcagatcaccatccacctgtgagtgtgtgtgtaatgcatcaatccacgtttgtttatcatttcatcctctctgatgatcagatgattcttcactcagtcacatctatgctttggggtcacaggttaatcaacggatgatggcacaccacacactacctagctaccactcctacttggtactcccattggatcaaatcaccgccacattgtttcatcttttcctcctctgatttgatctgcacttccaactcaaacctaactgagtttgtacttggtgaaccctctgatgagcctgcaaccaccactacaccccatgcctactgcctgctggactcagatgtcacatggcacaaaaaccatagaattgaactgaattattaacctcacatgtttcccttttcacacacttgtcaattgtgagctttgtatgtatgttcaaacatgagtaaataacatggttgtgctgaagatgaagctagggggtcaaatgttgcattgtgtctcaagatcccaaaacaagaattgttatagttatcctttatggcagtaagtactactagtaagtactagtaactaagcttagatttggtctgaagagatgtgccaaggaccaacaaggagagggagtaaagcatccaatggaacagttaaattggatgctattggctcacttaacacccccacaattaaatcttggcatgtgcagtaaaaattgtttgaccgtactgctgtttgtggcaatggtaacttggcaggataggagaagataaaaaggagattagactggatagatcttgcttaggactagtagtagtactggctagtccaggaagagtgattggtctatgttagatcgggattcagtagttattgattgggaattatatattgtcctcatggaccaagccagccagagtaatattttttttccttcctttttttgttcagagtccttgccctaggatatggttggtttgtagtaggatgcaagcaatgtaggtcagttcaaatttaagaaaatggatgaggctatctctttaggtgtcctttgggtgtcagatttcctgaagtttttgcgggaatttaaataattcatctgaaaattctgtaaaatttaactactccgtagtgtccaatccccaagcagtcaagcaacagcttactgtatttatttgtggatatttatgtatttgattatgtaaccttctttttgctaatcctaagtagtattaaccaattacaaaccttctgaaatagaatatttgattacttggattgtgtataaagaaatattatgttgaatcctttaattgcagaccttgtgtttgtgaagtcaagtatttttaagaagtccagtgtcatgaaaagaagttcagatcacactgttctggttcaattttgttctatgttgagggcttcttctttctttgtggtgttatgagatgcaggcaagcaaagctttaatgctgtcagagtgaaaactgaaactactaaagcatagtaggaacaaaaggattataacaagcataagatgacacagcattaggtgaggccagggtacataattttcattgtaccatgatccaaattcatagtgcttttattgtctcctctccttcgatctgaagccttgtaagtacacaattatatgcacagggagatagaaaacatacatgcatgttgcattagtccgcagacagctacaattacttcacttccctgacccaatctaaccatccttgcattgacaccccccgttgtgcaggtgcagcatctatttgctcttgatgatagttgccactaaactgtactataatgtgctcagggcaaagaaaaagaaaaaaaggctgcagccttttcattaaaaagacacaccccaattgcaaccttttcaggtagctagagagcatctcacagatccatgatggcaagcaaaatatggctttctgcataggttgttctcctgtggtttttgaggcagaaaaaaaaaagagagaaggagagatgcatccatccaatccacatgagccccaaccaccaagagttaaaggctttgctcatggcaactactgccttgatctcttctccttgacatgtactaccatgtaatggggtttgtgacaaagttgggagtagcctcaaaccagtcacaggcaccctgggttggctgggttctcaacatctgattgaaggtggtcacacagcagaaccgggcctgacaagtccttttcccttctaccatatgcatcctctttgtactctcaagactgtccccaagaaatattctcttcatcttgagattttatcccccactttaagccctcaacaaggtagttcccgttttttatatttctagaatttttttaaagaaagttttgttgataatttatagtatttgttacaaaattcaagtgctacattattttggaacatttacaagggcgtattggcattttctatttgattagctaagttagccgaggctaatgaccaaattaatttcagttagtaagaataatcgacgaatttctgaacgaaatattcattatcgattatttcggtatcagttagttcggttaggtttttcggtttcggccatttttctcatgcatagttggattggatggtgaattagtgagtgttgtttttctttttctttgagccgatggtgactggtgagtgagtggtgttggcaacagcagaggcatttgcctgcctcaaaccagagatgccaacgttttgcagcggaagggaacaaaaaagcccacgaaaagcccatgtgtactcgtctcgccaaaagcccacagagtggggcctacttgcaaaatcgttccttttatgccctctctacctggctccgtgcttcaaacaaaagcaggtaatagctctgaattattcatgtgcggcaattgagaaataaatgtatactgtaccggtgcattggacatggttagctgatctctccgtaccaagcgtaataaaaacacacaagcacttccctgcatctataatttgacctaccacacaatttgttacacttagcatccatgcaattctctttttgtccgactcttaacaaaaaagataaacactacgcgagatgttatgttacttgtgtggttctagtggctaacaaaaggtaatcacatatgacaaaaagatcgatgagctagagttcaccatatcgaacaggtgtaattaatcttctcccccgcgcgctaacacgtacgggtgaaaaagaggaggccgggtaagtagctatagacagcagacacaggtgagtcccacatgttccgtagccgccgcacaatatctggcctcctacctctgcctccgcctccatacgcacggccgccgcgcgcacaggggattttcgcggatcgcgcgcggcgcgtagcggcgtgcgtgttagcgtacgtaggtgaggccgtgagagagtgagctgtgagcggccgcgcgacgcgacgctttggcgcgcgcgggcgcggcggcggacgtacgtgcgacgtcgcgtacgtcgtcgtgactcacacagaccaccatgcgcgcgcgcgcgcgcgcggggcttcgctcgacgaccagccggggccggtcggcaggcggcggagacccccaccgtgcgcgtgagctggctgcacacgccgtttatgcatggtgttttatagtatttggttggagagatgtgatagatcggattggaatgaatctatcttttgaaagtttggtttcggaatatggttagaatggcattatttttgaaaataaatgttatctctagatctgagtcaattccataaaaaaaattaaacgactaatccaactcacctcctttatctcactgatatatgggctacacataattctcatttattaaagaaaaaattaagactatacaatccctctcattttaaaaaagaaaggatcatttcgtctcaaatatcaaatagaagtaagtagatagaatcattccaactgatggacctaatccattttatttcatttctaaacctaacacatattacgttctcatcctctatctttcagactttcactagtctgtcgtcacccatgatgagaactaatcccaggagagtgggaagagagagagagatggctggagagatcgatgagcagaagcgatgcaaatgcaagcagagcatccaatagatttgaacagaggagagggggacctgtctctcctcattggattccccctctctctctgcagccacacacaatgtcacaatgccactatccatttcttcctcgcatcgatattccattgttcccatctctgccgtcgttgatcgtctgctcgatcgctacttcatcatgtacacatccaacattacgtgcatatacacacatggtaataaatcctcggatcagattttgccatggatgaatttaatctgtccccctcagcaaatcaataccgtagcatagtatgcagtgatcactatctcaaaacgatatagagggatcactatgctgcgttcgttcgtgagatagggtgagaaaacacctcgttttccttgcgcacgctttctaaactactaaaacggtgtgtgttttacaaaaaattttctataggaaagttgttttaaaaaatcatattaatttttttaaaaatttaaaatagttaatactcaattaattatatgctaatgacttatattattttgcgtatctttccaatcttcctcattagatagattatgcatgacgcggcgtgagggagctatagctcgtggtccagatgttgggagccagcctgctgttattacggtcatacgacgccaccactatgtgtccaaaatctataggccggcgcgccttcccaggtaggtacgttcgcgtacgtacgcgatttactcactcacgtactgcgcgcagcagtgtgcatactgcgtacctctcgatcgatcgatcgatcgatacatcggtcggaccacacaaatatgtacagcatccgggaatgattaaagactagtagtaggctaaggctgtctttagatctttccaaaagttttgacgtatcccatcggatatacggacaaacatttgaagtattaaatatagactaataacaaaacaaattacagattccacctataaattgcaagacgaatttattaagcctaattaatccgtcattagtaaagttttactatagcacaacactgtcagatcatgcagcaattagacgttaaagattcgtctcgcatttacacacaatctgtgtaattagttttttttcctatatttaatatttcatgcatgtgtccaaacattagatgcgacagggtgaaaaatattgccaggggatctaaacatgccctaaatcagttttactttatccgtcccatgaaagacgaacctaataccaaatacaacatatctcagtactatcaatctgaacagttagttatattatattatgaacaatgtttcttgttagtttttatgttatattatgaataatgtttctttttagtttttatgggactcacggagtgttctatttgttccaaaatactgtacgaatctagaattggatgagacatttcaactttttcggatttgtagtataaaaaatatcacatctgattctaggttcttactacctccgtcccaaaataagtgcagccatggttttcagcgctcaactttgaccattcgtcttattttaattttttttgaaaaaaattaaagacataagtcacgagtaaagtactatccatgttttatcatcttataacaacaaaaatgctaattataaaaattttttaaataaaacaaacgatcaaagttgggcgcggaaactcatggctgcacttattttgggacgaaagtagtatattgttgtagcaggtacttataacagtttcaacgtctcgtcgtgcagttggatcgatcgatcgatcgcatcatggtccggcagccagtgaaggagtagctaaaagtagagtaggcgaatggtggcgcaacaacaatgcgctacagtggctaagccgttgaagtccgaacgttgcacagtgtttctctgtacccggggatcgatcccatgtatgattggcaagtagtactagtacatattggaccaaccatggtggctagctctgtaggtacgtgccaacttatacacatatacatgtatgtatatagaggtcggatcaataaaaaaaatattatctaaaagacttgtatgtgtatacgtatacatatacatgtagcgcattggttctcaccgagaagaagtagaagaaagatgatgattctaaaattcattgttctcgaccgacaactgcagcgtgatcgctcaatcatgcgtgcactgcgagtaactttcttgtgacgagcgagctggtactgatggattgatgagccacctccactgttccgctgcccaatcatggccaggccaaagatcacggcgagacagccagtataaaatatgcatgcacacctctttttttcaagaagagaaatcttcttgcgaatggaaatagacagtactacctagacacggtggcataataatatgggccttgtagtttgctgcccaaaccaaagttctctttttaagattatggttcagatgagggattgtggtcaatggttgagattaggaagcagatgaggaaaaattaaataagaaatagctggttgaagggcctatccattttagaggaacttcagcacataggaatagaaatacatgcacacttcaattcataggaatttttccataaagtttgtgtagatggaaaatttccttttgttttctctttgtaacttgtagggaagaaaatttttttttggttttcctatatctacattcgtatgaaccaaatgacattcatacgaattattccttaggaatctaaattctttgaaattcctctaaaacaaataggcctcaaatgagaaagtaggcggtgatactcttatatctctactacttaaaaaatttaacatgtttccgtcgtccgtcaacataaaaaaaacagcgaaaaaacaactaaaaaaatccgattccctagcgaaaaaaaaagatccgattcccacctaaaacaggaaaaaaagtccgatacctggcgaaaaaaaagaaacgtagatggaaaaaatatatctgattcccacctaaacggaaaaaaaatccgtttcctggcaaaaaaaaaagagaaaacaaatgtagatccgattcccacaacgggaaaaaaaagtccgattcctacaaagcgaaaaacaaaaaaaatccgcaaaaaataaaaaaaaccaaaaaacatatagaaaggtcagactctataagagagtggcaaaaaaaacgttcgtaaaaaaacgcacgaggaaaaaataaaaagggcggaaaaaagcgcggcaaaaaaaagtctaatttctattcgcagttttagtagtccatatatatctcttatctatctctaatttaatctaatctaactatttaaaagaagtttccatcatatattaaaaaagaaaaatgtacgagaaaataaaaatggtttaaaaaatgaaatgttagaaaaaagcgcaaaagaaaacgcgctagagaaaaaggtttccgtagtcaaaaaaacatatgagaaaatatttccatcgtctgaaaaaaaagaaaaaaaacatacgaggaaaaaactgtcagaaaaaaagctaaattgatggatgcttggtcatataggatcatcgattttttccatctcctacactgctttttgtttcgtcatctattctcctgtattggagaccctgcacatctctgtaggcaattatcagactatttttatgaagaatagctactattcttgataacatattatataaaaataatattagaaaataaacataatttaattgttatttagagaatagtgcacagtttatgactctattttatgtagacttgaccatgcgaggcagtctagaatttgattggttgcaagaatgagtttaaaagaatattttagattatatgcatgttgtcatatgaacaatccaattactttaagtaaagcaaatatgaataatccaattattttagataaagcagacatcggtaaggttgccatcatcgaggttgggccattacatttaagatgttctaattttttgtttgtcatcgacatggttatacatgtaaaacgtatgttatcattagttttttcacccgttacaacacacggacatgtttgctagttcttaaagaaattttaagctctagatgttcatacatttatgtggagtaccaaattttggcagtgttgtgatcaatgcgcttgatttgaagtcttgccatatttctataatatttgagtgaaaacttccggaactacttttttttagagcagcaatatttatatatgtatattcaggttgtcacttaccaaattttttcgtttcaaataattttatagggttcaaaatgatagcaaaccaaacaagatattcatccgttctcaaactacgcaatattagtattcttgggaaactaattccaagtaaatcaatgtgtttttggcccagcaagtgcttattaggagacgaatccaaacaattcaaagtttagaatttgaccaatgacatgacaaaaaggaatctttcatccctacctaaacaaacttatatatatttatctaatgatgaggtggttaattacaaagtactaccacatcgtttagagatcagcagaaaaccattaaccgagattcgttgtactgcacaaggaaacactacacctatagtcctatccataggtactccctttatctcacaaaaataaatctacgtgaggatatgataaaagattgtccagattcattgtcttacataaaatcacatttgcactagactttttttttatagagaaaatccatgcatatgcatgcgtgtgcgttgcctttacttttttcatccgttaccccccaccatgaatgtgatcacatgcacggcacgccatgatccatccatccatccgctttgcaccctatctcgcagtattcccccgatcaggaggctacccatgccggttgctcgcggcctatcccgccgcgccttgccctccccggctacaagagccaccatatcacaatcaatgcgtagtcgccttcgccttgcagtttggaggggtcgcacgggctcgtgtgtagcaaacgatgcgcccatcttttagccacccccaggctaccgatcgagcaagagggtagtgaaagcaagtttaataatagtatagtcaactactagctccaattcatctatagctaatctaataactcattcatactatagttacatactacactattaatatatggtctcatctgtcatacacactgcgctttaaagtccgtgctatagctggctacaaatttgtagcccgctgcttttatctcttctcacttatctctttaaaatatgtctgcagctggcttatagcctgctattgtacctgctctgagggtgaggccatcatgggatgggaggacacatagggcatgatggagatgggagcacgccggccggatggatgttgaccccgagcatgcatatggttggatggagcgaccgtcacagtggagtttgaaggccagccagccagctcccagctgctcgctaagtcgctagtgtgtgtgcattctgatgtggctgaaatgtttcacatggttcatcgatggacggatgctccgtgatatcaagtccatggaccaagtaaaaacataatggttggctacagtcgggtatagctcctgtttggggatcttctacttctggtagatgcaacaactcaaaatctcaggctctcccaaacaattcagatcataactcttgattctccaactcaatagttattacaggaactatggcttgttcgatttggaggaaaaccaaaggatttgaattcataaggattaatctctatgtgtagaaaaccaaagaaaatcctcccctttgtcccttgaaaaaaaaggagaaaatatccccttccaacaagttgtaaaagagagaacaaaattttccatccattcaaatctcttggaaaattcctatggattaaagtgtacatgcatttctattcctccatttatcatgttcctatgagttaaaattccaccaaaccgaataagcccttagaaaataaactagtacccagaattctaaattctcatctagttgtatatttattaactacttaaaatctctagcttccaaaacaaagctagtctgtctacacgagaagagtgttttagcactaacatgggcacttgacaccaagaagaataagctatggaaaactaatggtcaaggtggtgacctgacccaaaaaaaagaaatgcacgttcaccctcaacaactttaatcacaattcacagaagacacgggtttctatcgacaacggttactgttgtgttgatgggcctatacttctggactacacaacatggggccttcacagaataaatgaattacatgtaggggaggggagtatctgagtaaatcgccttgggtccatttgcacgaggcccattaaacctggtggagtggtggcacattctgggcattcaaaacatcccaacaaacatgttgactgtattcatgaactctacaatctacagccgtctgaacaaatatattatacacaaatagaatttctcctgtttcgcctgtccaactaggaccaagtgtggaagaagacatcctgactcctgagaaagggaacattctgtaacctctggaaggctctgaagcagcttcatttgggggcctcagtctcagaccatccagtttgcaaaactgacatgtaaatacactactgccgcaagcaggttgggaagaaaaaaggcatgatgctcaccatataggaacttcaacatttgcaaaacgaagatagagggccctcaattgctacagtaaatctagaataggtggctgctctgatgaaacattggaatgaggagtacgtgatgctcgtgaaagtgccgattgcccttgatttctaccacgccctcttccaacagaagcagatggaggaggagcaagcctgggtggaccctgtgttgtgctgcttgacaatgaccctgtactccgtcctccaattggatttccaaatccaagagctgagttgccctgattcaagtaattgcctgttgagttcacggccattaaattagtagtgttcggtttcgctgaccagctcatttggttggttttcatttgtcccagagaaccactgttgccactgaacccaatatttcctgtacttagtccagaaatactttggcttgtgcttgacaggtgtccaacagctaaaatgctggcaccactgcttgcttttgggggccagtcggcaaaaggatcaatatcagcaagaccatcactagatagccctccagatttactttgctcactaacagataatggtgcattaaagtcagacgatgtgttttttctaggaggccactcaatgtcaacaggaacacatgaaccagaagtttggggtccagagcttggtgcaagagattgcagtgatggaagtgatggtgcaggcgaaattgtagctggtgtcacttgcgggattgcagatgatggcttaggttgttgagtactgaaatcaaaaggaagtgccgagggttgctttgtttgagtgctgaaatcaaaagggtctgatggttgcttcatccgtgcattggaatcagatgactgtgatggagtgcttgctttcttagtagggccccagtcctcatcccatgcagcaccctttgcagtttgtatctgttcagtttgtcccacacctcgtgacaatggctcagaatgaatcccattagccaatgagggtgatacttttacctctgtattcccattatctgtaacagtcacaccacgcttctcctcaatcttgctgtagaagtaggcactaatttagttggcatattgattaacgcatcgcaagtgtggtgggacaaaaggtaccttgtgatatccttgacaaatagtatgtacttagcaaattgctgtacattcagttgatgtgctgtgagcagtgggaagacgagaggaatcacgtactccgcagcaaactcaacaccacactggatcattggcaaatgagtaaaataagatatcttttacaaggaaaaatcaattggcataaaaaataattgttcatgatttagcaatactgaaacaaactatatcaagaacaaacctgtttaaaaattgcattagccactccaagggtgcacataagtgttggtgcggtgtggtcaacagctgtacaacgccgaagagtttgcaagatctccagtatgccttctttatccaaagatggaacaagatcccctaaacagcgcaaggcatttacacgcacctatattttcaagtcacaattcaaaatcaagatcagaacaaagaaacataaaacacaaaataatataaggtacagaaggctgccttcctggtaattaggcgggattataatagggggtgataaaatacagaagaattatataatagcactatagtgacactaacatctaagatcttaacactcttgatcaataacaagctataggatggagtagctacatagaaaaaccatacactcaacatctcatggctcttatatttctgtttatttattttatgtgcaaacgagacaggagttttcccttttaattattcttttttaaaaaaaaagttgtttcatcatacatgctatttgtgtgttttaatgtgtattaatatggtacaatctgacacataaagtacccaaattataaaactaaaacatgtattatgcataccgcagcaactgtagtctttaaggctaatccatgtacgcgtggcagaacagactgtttcagtagctgcaagaagaaatcactgagtgagtacaaaaatggttcatgtggaattgttgattcttttgtcattgtgaagttaatttgtcaagtgagcccttactcaacgagaggcaaagatagtggctttctcaattgtgatggagaaaatgaagctacagtatatagtttatcctcattttaagaatatatttcaatgctaaccttcacgtcaagctgacgagacaatggcactgtccgtcgcagtacttcttcctgtagtcggggatcagtgtcatcataagcccgtaccagcataggaaggacatgtgatatcaaatgctcttgtgtggcctgaaaagagaagcatggtaaagaaattgattaggtcatctggccatggaaaattccagtaattacaactattgtgttggtaccattgtgaatttagattataattgcatttactatagagataaaaagagcaaaaacaaaaacaatgaatcagtgcagtatttataaaagtaacttagttaccttgtgaataataagatccgcatgcttcacgagcaaaagaagtgtttcacctgacgctgaagtaaataccggaacaagggccggcagtgttgaaagctcaaaatcacctttgtcctgccagagagcagagaacaaattttcagaaaaaaaaattatagcatttgcatcataaagaaacattaccatataacatagctttaaatgtatttcactttacaaactctatgaactcacgaaattgaagcataacaaacaaataacaatgttcgagtgttagtactgtggatgactctgtgttgcagcaagaatgatacaaccacattaaattggacttactccagtcaaaagcaagttcagatgaaaaacagtcaaataaaatatgatacttcacattatgcaaagtggtattacagaaccatggtatcatcccattagttaacaatcagtgagataagttcttactatcattgaacaaagaatataattcataaaatatttaagaaaaaggtattcgtaaaacacaaggaacatgacctgagattccgctattgttagaaccatgggcaaaatcattggctgcatgaccatgttgcgtaactcagcacagagaggtggaagaacctggttgcaaacagagtcagcttacagatagtcaatatattaagtaacattgtgaatcagcattttttttccttccgatagaaagaattcgcatgcacacatatgcaaacataagtaagttgcgcaaattcaatacattaatagaaaatccaagaaatgccattgacaagcactcaatttcaagaaatgtcatcaagtacaagttccatgaaatgccatcatacaagcaactttgtcccaaaaatgccattgccgttagggttccattagcagccctccgttaagtgctaaggatgaacagtgcacttaacggcgcgggattgggggaaccctaacagcgatggtatttctgagataaaatcgtttgtacgatggcattttatggaactcgcactcattgatggaatttcttggatttgggtgtttgtcaatggcatttcttggatttttctcattgattcattgaatcaaaactgtagataaggacaaaaaaggaaagtgataatgctaatagaaggatcaacaaaagtgattcctctctaaaagcaaacaggaggcgtgattcacctatgtaataaaggaatggaagttagaacattgaggtgtgtatatgttatctttttattttcaatattacaaccaatagttctcagtgtctcaacatttttttttttggcaaaataactagaacacactgaaattttgctatgtgatcttgataagctcaatagcacaaagaattgggcaatgatattgaattgaaaatttaagatggacttcctgttaattttatgagtatagtatagctgtcgatgcaaaaatacttatcagacaactgggaataagtaacatggaataattagataattagcaggttctaacatcttctatgaagcagcacacaaaccaagaaaatgtggccataatttcataagaccacacttgatatgaaaagtggagataatggattgctcatactttataccgaagaactcgggaatcgaagtccttccacatatccgataatgccttcagaaactccgtcttctgcatattgtctctctcctgaagacgatattggatcaagattataaccatttctaggtaacaaattagtatgttgtctgtttagacaaacaacagtcaagcagataaagctcctagttctgtcttcccacgtacaattgaaacttaagccaggcaaacgagattctcagatagaaaataagcaagctatgatatgcatatatatgaaacaagcaactaacttatctgtgaaaagaaactggagtaatagacacatacaagcaaatggtcaaggaaacgaagagcacgcaaccgcgtatcattccggaagaaggaagagcctatcagacagaaggtgcaacatttcaaaagaatttcatgtaagtataggtaacctggtgatctccaatcaaatagaacatccaaaaactccattctggaagatcttatgcccaagataaagaaatgataagtgataatttacctgtgaacgccatagcactagggcgtgatgctacatcaactgatagcatcctttgcaaatccaccactaaatcagcaggaatattagaaaaggcttcacttgttaaatacgtcaaggaattcatatactgcaaaacaaaatgaaacatcaacacatctttaaaaatgctaacattgcagcagatgcaaccttaattccttaacagatggtttgtttgcataccaaagggaaactacatacatgtaccaacagcagttcagagatcaggtaattaaaattcaaaaaaaaaagcattaagaataggtaaaatgtcaaaatccagattcaagacataccattttcacattgttatggcaatccagaagtggtctacgagcaaccaggtgataagctagacatccaaaactaaatatgtcacaagccgagccaactttagaatctccacttcggaccaattctggtgcagtataattcagagatggttgaagaggtaaagctgtatcctcaacatcatagtcctttagagggaccaaacagacaaatagattatgattcaaattgtgaaaatgacacaatgatgggtattagaaagcaggttccacaaacagctaattacattgacaaacagtgttagcaaaaataattacaggggaagccaagttgtaaataatgtttacttgttcactgctaagtacttaagtaggaaatgatttgtgccattataaagaaaagcacttccattgaatgtggaaataactcagataacagtagctgtacatgcttgatgagttaaacaaaaaagagcaagaagaattatgtgctttatcatggagtgcaatcaggtcagctaagagaatctttatcaattatagtagaaatatttatgctattgctccaattagttagtgtatccaaaatggtaaaacaaatacacagcttaaaagctatcacataatgcacaactaagcataaattacttactaaccgaatagtggaattgctgtgttgatgtcaaactgcctgtggcttggtcaacagaaagagcaaaaccaaacccaccaagtttccaagatccattcaaagttataaagaccgtctgcaaaagaaatcaaattattacaacgacagaacataagacttgcagatgaagaccaaataggctaaatgcattatgcaagagcaggggaaatcacagattcaaaaattaactagtatatgcatgatcattggcaggcagtgttagattatgtgttcccgcaacaccagttcgtgcagcagattcttttgaactcatttcatgcatagttaagtgcgcaaaaaacagcatgataaaattgagcggctagcctagatcacagcatgatatgaatggacttggctaagcattcatcagagacaactccaaggcaaagaacattatattgttgtactagaaaacttgagaaactaactaaagtaaataaaacaggtaaaatgaaaaaggattctaacagatttatgacaaagcacatccataacatgaaacattcgtgcagaaactatgagttgaagaatgtgctgcattcaacctcgggtgatatagctcgatgggcaagatgggcattgttatgaagaaagtctagtgtctctgagacttgtagcaacccgtgtttaacctccagtagccccatttcctgaaacataacaataaacaagcaaatctcagtacagctgaaacacatcgtcatgctttatagaacccacggcactttttgtaaatgaatgtattctaagtaccacgtaacaatttatatgccttcccaggaaacttggcagatttcagacagattgattgcattagaaagttaactgcaaagaaagctcgctgcaaatgtttataagtaccaatgatcccatttaatgaattttctggatatggcactgcaaagtgttgcatacaaaagacaaagccttatgtcaattttcagctcaaattatgttctaacgcacaaatctagataatgttactaaatatatcccaactcacaaatggtacagttgccagtttaccactgtcagtaacactaatcacttcaacatgttaattagaaggaacttttgagctagcaaacatcccatgcccaaaataaaccaaatcacagatcttgtggactctagagcggctaattactagcaatcgccaaagtggacatctaggcacacggaaacctaacaaaaaataagcgaggcagcatcgctccgtaccatgcccttgagctccttgggcaccttgccgacgttgtcgaggcagccgagcgcgttggcgacggacgcgaacaccggctcggtggccatggccatggcggccttggtctcgtccagcgcctggacgacgtggagcaccccggggtgccggaggcgcacgagccgcgcggcgtcggcgcgggcgaggtcgaggaaggcgtcctcggcggccttggtgagccccgcccgcgcccgcgcctcggcgagcgcccgcttgtcgagcacccagacggagaccaccgggtagggcgcggacggcgccccctcccgcggccgcgccgtgtagatccgccatgcgaggccggggccccccgacccggcctgctcgagcagctcgaagtcctgcagcggccgcggccccgtcacctcctgcaccgtcgtcgtcaccgtcttctcgatcaccgccgacgccttcgccagcgcctgcgtcagcgtcttcatgttcagcgccatctccccccttccccctccgcctccgcctccgccgccgccgcagccgccgccggcgagatctgggagccccccgctgcttacgtcggcggaggaggggtccttcgatcggtcggtcggtggctgcgtgtgtttggtgatttttacgggtttttgtttcttaatttttccacctaattttcatgattttttttctctcattctcgcgtgactccgagacagcgaggaggatgcttcgtggcgaaagggttggattggggaaattttggttcgatctgggccgtccgttctgtctggcggatgggatggacgggtaggattcgtcgattcggtggggaacgggaggaagttggtggggtgcgttaacgctttcgctaatcacgttccgattcagtcaacggatttttttaagggggtaattgcgaaattaacaacacggtttttgtgctgtataacctgtgttaccttcaggtatacggttgccagtacagcgagaaggcggataatggtagtacggacctgtttggtataggagttaggtctaatgtggagttgtggagctgcctaaatccagctccacaactctagtttatttcgtgagatagctcaacccagctccactcccagttttggtggagttgaaactatttggctgagctccaactccaggagggttggagctgaagctgtgtcaaacaggtcctacgtaaaccttttctgaaggcgtaaaacactagctcagcttagacgtttagaacttgattcgcggagtggtggtgtttttaaaagccttgttagagggtgtaattaactcattaaacacccaagtttaaggaatgggtgaaggttaaacacctaaactatcagtcaaagtagggcgtcttctttattgctcgaaggtgtttttttcatttggatctgttatgaaacaacagggtgatatcatccatataaaaggatggatcacaaccgaaggcaaccgcgccttccttaggcgctccttggcaacagacgcgatggttcccaaccatcgtgtctccggttgccaccccttccccatctatatattgtaccgcattgatcaataaaggattccgctcattcattccctacattcttgtgcaattctctctctctctcgctcaatccctctcgctcaatcaatcttattcacttttaacatgttattagcactttcgctctcgcgaaggagatcgcgaagtgaaagaaggaagaaacatcgcttttgatctaacagaaaagcgaacagaagaatcaacaaagaaggtacgatgcctacctttcattggattatggatgccgttctcggcctctctcgcaatcagcgcgtccgtcgccttcgccatcttctccgtcgatgggagaggagtcgccgccaccaccacggtcgccaccaacaccatgaacgtcgggctagggctggtgcccgtcgccaccaccctcgccgacgcatcgtggtggccactactccggttgctcctccttcgcctccgtctccgattgccgtcgtgcctcgccgtatctgtgtgcagggggtgcagtactgcgcctaccacggatggacagcagtggtgacactgcccggcgagccatgcgatctttccccggagatggagtcgctgccgccaccaccgaccgctccttcaccacttccaccgacaccaagttgactccaacgccgttcccccattcccgcgtcaccggggtccggcgggaccggtaccctggctgcgcgcacgagggagccgcccttcttcaatccgtcctcgtctcatcgtcatgccggtgaagccgccgctcgccgtcccggcctccaccacaccttcatcgtcgttcctcatggctctcctagccgtacactccctaacggggtgccggggaatggtgtccgggctcggccggcctccgattccgatgaggatcgggagccgtcggcctaatccggccggcaaaccgccggcggacgaagaggtggccgtggcggcagtggatggtggatggcgacagcggtgggtggcggattgtggatgcaggcagtggtggacaacggcggatatggaggcagcaacgccggcgcatcacgcgtcggcgctgcaactgggagatggcggcggcagatggtgcggcggcgacggaggaagggcggcgccaccctcggcactccctcggcggcgtcgttggcgatccacggcggcgtcgttagcggcgaactggcagcggtcggcggcgaaatggcggcggtgggcggcgaaaagggcgggggcgtgagcggcaaaaacggcggcggcggcgaaatcgtgggggcggttagggttaaccctaacacccccggcggctcccccctgccttttgctgtgggccggatgggccggcccaccgccccccttgcctgccggcctagtgccacacggtggt

SEQ ID NO: 59560 - DNA, 33250 bp, Oryza sativa
ctgcagccccttcctgggaagaagcaggaggcagcagcatcaggggttgtgtgggtcagaggagctggccaagcggcgacggattgtctcgaggctcgagtgtcacgtgcacgtggatctggtcaatcaggcaagtttgttggtggttctattctggctcgaggcgagagacagaccgagcaatttacttagctgcaagcagtaaggaattggtagtgcaataattaagctaatgcatggacaatatggatacgtggtagattaattgcatacatgtgtatgtgtatgcatgatggtcaacaggcccaggattggatgcacagcacaaggtgtggcactactaagggatggtcacgtggaaagcaagcaagatgcagtatttgtgcagtggtgtcacaggccattgagcaatgcatggagatcaaagcaagcaacggacttcatcaggggagaattgatatatccatacaatggacgagatggcatgagctaactcggttgcgttggcatggataggagatcatatttacctggagtccagaacttgatgattggtgcaaagcgttggtttggcggcgtggctcacaggcacaagacgggaggcatggtgcagctttgtggtgatcaaggtgatgtggttagtatacggctcgggagaaggtgcgcgaggtgtgcatctatgtcggttaaactggaccggcagggtggtcagaccgacggactggttagactgcggagtttggacggttagaccgggttcaatggacgtgtggtttattgcaagaacttgttaacggatccagaagaaggacaagaaggttctacagatggatagcttacaagtgtgaagggcgagtagactgtcggcaacaggctagtcaggtcacatatggaattatctgacggaaatgtgatatatctgggactcgataaggggttgagatatatggagttatgccagaggtgaagaaaaagtcccgggcaacaacgggtcaaatatcgttgatagggtcgacgatactgtttggcagtacatgatatatccaagatatgcaggttggcatgatggggatatatgaaatctgcgtcactgaagaggaaaagcaagtgctatggtgttaatttcttcaagtgattcaaggcaacggtgaattttctcaaagtattataggttcagtttacggatgcgggaaagcgagaatgttagatttattagatcggttcataagacaacaaggaagaaagggttatcttcaagtctggtgagtttgatttatctatttggtgatgatgcaggttatctgggcatggattagatcaagtcaaatttaagatggaagatggaggtgaacatggtcttcagggagtcaatgatgtgacagctaggaagaaatccaatttcgcttggcaagacgactgagatgataggtgaaaaggtggagcactgttgcaggtggaattaagaggaagaaattacagggatagcggagtctcttgaagacgatgggtctggcgtagactcgtcgggcggcttgcggtgaagctgcaaagaagacaacccaagtctggaggacaggtggatcggtatggtgattctactacttctgggtggcgtatattcgccaaggtggagtttgttaaaataggtgtcaaatatactagtcctatttggttacagttggacttggagttgtaatagatgttagggggtggagttagagtcgtactctgtaacccggtatctctcttaaatagagaggggggcaccacaatgtaactatggcgactacaatgtagcgtagacacgcagggagatgatggcagcgtaccatggactaatagcgactaggtgctatgttggttgcggaggagcacccataatcagagccccggggatgtaggcttcggctgagcctcgttaacaaatatcgtgtgttcttgtgtcgtcatctagcatgtcttgggtgatcaacgactgaagcgatcgggaaggttagtcgtcgtttcactatatcgactaacttttataacaggatgatatattaaaccaagtttagagattttgatgcgcgttttgtaagtttgtgtatctaagtgaaactttgaatccctagtgtgttttactctataaaaaaacacgaagtttttcccgtatcaaatcctagaagggtgcagtagagcagtgatgaatcgatcagacacaagggacggtatgattagagcagtgatgaatcgatcagaccaaagggacggtatgattagatgctgttgacagacacacagtaggagctgaggctgtctctgggccaacatgacatggccctgttcttctacaactgccgcctcaattgaaaaacaagttgcaactaactttgacaaacagccccgaatcttccatctcaaggtctctcaacaggatggctccaatttccagcttgaatttgactagtttactccgccgctcgcataataaatctaaagaatcagcaaccgatctactatgacaaatgcctcgcctaactgcatgcgttatcaggtgaataaactactactaggtgttcttgtaccggccatagctcgtagcttgtggaagagatggacaatgatgcatgtgccaatgagaatgcattctttgaaatgagtgatgtttttctttgacagaatttacaacctatcagttttcaaaaaagaatttgcaacctataataatcaggcaccgaatcgctctgttctgttctgtttttgtgcagagataagcagcacatgagatgctgacaactaaaaataatttccaaataatttgccaatgatgcatgctgacaaacttaatgaggatggtcaagattcttgctcgaaataatttctaaatggagaagttagagaaaaaaatgatactctaaatagagttctgtgcaaatgaggaaaattcagagttaattacctccattgtgctgccattgctgagcatgtctggaaaccagtggccatggccgttgtgccagcttctctgtccatcagcctccgatgccttgctccttgttcttgatctctttgagaactattgcaacgaaaacgaggacgagctcgattagagaaacaaatggatcaggaggattaattagtggaacaaacgatcgcgcgcactcacctccaccgacacgcatcgccggtgagccgagctccggcgagcggcatcttcgtcgtcgggcgagctcagctgccggagcgcgccgacgagcttcctggccgacgccgccgagcgcgtgccgtcgtccgcggcggcggcggcggcgccaccgtggcagcgcctgccgttccacgacgactccgacatcttcctgctcgaccacggcgacaacacgacgccgccgccgccgcccacgcctctccggccgagcaccaccacccctcgcttcttcagcctcagcttcctcagcgggtccgacgcgccggacgacgacagcgcgcaccgcttccggatcttggtcgcgacgaccacctcaccgtctctgtccaccaccaccgcgccgcgcctcagcatcgcggtggccgcctcaacgccgccgccgccgccgccgctcctcctcctcctccttcttggcaagaacaacacgagcagcagcaacaatgtgagctcttgtatggacagtcacagtggcgacagtgacgacacatcaaaagaatcgctacttcttggatttgcattgggatttgggaattgcttttggccaacatggacagcagcaagatcgatcaatgatgggtgtttgtgtggaatgggatggaatcagcaacaactgctgcttcgggcacggctttggatgaatcttgcggacatcgaactgatcaaagggagaaagcaaaaggaggaagaagatgggcagctttagtggaaggaataagaagcagcatcaagaatcccagcaaaagcaagcttacgatgtgaccccctcacatctcttcaagaagagaaaacacttaaagaatgagaagcagcatctctcatgatctccattgatacagagaaagatcctcacgattcacaaatctatgggaactgatgcaccaaaatatccttcaaattgttaatcgatcagcacaccaagaactggaggtacagtgttgaaggaaaccgaggatttatacttgtatccggcgaaagatcgctgggtttctttacagtacgaacagagcagagaagatcactgtaggaccacaagttcaaatggggttcaaactgtccaaatcaaggagagggaaagggaggagtaaaaaagggcagccatgaaaacaaatctacatggaatgttgtgctaggaactgcagaagtatacgccagtatgaccaaaacaaacaaacaaatcatacaaaatgcgcagaacaatgccgaattcaacgaaagaagaacaggttacttaaactaactcacccattaaagcccagaagcagagctgcaggagtaatcaagctagatcgccaaactccgctgatcgtcgcagaactagaatcagttcttgcgcgccatgattgggggactcattttttgcagtttgtgatcgagagggcacacgagtgcgtgcgtgctggggttgaagcaaatgagggggacaagatgatgggtgagtatatgggttgtgggggatgtgaaattgacaaattggtgtccctttgctgcagaatgagctgtctgtccgtccgttgcatatgattggagatttgggtatgcagtgttcggttctgtgtgcgtgagagcatatatatgttcttcagttaaagagggagaggagaggatcacaaaattccaaattggacagatgcttgaggcggcttaatcaggtttgggagatcaatcagagatgaaaattttcgttgcatactttaagggtgggtacaactgtacatattcaatggacgtcagattgctaacgactggatatcagatagtcagcaattataacgtcagatgtggttaaattttctccctcagtttgtacaccgaaagcaatagtttgcccgcgggaaagattttgcttaagtgtgtgttaaagaacgagtgtttagcgtgtacgtgacagtttaattcttttttttttcgtttatattagctgacgcactagcaaagaatgagtatttatgcatccaaataggcagacgtataggttcaggctaaatggcactgataaaatggggtaacagcgttgaaaacacggggggcttgatcattgcttccctaacaatccaaactaggagctcttgtagggtggtaaactagtaatctagtctatataacttaggagagtataggagttggtttctaggtgattcggccaatgtagcagacgacaaccagccacagccagcctaattacctaacctttgagacgatcgacggccggccaagttgagccatccgacattagcagcttcgttaatcctcaggcaccaccaggaacaaactaaacaacccaaaaaaacatagtagtactagccggcgacgcaacgcacatggggaagaagttgttgtttttttttttttttttggaaagaaggaaggataggaggagcagcgagatcaggccggcatgtggtcgcagatctcaaggagatcggagaaaactccccccacaaaagcagagtagagcagagcaagacattcaccgagcaccacacagcccacctcgatggacctcgatcgagtcgtgctcgccacgcgcgcccgcgctcgctcaaccgatcgagagcagcggaagccagccgcctcggcgaacgcggacgcggacgcgggcgctgctgccgcgcgcgacatgccgatcgacgtcgcgcacgtcggggggagcgggaggaccagcggcgccgcggggggcatggcggcatggggtgatgtgggggtggaaggttcagctcagatcgtagcactgtagcagcttgtggcagggttgccgcgtgcatggcacttggcagcatggctgcatggacggatggatggatgcagacaaacagtaggcgggcgcgtgtacccgcgacatgggtgggacggggccgactagcgcgcgggtgcgggctgcggagtggtgtgcgtacgcgtacgcggcagcgcggcgtgtaatgtaacgcctccgtcacaacatggcaacgtgcacggtcgaccatatcatatcgctccacaaatctgtaattatgtatcgtctcccgctgcgctctgacacgatgatctccggtcttaaaaaaaaagaggggaaagagattaagtttagttttcttttgtgctgggctgtggtacgtgctgttgggctgggctagagagtaaagagaggttgggacgtgtcacgctgccatgtgccaagttttggggttcagtgagcccggtcagctagcaggtcgacacctatttgtttgatgagtagacaagttgtgcccaaacctaggattattctaacgagtagcgaaggaattaacaggagtattaaaataccatatttgcattattcacatacatggggtgactactgcgcgcatacgcgccaactaaattgctggcgcgcacgtcagctgccccaccccagccctcccttatcttttttttttctttttgcaccttttttccgattttggtctctccggatgcgtttttctttttctttttcgccgtttcttttccgatttttttcaatctttcgcacacctctttacaaatatataactcaaagtttttaattttgatttgaaatttttcaaatttgagttgagttgaaagtttttaaattttaagttaaaagttttataatttgactcgaaagttttcaaatctgagttgaaagttttaaatttgagttgaaagttttcaaatctgagttgaaagttttaaattcgagttgaaagtttttaaattctggtcaaaagatttgaatattcgagttgaaattttttcaaatttaggtcgaaaggtttcaaattcgggttgaatttttttaaaatttgagatgaaagctttcaaaatttaacttaaaagttcaaaattcgacttaaaagttttcaaaatttacattgaaagttgtagattttcaatttttttgtgctgagaaaaaaaagaaaggttagcttaatataccataattatcgataactaattacgtatacgattttttttcttcaagtcctgcaaggaaaaaaaattcgagtcctgcgcagttcgttgcggaaaaaaagaaaaaggaggttgtagctagtgggccgcgcacgagaatatgggccgaaaacactcgcgacttagctagctggcgcgtctgcgcgcgataggaatctcgcatacatgggcacaagatctggttgttggtaattaacctggtccaagaagaacaactggtgacaaatatgtggaaatatggtcaatatggaatgcgacgaattctatacgccatcgagaaattctgaagagtatcaccgcgaccgttcaatggacatcatttggagattaatgtcatggagagaatgttgcagaaaatggaactataaacttctaactcataataacgctgtaaagattaatgtcgatggtgcctttgtcgaagatggtcattttggagcttcattacggccattagagatgatcggggcatgttcagaatatataacaaatggctgctagtatcgtctgctattgctgaggctatagcagtttgagatggtgttcatatggcatgcgagcatgggtttgacaaggtgatctattgaattttttttctcattcccatcggacagacgtatattcagcatatgttcattcctgggtgaagtatagaacttgtttaattgtttcgatattgattacagttgctactcttgcaaatatatggcagcacacaaatgtgtgctgaatatgtattcggggctagagtctagatatgggcgctggtagcaacaaacaacgaatgtgtgattgtctagtctaagatcctacttaattcgactgagaatgaagctcctaattccaaaaagaaagaaagaaaaaactatgattactcacatataaccaggggcggatccagaaacaaaaaattggaggcttgattatacagtttcttcaacctccagccatctagggacctttagtttattattcatggtgaaaaaattgaaggggtgctccgggggacatccatgggtcttgtgggcacccacgttggatccgcccctgcatataactgtgagggaaactaattgatgaatgctcacgagtgaccaaggtagcaaacatcttatctcatatatttaggcttcgttcgtaacggccagagtttggcatgtaaaacgagacaaatattagtgtattaattaattatacaccggaaagatggctttatttggtttttattcaaaaaacttctatatagaaattctttcagtaaaacgcaatgcttagctgtttggggagtgtgctcacggaaaacgatggaagtagcccagtcaagaatctgatctaaacgtaggcttagtctttatcccatccattggatctctagattaatttcccaccattgctgctccgcatcagttccttcaagccaccacgcacctgatgagcgccactccccctccctcctactagcctcaacgccagccgctagtgagccccgccactcctcctacccccatgttcctccttcctagcgagatgtcgataagctcgggaaccccttcttcatctttcccgtcatgtcacttcccctacatattttcatcctccatggaaaggtgccgacaagcttagatccctttttttttctacctctagagacatcaatgtcctcatcttcctcctcgctgatgagccccttgcctcatcccagggacactgacaaatggcatgcacctccttgttccttggatacagacatgatggtgagctccacacaagttatgggtagaaaacttttgaaattttgagtagaagaactttgattcgaaagttcaagggtttgatataaagtttttgagttttgagataatagtcttaggttcttaattagaagtgttgcgaccaaaatgatactctttccattctaaaatataacaatttatagcatttaaaatttgtcctaaagtataacaaattctccacctatattctcttttcaatcaatcacaaccttattccattcaagtcgacatgcttttttaatacccgtgtccaacctattacgtgtattttgagatgaaggtattactccataggcttcctgctttggtccatggaacccgcagccaaatgcctagcttaaataaacgtgctagatattggactagtccatgattagcatgttatacagaagcctagttgcctagtttttgaactcaaaacttaggttttggttttccggaataagtttactttagtctctcaatttgtcatcaagtctgaatttcttccctaaactgaaataacaggtatagtccatcccacaactcacaatatcgtgtcaactttggtctcttggcagtatagtggccagttttggctgacgtggcgagtgggccccacatgtcagggccatctattcttcctccaacctcccctctatctccatatccgattcttctctcttcctttgagtgtgctaggcgatataggagaggaataggagcgacaaggggcgtcggtgctcgagtggacggaaggcctcgacggcagtagtggagggtgttagagctatgagtagggcatggctcacatgagtagggcagcaaccggtaaagggagtacgggagatgaccggaatggcgatggaaagagctcagctctagtacgtagcaaagtggatgttggaaataaacacgtcatggtgtattcctggcgtggttgagtcagtgtgtgtgtgtcgtgctgctgcatgtgtgcgtcgtgtgcgttctgttagtttggttgagtcgtgatcacgagtgcatggctgctgcatggttgtttgcatggccgttgcagtgttgatcgagtcgtgggtgtgcatggtgtgcgtggcgtcggttcttgcggaggaagccgcgtcgtccgggcgagcgtgtggctcacggcgacgtcgagcgggttctgcggaacgtggcgcaatggccggcatggaggctagctcccggtgtgtcaccggtctataagaggcccctgtactccttcgttgtttctttgcaaggttcagtgagtaataaagccaagatacaggagcgatcggctccgcggcgttcgtcgctgtaaaatccattgttcatcgtctccctcaccggcgtttgtgttcgtgagtgtgagagtgttcctgggctgagccaacagtggagtggcggtggtagcttgtgacagtggctataagagaggggagataggaaaattggattcggtgggttgaggcagtgatgtggtgagaggagaaaggaagagggttaccggcagagaagattgcctggcaatagggattggctggacatggcagacagaggagagctcgaagagattgatgcatagtggggagaagggatgtgatgatgatgaaccgcagcagcagcggtgcctacggggaggaaggagcagagaaggttgcttggtcggctaagctgagcgctcgtgctcagctgtgcgttagagctatgcccgtcgttcatgctcgccgccacgtcgtcacttccgccccttcccccaatagcgatggggaatggaggagagagaggggagatggggaatcgctgaatcagagatggggaatggaggagagagaggggatgtaggccgctgcagtagttgtagcaccggagttatcttcgtcgtcaccgccgccgccaccaccaccaaaccagccctgcctccgctggagaagggagagaaggagatggacgcaaagctacggaggtggcacacgcggacggcgaggatgggcctttcgcagctgacacaaaggggacgatggccaccctcgtaaccgccggcggctccaacacggggattcagttcgctgttcgcgtgcttctctgctatgctcaccttgccttgcttgcaacaccgctgcaccaagctacaaccacttgctcgctaccaagttcactttaggagagagaagagttggctgctaatatatggggtccaagtgcgctccccacgtcagccaaaactagtcactgtactgtcaagggatcaaagttaacatggtattgtaagttgggggatgtgttatacctagtattcggttcaggaatgaattttagacttggcgacaaatttgagggaccgaaagtgaacttattcctggttttccttcccgaacgtccttcctgatgcaactctggataacccagggatcaacaacggttgggccaagccaggccaactccataaacagcccaggcccatcactacaacaaccagcccacaactgttcgtatcgctgtcagtctgtcactcacccaaaaacagaaaaactgattggaatgataactgcggctattcccgagctttctcaatttttaccaaagtttatcaaacccaccgaatctcgttgaactttttacccatttagcgtacccatcgattaggtcgataaccacgaaaccggaggaaggttttcgtcggttttggatcaatccttttattgcaaataaaaacgcaaagatgcatgtaatgatgcaggcaccaaccaaaactgttgacaaagcgatcgatcgatcgacaatcgacaggcaccacctgtcgttctcagggacgaaaagaggccgaaaagctcagcggcgaaatcgaccgcgaatctaaacattctctagcggcaaactgagacatgccttgggtgctcccatgtgcaggtgacaaaagaaaattaagagcagagcaggagctttgatcattagctcacatgcatagatcgatcaagcgaggaacatattcatggtaccttccgtggattcatggccccatatatagaattcgcttacaattttgctatatatttgtcgacaaattttctcccaaaaatttgacagatgtaattacagtacaaccgtagtataattacactgtaactataatataacttgtatgtaactttcaaaaatctctccataacatattattttggtaaaataaaggttgtgggaacaatttttttcagatatgtgtgtactgtgatttttttcttcctcaccaaaataaatctttataatagatctaataatttaaaattacgtgaaacttacatacaaattacactgtagttacatgcaagttacagtgtaagtacatacaagttacagtgtaattacactacgattgtattgtaattacatctgtcaaatttttaggagaaaatttatcgacaaatgtataggtggtcccttcgcttaaattaaaagctgcttctaaaccttacaggatgaacactcagaaacagagttagttttctctccgtctctaaaaagagtgaaaatgaagcaacacgaagtttttagacaagagaaatgaaaatggtacgaagtctcacattagctaagggaaaaggaaaacaaaaataggatgtagagtgagacctagcgccaagatctgaatccaagcctaagagtaagatgtagagagagatctagctccacatgcaaaataaagctactctctccgtttcttaataacgggtaattttgactttttcgtttaaattttgataattaattgcccttaaattgttagcccaaagcgaacaaatattttacttgtatttagggcataccctactttaataacatatggtatcatttttatcgtttgtaaatattaaaaataaattgagtgattaaggtttgaaaaaaaatagtgacttagtgtcacttattatgaaacggactaacggaggatactgcaatgtaagtccatctatacacctgagatggaaggaatctagggtggtgtttgaatctcccgaagatgaagatgaagatgaacattaagtgtttcacgtaaaacgaggtggtaataacgtgtgattaattaagttttaattattacaaacttgaaaaatggattaatctgattttttagaacaactttcatatagaaagtttttacacgaaactcactgtttagcggtttaaaaagtgtgccaccaaaatccaaaacttaatccatcctttttcagaggaaacttaatccaaaacttaaacgcacaaggctgactatcatacattaccagtttaaaaaggaatcaaatcctgactgttttagttgccggagggagtatctgacacaaaaaatcaaattgggtaaaaaatcccatgattgccgactccaaaatttcatatcctcatagaaatggagagaaattttatgttttgtcattgataactatctgatcctacaaattgctaaacttaagttatacaaaataccatcttacaaacaccccccctcctcattttgcaagactaataaaaaaatcatttggacaaatgtcatcatactaattgcccaaactatccttaggaatctcataaataattgaatagtagctggcaaaacaactttctatattctacagagtggtcttaacgaaaggtgggggatggtttttttttataaagggtatgtttagattgtagttaaaataaaccttatcaaattttgttggtattgccaaattttagcaagttgataatattgtaaaaattttagcaggattttttaatgtatttactaaagtttggccacaaactaaacgtagacatatttttgacaactatgccaacaaatggtatggttaaaaatggacctaacggctgtgataaaaaaaaggaaaagaacatttgttcaatcgcatttacatttatcgtttacaatttgcagagtcagtcacttgtcgataaaaaagggtaaaatttctcaatttgtagccctgaactttcatcaaacttctgaaaactaaatataaccgttcaccattcaaccatcaactagatttagggtccatttttataatgtgatacttgtgtggtaatgttagtcttaaatacatttcacaaaactacatatattttgataaaacaaatcacaaaactgatttaacaccacatttatcataaaactatatatttaagacattgtatcataaaattacaaatttagtgataaagttaagaagtacagagtttagagtttagaatccatagcactattatttttacaaagttacaaaatatgtagttttatgatacaataacttaaatccgtagtttcgtgaaaattttagtgttaaatctgtagttttgtgatactcatttttcaatctatagttttatgaaactataatagtttgatcaatgcgttgtcttgtttcaaagtttattatggtttgattttagacgaattccaaaggtactaaagtgaacgtcctttatttccaagtcccattatttcgcttattcgtatacttatacgaatctcttattagcaaataaaaaatatttatgagtaaaacctatatatttgtgtccttagcggcttaaaaaatgcaaaaaaaaatcaaattcaaaatcgagttatataacttaaattttgacttataaccataagaaaatgggttaattggattatgccattacaaatttgcctattcagaaaaatgtcattatcatagccgtgtcatttgtattttacaaaattagaaccgtaccacttccatcacattttccatctatccccttccttttccgtcttcttccttctttctcccatcttcttccctccgccgctagctgcgcctttcctcaccagtggctgtcgcctcccctattgcctaggcatagcgacagcgagagctgaacctggtcccggcccaacctcactggctactgccgcctcccctatttcctaggcacaccggcgctgcgttgctgcaagggggtggatgtagacagcgtgaagccggcggaatccactgagggagagcacaacagccccggagctgctgcttggaaaagccaaggtccgcccactcccgtacgcgcatggcctcctagagccgctcgtcctccacgagctaccgccaccaccagctcacacacaccatggccgctagcatccgcacctccgctcatcgtagcacctcaaacaccaggtcctccccaagatcccagaaccctcggttgctcaccctctcctgcatcctccggaggctactcttgctgctgttgttgttgcaatggcggctacaagtaatgggggtgaaaacagggtgggtatttcccgcccgcccgcccggccacattatttcgagacaaattcggatactcaagacttttctcggacatcgggtccgaatgcgggtcttttttggcggatacgagatcgggttcgggaacatcgtatccgacggatacaaattatccagtaaaaaatccgggtattacctggataattatacagatattacccatattatatttttgtgaggcactttttggtactatttattggttctactatgatgtattgtaccatatttattttctaaggtcataatagcctaatacaattgtattatggatatatggaattgttaaatggttattgtctatgtgatatataagattgttgctttgacttgatatccaaataaatattcgtaactgatagtgtacgtatctattttggtacgtattcgttccgtattttggcccgacattacctgagtttgtatctatattcgatactacccatgtccggctctattccgattataaaatatgggttagtatatgggaagggtgagatccgaccgaacctgacctgttttcacccttagcaaggaagaggaggcctcaccctggctcgaattagaggacggatcagtccactgcctcttggctggctcgtcggagccgccatcaccagcaatcggagcacggggctcatcaccgcctgacgaatcagagcaaaacttcatggtgcctgaggagggaagaagatgggagaaagaatgaagaagatggaaaagaaaggagatgtatggaaaacgtgatggcagtggcacagttctaattttgtaaaatttcagtggcacggctatgaataaataaattggaatggtatttttctgaataaaccaaatttgcacgaattcaaataaaccaaatttgtaatggcatggatccaattaaccctaagaaaattagcccttctgcaattaaggaacagcaacacgcaattgtaagatcgaatcaatggtgctcccgacggaatgtatcagaacaggtcttccagaaagatgcatcatccctccccctaagaagaagaagaagatgatgaagatgcatcagaagaagacaattgccagctgatccgcacaaaagcagcagaaaggaggaaggccgggccgccgtcacaagtcggcaaagctcagctcgtacggcaaacaacaaagagagaatacgtaccttcctatctggtacgagtatttcatgccaatcgttaattatctgctagctaaactaaacaatatattagccccttctgacctacctagtactactactacctcccttgcttttgatcatccgtttaggatctcaagttattcactgacaatataataatccattctctttctgttgttttttttaaaaaaatttacggagtaaagacagaagggaaaaagggaaggagcaggatttggcctacattttggtgtgataggtctttgggtgcatggtggcattggtccctcaagaacacagttgcagggcactatgtggactgtaccctaaggcacagccagcaaaatgcagatggtcactctgcactgtctgtctgatgaagggccaattgaaccttagtggcgaaggcttccaaaaagtgtacctgctgagattcccttaggtttggctatgatgagttaatggaataatcaggggtgcactggttctatcatgagaatttgttaatttgaattttgagggagggaactttgctttatttatttttgtgatagataaacttacccaaatcatatagttgtgttctttcagctggaaatggtgttatgttttcttctgtgagggaggtgctcaatgagtttttatccttaaatgacatttctttttggcaaatattgaataagaatacatatcctatataggtaacacctccttatattaaaattagctcaattcaatacattacatgtcactgagtttgtcacaggtttacaatttgcctctgactttatcacactctatgatatgccatcaacttttatttaacttctacatttaccatcgtcgtccggttagtctccgttaatacttacatacccaaatgaccaaaatacccctaggacgaaaactttcaaaatttggacaaaaattccaaaatatcatattataaacataagattgtaaatatccaaaatttggccaaaaattaaaagtatgatatttcagaatttttgtccaaattttggagttttttattcccaagggtattttaatcatttggataaaattataaaatactaatagaggctaaccgggcatcgatggtaatttgtaaaagttaagcaaaagtcgatggctcattgtataacatgacaaagtcgatggtaaattcagatctatgacaaactcaatggcatataatggattctgtcatcaatgtaacaccaattatatgctagggtaactcaatttttcaacatactccctccgtttcacaatgtaagtcattctatcatttctcacatttatattgatgttaagtattatatatggaaggagaatgtgtcacgacgagagagtatcacatgctagactagtgtggcgcgtgttattgggtgaacatgtcttatttggcatcccatttctatatctcttgtgcaattagtggtagatccaaaaattttctagagcctaggcatgggcgtcattaaactctgaatctctgatggcaaagagtgcctgcttgaatgtatcaggcctacgagctcagcctaatcttcaattccaggttgaaagactcaaattattcatgaaactcgatccgttggaacgtaagaacttacaagattttcataggatttagttcagttcttgtaaagatcatccgaaaatccatgttgatccaaaaagggccttgaagctcttagttaatttccacattattatctaaaaaaaagttaatttccacattagagcttcaaaaaaattactaaagattgatgctttaggcttggtttagttcccaactttttcttcaaacttcgaacttttccatcgcatcaaaactttcctacacatataaacttccaacttttttcttcaaactttcaattttagtcaaactttcaattttaacgtggaactaaacacaccctcagttgaaagtttgaaccagttgttttgagaacaccctaattaaactttctccatttaaaaccaagggtttcaacagaattgaaatttagtgggaaatcatttaaatcgatatatggaagtaacaatttcgggttggagagggtgtgcttccgccactatcatctggcacaaacagtgttgtaaataaaactagcacttgctaagattcaggggctattaattttatcacccagtcctccactgaagaacaatgcaattaagctgaatcatacatacatttcaatatggcgccaccggtgaacatggaaacaaatagtctttgaatagcacaaaagtatcgaacccaatgacaagaaacaaagcaatcactcaaggggagcaacctcaatctagtacagttgcaagttgcaaactctctacaagcacaagatatttttcccacaaaacatcaaaagaaacatgccaatccatgaatagctcagtacaaacttttgcacgagagctagccatgcatgcaatgagacatgcaacctataattgggaccatggcacaactcacagccatcataaacttttagagatgatgttgcattgatgttggtgccacactttagtcatttttgccaattaagcattagatagatcctcctttgctatagatcacttttgctttaatctttcaccagccttttgatgtagtaataagttactttttcctcttccctgtaatcctcctctcctctccttttctctcagtgcccataattctgctagccagctaccatatgcaactttttccatccatgtgatggtgaagcttcatggaagaagaagatagaagccatcacccctatatatacccatgcaaccctacaaaacaaactccatgccaaaacacatagatctccattgcatgcatgcagtacattgctagccacagctataacccactataggagattattagtgcacaatatcatcaacataattgtgtgattttgtgccaagtaaattgatctgagctgcattcaattggtggttcattgttcattttggtttagaagatgaagaaggcgtccaggttcttgaagggtctcttgtcggccatcgtggcggcggtgaaggcgaggtcgcggcggtgcgcgccaagacgagcgccgtgaggacgcgcctcatcgtcttgggcatcctccgcaacaagaagctcctcctcagcgccatcaacaggaagatccacgccatcgtcagcagcggcggcggcggcggcagcagccatggcgagtacggcggcggcggcgagagctatggcggcgagcagcagcagcacctgagtggcatccaccttgtcggcggcggcggttacaggaaggccgccgtgctgcatagcctgccgagcttcgtggtggagcaggagaggagcgccgtcgtgctgctcagcagcctgccgagcttcgccatggacagggacgtctacggcggcggcggcgaggcggaggcggaggaggagcaaggagtgggtgggaagcagcagcagcagtcggtgatcgagctggcgcgcggcgcggccgctgcggaggcaggcggcggcgcggagttcaggctggaggacgaaatcgaccacgtcgccgacgtattcatccggaggttccacgagcagatgaagctgcagaagctcgagtccttcaagaggctctgcgagatgctcgacaggagctaatttaatttaaactaagccatcgatttagtgagaatttgcatggtactaaggcagagtctgagggcgtaattagaataagtgacgatggaactatatgtatgtactcatgctctttcgttttagaggagaattgatgtaccaacacgagtcctaatgaaggaataagagatcagactacttttttttttgggaacgtcaaaatttcacacagaacacttgctcacattcttctaggaatttttctcgcgtgctaaatgggattttagaacatttttagcctgatgacaaaaatgatgtccgagctaatgagctagtattatacagtcgatcacatcaaaggattcttaaagattaggattaactattctgcagaatgatcatggttctaatgattcctttctggatgtgttggctgtgatttttgttctattcgatggtgtttgtaaaaagggatatgtaaaaaagacgccgtctgcttgaccactcagtttacactacagaaatctggacactttaactgttaaggaaaaagaactgaatttggtcggtaaaggggttactcaaacatgcatcccaccacaaaaaagtcttggcttggatagaaacgctttacacaagaaacatatccgcacaaaattttcggtgcctaagttttacaaaattacaaatctcatcaactctaaactgaaatatatcttgattattttgcactaacgcacactgaatcaagagagatggaggactgaaaatctggcatgcgtccgtttcagaatcgggcaaattccatatgccagcagaatcaatccactgattccaaatcccagtccaatcttaataaagttttgctatatttctgaggcagcattacatcagacttctgataatgtagtgaaatcagttacaaaattcaccaggaaacatcactctagtaatatcataagatatccaactgtacataacacagagcggcacaaatgcacaagtacttttttccgggaaaatgcacaagtactacaatgatatgtgcgggtgacgaaaaaaaagatgtcaactctactgtgtttaatagcacaatctgtacgtcctgcaagttagaaatagaagaacggaaatttcagatttcatatctgaaagtaaaatgacatgaactccgtagggatttaaacagaaataaatcagtaaagaggatccttctgaaatttggaaggaaatgtctatacatatgactagcgtgtaccatttgtgtctgactagtgcaaagctgctacatgcctaggcccacatgggaagatgttgagagtgttgattggtggtcggatgtgagtcctacagcttcagtcgtacgtatagcagaactcaatttggaattactgaaggatacagaacacaaaaccaagtattaccagttgtttttctttagtgtcagaaatatcaacgttgcgccatcttattactgtttaaatccacccctttgcttcacttttgaacggttctatcttgaaagagactgcaaatccttcatccattcccagattaacaagaaaaatagcagcagagaaccagaaacagtttagaattttatactgttatgcaaagggaacaaaagagaggttgagaaacacaaaattgcaaaagaataaagccaaaacttcagtttgaaagagaaaatgattgaactgcgtggtgatttctttagcataaaaggagctaaagagaccatttaccattcttctacagccttttatttcggttttgaattgcaatatttacttgcttgagacttacagagaaaatcttatatcaattcagcgatttgcttctccacaaaactacaaaattgaagcagccttcacttataaacatattcaacagaatatgaacatactcataagataaaaaaggccattgtgtttaggttaactgtaaaatagaggggaaatattttgagtaaatcagaactagattattggataaatatagctaaagatagttcacaggaggcataatacagcaagcgtacaaagaaaagtagaataacaatcgaagaagtccaatgataaacagttaagatttgatgaaatatgtaacaaaatagttcatattgattgattttaactaacaacaggagataagtcatctgacatgaaaaatatatatttcagatgaaaatggttttaaaatatacatttactggctggataactaaagcatgtttacttaaatacgaatggcatggaaataaattcagaaacctagcaagaagaaggaaacatgacgctaagaagacacaatcatatatttttcaacatcatatgatgtaagaaagcccaacgatagccaagctcagatgttgcacctttgctctctagttactagagttcaattcccataaatctgttttctttttttcttttgttgattttccactgttgtaagaccttacaagagtacactagccaattgttcccaattcccaccctcagaaaaaataactgtacatgtagaatttgcattggtaagccatggcatatgaaattatcaatcaatgtgtcaataattatagcacgtattcattgggacccccagtatcatttgcatagcagtcttcccttttttttaatctcattttgtcgatttcgataagtgctattcacatgattccaaaagatgtatgtctcggatcttagctaagtagctacttgaaatgtgcattcattcaatcacttttgtttacctggtactaataagtttctacatttatcctgcagacatgacatgtcatattatcgtatccaaatttcagattatgattgcttttggggtacctgctatcaaggttgggaaacatttcaggaacttcgaccattattcagatttttgtagaatttagctccaactgacacatattttctttctctcaccaaaggccattacaatatcaaagttgtaattttaggggacaaaaagggaataaaaaaccatttaactttaataagtaaggtttggccttcaaccaattaagagataatgatgcaagggaatcatacttgtcaatactgtttaaaaaaacattggtggaatttgctgttttaacaggaacaaaaatttcacctagtggtaatataaatacaaaacctcaaaaaattagcagaggcgcaaagcagagatagatgatccacacactagtagtacagtgtgtactaatgaaaaaacaacgtgtagtgcctgttctttatatgaatactagtttgtaagtatgaactatgaacagcataactacaatcagtatctcactatctcctggagcaggtatgaggacatgaacatgcactccaatttcattcaaatattttacttgagcaacatctacaagggaaatcagataccaaaggacgagtaatttacattgtttgtggaatgcactcatgaattcaggtgtgctatgctgagtacgatacttgaatgtcaaaagcctaatatacatgaattcaggtgtgcaaaccaagctttagagaacaagaggtttcagcattgagtgtactgttaacagggaccattgatatttcattgtttgccaagaaacgtgcttattcataagctattgctagagaagattctaagttctaaataaccataaggaagacggcaaactttaggagaacaaataagcaaaaaggtttattttcaagctcattacagtcaagtagttttaatgttcaaatcattaaaggacacttttaagcctgtggttgcagtatcagtgttatatatataatattaaataagtttacaggaacataaattttgtaacagtaaaattcgaccgacaaagtctcgggttgtggtgcatactttagcatggagtttcttccaatgctactgaacatcatatttcttcataacccttaataggttattcctaaatggctgcactagtaatggtaaacccaactctacccaattgaacaagttcttgggccttttgatgtgttaaatagtactgaaaatctagaagagctaacacccagaaaaaaacagcaagagatagaacagaaacaacacatgtacaatattccttagtacacaccttgcaacagtgtgcataacgaaaggtccttgtattgtattatggtgttgcaatgactactaaaggtagcaagaacacacatgaaagaagtgtaaagcaatttacaatccttggacaaaatcatacctttaacagggcttgccaaatatgaactatgttcttcttctagagtggttggctggccccggtgcaccctcaaacaaatcagaaagctgactttccaagtcctctggggtgtattttatatatttccctgaatttcttcccccatccacttggctaccatatcttcccaaaaaagcacgatatgccggaataacattttcagatatggatattttcagctcttctcggagctgaggatctggaactttccaggttgtttggttcctgtatatttcctcaaaggccaggttgaagttcttgaacttctccttgatggacatccgagaacttgaatgcccactgccactgccgctgctgctgccgctcccacttccatgtccatcatccttcagaaaagataaaaccttcatccaggaaatccttaggtagctctttgaatactgccggatcttgccattacgcctttttacccagtgatcacctaaaatcttgccgagctcagagtccctcaccttttgaacaatgtacagcaaattgttcatggaaaatatgcactccagggcgctatcttcatacagcttagatttttcctccaagttagcctccaaataagatatcagcttcaaaaggcgctttccaagaggggtcatgctctccaagtgttcctgatcctgatcctcagctcttgccaaatcaatttggtcatcggcattgtcatccaagagggcatcaagtgtgtcgctgtaaacaaccagaagcctcaaatagttcatgacgtagcgtgtcatggggtggatctcaccagctgtcattgccctccgtgatgactccagctgcaaaaccttcccaaactcgaaaagtgtacccctaatggcatccccaagcctatcaagattcgcctgaacatcgctgatcacaccatccccagaactgcccaagcacaaatccttcatctcagggatcacctctgcaagtgcctcatacatgtcaagaatccgcgagagcttctctggcgagcggggacacacagccacagcatccccaaagctgagaatctgcataatacaacctttggttgattcgatgaagcactcctccctgagctcatcggacacactgagcacctgatcgcagaggcgtcgctcaccagcgagcaggacacgcacgaccgtcttgaccgcctgcacccacttcttcatcttgtcattcaggtgcttccactcgatgcgctgcacctcgtcaatgctgaggcgctcgacgccgagcgcggagaggtactcgtcgagcaggtcacggcggatgccgcagtacgcgtcggcgagctcgcgcgagtacccggcgcgcgccatccggtcggcgatggcgcggaggtcgtcgacggcctcagggcgcacggggtcgaacacctggtcctcgaaggggttgaccaggggcccgccgcgcgcggtctccggcgcgacgtcgatgctgtgcggcgtggcggcgtcgaactcggaggaggtgtcgaggtcgtccatggagccgagcgagaggcggcgcagggagaagaagaggcccgtggggtcgagcggcacggcgtggcggaccatgaggtggcgcagctcctcctcgaggcgcgccatggcgagctgcacggcgaccccggcgcggcccgcggtggaggaggaggaggaccccgcgccgccggcgccgccgccgctgccgcgcgcgaggtgctcgatggccacgtcgaccgcggagaggtactcggcgacctcgtcctcggtggcctcgaagacgagcgcctccggggtgccgtcccagacctggatgagctgctcggcggcgtcgaaggccgcggccgagatctgcccccacagggggttcccccgttcgtcggagtcagcggcgaggtcgggggaggggaagaggtcggaggtgatctgggagaggcggttgtcgaagcccgagaggatgcggatcatgtcgtcggcggcgttcttggatgtcgccagcgacttgacgatgtgctgcgccgcggcgagcaccttgtcgcctccgccggcggcggcggcgaccggggactccggggggggaggcgggggcgccgccgacatcgccgaccaatcggggggattcggtggggaggggagcggaggtaacttgggtgttacgctgctttgcctagttgccttctctgctttgactgctagtgtgctagtgcttggtgttggctggcttggatcgccgaatcgtcgggtcgggtcgggtcgcgtgtccgaccggtcgcactggtggtggactgagaaggcgagctcaacgctcaacagtggcgatgattttttatcttttggggttggggttggagttggacggccgggggagccatgccccaaggtcgtgtacagtggaccgacgaccactgctccactaccaccagcagtggccggccggcgtgttgccccctacccatgttgcgtcttcttctattcttcttgggtctcagtcttaaatatatctctcaactagatataaaacatcctccaacttaataaaccgtgtaaaagaggtccttcaataatattgtacctggttttggctgacttgacgtctgcgtggctcctttgactttgactggttcttcatcgtacgtggtgttgacgtgtcacttagtgacaattgggtccggaaaaacaataaagcatatgggcccacatgtcagttttacatacacaataataataaaaggtttccccacgtggccccacctgtcatcctcactactcccctcttctctctatcctctctctccgggcattggagcggggcggacagtggccggagcgagcgacgggcgggcaggagcagggcgggcggaggccgcatgaacgcagcgtcattctccaccagcaagatggatagcgcgacgctcttgatgcccaacaccctgttgatgttgtgttggatggccttcccgcacacccatgcacgtgtagtcgatccggttgctatcgtcggcaaaggtgaggcgcgcgacaacgacgtccttctcgaacgcgatggcgtggaaggaggagcgggtacagacaagcatataggagatgtcgtcgaggacagcgtcggactacgcctggtcggcgtggactagggagaggacgtgcatggtgatggtggccctccgcgcgatggtgacgttggcaaagggcctcgtggactcacgcttggacgaacgcactgcaattgaggttcggaaaggtagacctagttggagggcaccgcgaaggagaaaccccggcggatggtgacaaccccgtgagcttggatttggagcaggcagaggccagggagcgaagggtggcgaggatggaggcgtcagggcagagctttgagcgaagtgactcggcgtaggacgcatccgtggaggcccgcggcttcttaaaggcggagcatgacgtggtcgcgcctgccccaccacaacgcttcttctccgacatgtcgagagatttggggtcgtagttgcaggggtgtggggatagaagtcgaaggacgatgacgacgacgactgagacccaagtgggcagagccgctctgctccacccatcgccgctccgcccgctccgtgccactgcctcgctccgcccctgtgctctgtcccgtcaccacctgtcgccccactcctcccctctgccccgccccgttgacatcccgctccgctttgccagcctactccgcccactgctgctctagccactgcccgtcctgcccgtcgcctgctccagccactacccaccctattccactgatcggggagagaaagagagagcggatagagagaaagggcggagagaggatagaaagacaagggtagtgaggatgacatgtgggcccactggttttattattttttgggattcaattgccacgtaagcgtcacgtcaatgccacgtgaaacgaagacctaatcaaaggagtcacgtaggtgccacatcagccaaaaccggagataatgttgccgatggacctcgttagcattggttttgtaagttgggggatgcattatatccagttttgtggtctaggcatgaattttgaactcggtgacaaatttgagggacccaaagtgaactttttccttttcttggttccattttttttaggtgcagaaaaggaataagtccatttttccttcctcaactcatgcccctgattgaatcacacccctcaaccgcaaaaccaggtataagacatcccctaactctcgaaaccgtttgcaaatcaactccccggacggttttggaggcggttttgtcctatgtgccgcttatatggcgggttgacttgtcttcatccaatgtggcatcaacgtggtgcttgtgtggcataaaaataaaacaaacataaataggacccacatgtcagtgagcaaaacaataaaaatacatattggcccagagaggtcctaccctgcgcgcagcgcggccagccggcgaggtcctcccccgcgcacggcgctctggccggcgagcgagcgcctcccccgcgcacggcgctccggccggcgagcacctccccccgcccgcagcacagttggcaaggtcctccccccgcacagccgttgttgccgccctgcctctgtgcttatggaagacgagagaagaggaagagatgagagagagagagagagagagatgaggtggaggctgccgacaaatgcgtcccacctatgactcagcgaatcaactatcacatctgatgaaaccgcctacgaaaccgctcagggagtgattcaactaggggcatgagtagagggaggcaaaacagacttattcctacatgaaaaggggcctttgaggctcgggccttgggcctggtatgtcacctacatgtcatctttttaggttaagttcacttttaggtccctccatttgtcgctgagtttaaatgtcgtctccgaaccgcaaaatcgaatacaactgttaacaccaaatttagtaatattctttagcggatttggatatgtaaagaatacaatcagccaatgaaaactttatctaaaagagatcaagttcaagaattaatcgtgaagacacacggcagcttgatttatctattaattaggcagggcttactaattttccttttaatatttaagaaagtgtgtttagtgtcgaatcaggactctaaacagcctatgggcataaatatgtacactggggttattgtaaactatctctcgatcaatacaacttttggcacatcaccaccctctgttccgaggtttttatcaccggctgcatcgtttcgatctccggcgaagggataagtcctaagttccactggctctgttatcggttatattggtgttgttcaagactgcatcgcttcaatatcttggattgctatagttcaattggtatatttgcttacccgatatttcaattctatctttagttgcatcgtgtcagggttatgggtaaggtataccctctacccttcgatatatgtcacatatcgatatggtatacttgcgcgtatacggacgttttcggcatacgttaaggaaattcatcacggagttcacagatggaaggagtcctactcgtacggaactgggtcgtcattgtatcgtgtcgggtccgatgtctccgagtcctacttgaagaccagttgacctgcgatataaaaggaacccccgggaggacctaaggcatcgaatctcatagccaacacatccaccacagcctacggagttgaagcctacaggagccaagtcgccgggagatctaatcgaacatgttcgattatgatctcgtcggtatcatcgagttccgctattccctttgtaatatgtggtttccatcatataatcccatatcaactgaattagggctattacctatcaaggggcctgaaccagtataatttttgttttctgtttgcctgatgtcgtattacgtagatcctcgtaccagcgtaccccagtaccctttatatccggtctacgggtatcccccgtcgacacatcgtgtttagttgggattatctcggttaggtctaatcttctgtcttagccgacatatctctatacaatatctatcactttatacatgatttattgactttattcgatttatttgttgctgtaaacttaatgctgtatcagtttgtggtccgagttcgacctatgactacacgcacctcggccgcccaccggcatactactgcacgcactgtgtgtgtcatgagcctagctagctacggactgggagaaacgtactaccatctcccaggcgcttgctcatcgcactagtcgattgcttacatgctgtgttgaaagatcggttggtgtggtacgcgtatgtgtcgcaggggaaaacattggatcaacgctcgctcgctcgcacgtttctcgtaagaaaaaggtgaggtgtggcactggcaggaaagcggcgtatatatatatgttaggtggagctagctataaggaaagaacagctccatcttttcgtttatacctatacttatcagctaaaatttaaatttttaatcttaaatttaaagttgattttgagatttttttcatcggagtttatttttcagtctttgtttttatatcgctaagaacacatatataaaagttttattcacaaattatgtttcgtttgtaaatatgtcgtttgacttaataagccaaacgatgagaaccaaaattgtcgggaattatttaggttattattttttcgtggccgttttctagttccactgtgtgtttggtgtgggtaccgcgtgcagtgcgtgatgagacactacttcgcaagagttccatctttctgcccttttattttacacgcatatattttctgaaatgctgttatacagtactgttttttaaaagaaatacataaataatcactttaaaaaatcatattaaaacatttaaaaaattttaaactgatatttaattaattatgtgcaaatgagttagttagttttccatcctctgaggaacatcgttccatggactgggcccgatggcgagattaatttttttttctaggctgggatcgagacaagcaggaaaggttatcagcgtgtactcactaaacgcgaggttgattgcgtgatccatctttgcttagggcacccgtaatagttatctataagctctttataaaagatccatgtcaacatatttttctatttggaagagattaaataaagaaagagagtaaagctatttactaacctgaagatagtatatagagaaaaacgagataatggattagagaattgtagaaacccatgtagacatactattgagatgttttactattaatctagtctattgctaagatcatgttttataaagagcaccttactttaacactgcgggtgctcttagggcacccgcaatggttatctatagactctttacaagagatccatgttagcatatcttcctacttggaagagattaaatgaagagagagagagcgcaaaactatctactaatctggagatagtctatagagaaaaacgaggcaatgcattagagagctatagatacccatgtagacatactattgaggtggtttactattaatctagtctattgctgagatatacatgttttatagagagcaccttactttatcattgtgggtgctcttagcagctggagtattcactatccgcagtttgccaattcatatcttccatatagcgtggctgtgttcggattccgtggatgggaaataatctctcccgcacggaaaacggagcgatccattagtgcgtaattaattaagtattagataaatttcttttcaaaaaggattaatttgatttttaagcaacttttgtatagaaacttaaaaaaaatacaccatttagcaatttgaaaaacgtgcgcgcgaaaaaagatggagagtggttgggaaacttgggtgccgaacacacccataacgctgatcaccctctctctctctctcgtctcatctcaaacgcgtatgcgccgtggaccacatttccccttcctcaacagtcaccacacagatacacaatgcctccccccaggttctcctcctccagcaagtacgggcttcaattcgccagttatttccaaccatccatgaaattctcatcaaacaaacagagagaaaaaaaaacagaggagtaaaatggatgaatctaccgaagccattatgtgaaaatgatgctactctattccactttgcttctttttttcccgtaacagttccatcttcatcttcttataatgcctcctcttaaaatagccatcacggctccgctcggctagcacgattaaccgtccagacttaccgtcaaatgtttcattaaaattttaacagttaaaaggattaacaatataatttctataagaaatggttgatatagttaagttatgttcagatttaaaaatctttatgtcttcgcaactatctacaactaaccacactactagaaaacacatttttcccaacgtaagggtctttttttcgcaggcggacatgattcttataaccaaataaccgcctacaaaaatataaatcggggtgaagttcgctgtccacttaaacggcacctacgaaaatcattttcgctggcggactacttaagcggcacatgcgaaaatagattttcgcaggcgaaccttatgtgctccgactgcaaaaatcgtacatacccaaaaaaaaaaaccacccttatcttctcctcccacccctcccaccactcaactctctctctctctccctctccctccactgactcagtctcctctcctctcctctcctctccctcactggctctcctctcctctcatctccggcggcggcggcggcaacaatgcgcgcggggcggcgcggggcgcgcggccggcggcgtctcccctcgccccctccctcccagatctggccggaggagggaggggggaggccggcggg

SEQ ID NO: 59561 - DNA, 8172 bp, Oryza sativa
ccggcgaactttgcgggactaaatccggacgaatccgagggagagagagaggggaaagtggggggaaagagggagggaatcacggggagtgatttccccctctttatggcgcgcggggacggcgggatgcggcggattcggcggcggcggcggcgctagggcacgggcgggcggcgggcgcggcgcgaggtatgcgatgacaggtgggccccacccgtcagcgagggtggcgggcgggcccgcctgtcagcggcgcgcgcgcggggaggaggccgatgggccgcggggagaggagagagagggagggaattgggccgagccggcccaagagggaaaaggggggggggaaagaagacttttagggactttctttttataaaacctttttaactttgtttatttcttctcaattattatttgtgctctgaaaattccactaaaatttatttacgcattttaggcttttaggaaatatacaaaaatcctccaagccttatttgacttttaaatttgcacattttaattgttggaggctttcacatgaattttaattattctcggcacaatttcgaggatgtattttagagtcgatttgggacgcgacaaacctacccccccttaaacggaatctcgaccccgagattcggaagaactggcgaggagatcgggatgggctgccttcagctcgtcttcacgctcccaggtagcttcttcttcggcatggttgctccactggagcttgcaaaaacggattacccggttcctggtcctgcgctccatggtgtccaggattttcactggcctctccacgtaggtcaaatcttcgcgaacttcaatctgctctgagtcggcctgctcggatggcactcgaaggcatttattgagttgcgacacatggaacacatcatgcacgttgcccaaggaggcgggcagctccaactggtaagcgacttctccgcgtcgagcaacgatacggaaaggacccacataccgaggtgcgagcttcccttttgtctgaaacctgtgtacacctcgcaatggcgtgacccgaaggtacacaaaatcacccactgcgaattccaggtcacggcgacgattatctgcataacttttctgccgggactgtgccacctttagattatcccgaatgattctgactttagcttcagcttctctcaggatatcagtcccgaacacttggctttctccaacttggtcccacaatagcggtgtccggcatttgcgcccgtacaacgcttcataaggtgccaattgtatgctggcttgatagctgttattgtaggagaactcggcataggggagactcttatcccaggtcttcccgaaatctagtacacatgcgcggagcatatcttctaggatctgatttagacgctcggtctgtccatctttctgcgggtgataggcggtgctgaaattcaatcgagtacccagctcttcttggagcttcttccaaaagtgagaggtgaattggcttcccctatcagatacgattttcttgggaacgccatggagactcacgatcctagcgaagtagagctcggctagtttgttccctccataggtggtctttacgggaatgaaccgtgctaccttggttaatcgatccacaactacccatatagaatcatatccaccttgggtttttggaagtccggtgatgaaatccatcccaatttcatcccatttccattctggtacttggagaggttggagaagtccggccggtcgttggtgctctgccttgacacgctggcacacatcacatagggccacaaactctgcaatttcccgcttcatgctaacccaccagtatttctccttcaagtctaggtacatctttgtactgcccgggtgaatggaataagggctctcgtgagcttcctgaagtatcagctgtttaagttctctgttatctggaacgcatacccgctttccgttccatagggttctgtgttcatcctctgtaaaaccagcggctttaccctgtttcatattcttgaggagtccatgcatgtccggatcattcttctgagcctcgcggatttgatcgagcaaggtaggcttggcttctaacgcagccaagaatccgcgactaactatgcttaggttcagggcttccatctgttgactaagttcgggtggaatgccacggacgttaagagtgttgcaatggctctttcgacttagagcgtcggcaaccacgttggccttaccaggatgatagtgaattcccacatcatagtctttgatgagttctaaccatctcctttgccgaagattcagatccgactgggtgaagatgtatttcaaactcctatggtcggtatatatttcacagcgattcccaatgagatagtgccgccagatttttagagcatgaaccaccgcggctaactccaagtcatgtgtagggtagttgccttcatgaggtcgtagctgacgtgaggcataggctactacatgaccgtcctgcatgagcacgcaccccaatccttggcgcgaagcgtcacaatacaccatgaagtccttgcgagtatccggcaagattaacaccggcgaggaaaccagcttttccttgagagtttgaaacgccttctcgcattgcgggctccacacaaatttctcttctttcttcaacaactgtgtcatgggtcgagcgattttggagaagttctcgatgaaccttcggtagtatcctgccaaacctaagaaactgcggacttgagtgactgtcttgggttgcttccaatcagtgacggcggtcactgtttcggggtccacagcaatttgacttcggacaaccagaactcacacttgctaagcttggcatacaattgatgttcccgcaactttcccaacaccagacggagatggtgctgatggtcttcctcggattgtgagtatatcagaatgtcatcaatgaacaccacaacaaacttatccaagtattccatgaacactttgttcattaagttcatgaagaatgcaagagcattggttaaaccgaatgacatcaccgtgaattcatacagtccgtatcgcgtggtgaatgcggtcttcggaatatcttcttcacgaatacgtaattggtgatatccggaacgaagatcaatcttggagaatacagtggcacctttaagctgatcgaatagatcatcgatccggggaagagggtacttgtttttgatggtgacttcattgagagctctgtaatcgacgcacatcctcttcgtcttgtctttcttctctacaaaaatcacaggagcaccccatggggaagtactcggacgtatgtaccccttttctttcaactcttccaactgtttctttacttcggccagttcatttgctgccatacggtagggtcgcttgtgcagaggagtggttcctggagcaagatctatccggaactcaatctctcgcttgggcggcataccgggtagttcttccggaaacacatctccgaactccctgacgatggggatttctgacagtcctatctgatgcaattctgaactcttgatagaggttgggggtgcaaagaaaacaaccggttgttccggccctcggtacagagtaacagtgcgtctcgcgcaatccactactccttggaattgagccaaccaattcatcccaaggatcacatccaagttcttggtgtctagcagaatcagatccgagggaaaaggaatcccctgaatttctatagggacggcagggctataatactttgctgtcataacccctccaggggtggtgatgagcagagggttcctaagcctttctacccccaactgatttctccccacgaatggcacagatataaacgagtgggaagctccagagtcgaacaaaatggtagcagggatggaatgaacgaggaacgtaccaacgatgacgtctggagttgtcagcacgtcctcggccgtcacgtgattcacacgaccccgaatgacatccttcccgccgttgttggagcggggaggcgcttggccttgctgacgccttggctttgggcatttatccgcaaagtgcccgggctcgaagcagttgaagcacagacgctgctgaccttgagcgtccctgcggccttgaccaggctgcaccgttggcgtaggaggacggggcgcacgagtcccttgttgattctgctgttgctgcggctgtgggaagcgcaccacgaattgaggtcggggcgcggggcgaggttgctgctgctgttgttgctgctgcgaggaggatccccctggatagggattggtgtagcggcccctttgattagcaccctgttgattgcggaaattcgccaagcggcgcttgtgcgactccagctccttgtgcttggcttccaagcggatgctcttgtccaccaatcgttgaaaatccggatagtccccagagactagacggacggacagttcagggtccattcctgccaagaacttttcttgcttctcctcatcttcccgcacatcctccggggcgtaacgggctaggttgttgaactcatgcaaatactccatcacggagcggttgccttgcttcaactctcggaattcccttttcttaagggccacgactccggcgggcacatgggttctccggaaagcggcggtgaagcgggcccaagtaataggctgcccctctggctgcgtagcctggaaatggtcccaccatagagatgcgggcccctgcagttggtgggcggcgaagataactttctcctcatcgctgcactgcaccgtgtctagctttttccccacggcatgaaaccaatccaacgcatccacggggttgttggagctagagaaggtaggtgggcggatacggaggaactcggcgagtttagagtgttgtgggggtggtggtggagcattatgttgtggtggattttggaggtggtggaggaaagcagtcatcatgttggcttgctgggcgaggatttgggtgagaatggcgttggtgtctggtggtggtggtggaggcggaggaggaggtggaggtgggttgccctgatggttgtggttgctgccttcgggttggttgccatcaccggtggcagcatttctcctggtcgtcaccatctgaaaaccccacacagaaccagcaaacagagaaagagctaacaattaaaactaaccacccacgactaccataattcttgaatttattactgctattaaattggttcattaatgttcaagttgcttaggcaaataaaataagacaggctccgacacagttatgccacacaccggcataaccatgccccacacgactcaaaaagacaaacgagaaaaaaaaacacacgcgcaagcctactaactgctcgtctactgctgcgacgggccaggacggaaggtgagcaacagcgcaccctccgtgctaccaatgccggaggcttccccctcctggggaaccacgggcgcgggctcggcacgaggggtctcgacgaagcaagtccacgccagggactgacgaacaagctcgggcctggaggtgctcttgcgggcggtgatcttctggctgcggcagacgcggcgacgcttggggcggcagacctctccctgggcgatcttgagctgatgcagctgcgcctccaccgcgtctaggtccttcttgagctgcaggttctcctgacgcagctccaggatcttcagattgttctcgaccatcccgcgacgcaccatctgatggaagtcgatacgagccgcgtcgtacacctccaccatgcgcgccaggtgcacgatggtagcgtcatcctccgagctagcatcccggaaggtggcgtagtcgtgggctcctccgcgacgagggtggtagcggtagggcgagtgctgcaactcgtccgggtagcgctggtgaagagtgccgatggcgaggagagcggcgttctggcaagcggcggggaaggaatctccacccgcggtaactgccagcgaagtccgctcgggagagccagagaggatcactgcggtgacctcccaaccagcgtggggctccgcgtcgtcaccctcctgatccggaagcggcctggcctggtagtccactccatgtggataccccagggccacgcacatgccccgcagctccaagacgaagccagtcatgtccaaaccacgacgggtgacgctgccggccatctacaaacaaaaacaaaaagaaaacaacattttaaaggtcagattttggcgataaatgaagcagcaagacagagagagactagacagtttttacaaataacaaaggatttttatttttgaaaatattgctaaggcttgggatctacggctcgtcctagggtcaagggtagctctgatgccaacttgtcacgaccggaaataacccaacgggcgtccctgacgtgcgtgcattaatccttgtcccaggaggcaaggtacaccaaaacttgatacaattcagagtttaacaagcggaagcgtaaatagttaacttattacatgggcagcgaaggcccagcacacacaaagacaaacgggaaacagcggaagactagggcgacgaccacaggcgcttgacggcaggcacgagctagacaccaaagccttcatcttcaaggagctcctcttctgggcttgggaaaaaattgagcaagactgagtacaaccaccgtactcaacaagacacacccacaaatgcagaataaatgcaagggagtacaagggaattataatataaagggttagagttgcagtaaacagcatttaaagacatttagttgctcaaagctattttgtaaacacgatcctagaactatacaatgttattaatcaaggccgtgaacccacacgaacctgccttaacccaaggcctatgatgattcagaccgatctggcaacccgaccctgggtcccagctcgtcccaagccaacccaggccaaccattccacgttttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagtttccaacccatcctagccatagacaagagtaccgacccaatcccgcctacggccggaacctccgggacaggcaggcaggactgagccccaagcagcagggcaccaaccctctgccacgacatctcgactaccgggccgcagctcgtgtagccttcatttgccctggagaatgtccatcgacccccgacttcatccatccccaatccgtgtacttttgtttataaccagactgagccacaaactaagccttacccactagacatgtggaagtacggtagtgctttgcaacagagacccgaagaccggtccttatatggccgaggtgctactatcaaaaccatgcaccccgagcccagcctaaaaccattttggggattttgaatagaaggagcggtgtgaagccaattccacaagaaccaaaccattctaaagtatccaggtgatatgaatatttcccaaagtctatagttgaaaaaccacctaatgttacctaattaaattgcgaagcatctacctaaaattaaactagtggtaccatgagtagaatgtccactagttgaggttttgtttaatctagggtgaacaaggtaataataataacaataacaataataatatggtcataacaaaggtaaataggcatggctaaataaaacagtgataacgcgggaatttaaataaagcgataatgcaataatttaaatcaacataattttataaactgggattcaatatgctcaaagatgatgtgacttgctttgctcgctttcccaaacgtcggcttcaacttccacgaagagcggatcttccgaagctgcagcgtctacacgaccaacggaaaagaaaaggcttttactctaataaactccacataacagccgaaacaaagcacaaaaatgggttcttgacttcttaaggaaaaattaaagacttgaacggtccaattccgagttcaaatggccaagttatggccatttgaagtttatatgctctttaaatggagatttgcgaatttcttcatttaaattttaatta

SEQ ID NO: 59562 - DNA, 4766 bp, Oryza sativa
tataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaaatccaccccccttacaagaatctcgtccccgagattcgaggaggctagcaagaagataggttgggcggtcttctcttcttgtctgacttcttccgctccgtcttctataacaaacttgcctagcacaacttctccactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctattcgattcgagggtcgataactttgcctttgaattatgcttcccaagagaaccaacttatcccacttgatatactttgacgtcttcccaaatagttttactgttagacttcttattgtctgatcgttatccggccaaattttgaagcttcgtggttagatgtgattttactctgacgtctgtagactatctgcgaacatatcacttggttcataactgggaatagctcccacgaacaagcaactcagattcactttctttatgttcagtttactttccgctattctcttcatgttgttatcatttagcattcaacgtattcctgtgcaccttcagccttgatgtgttctttcccattggatcatctcccaagacttggcatcacctggcaaccggtgcttgcacttttcactccgtgtagcatctgataccgagttgaagatttcactcctcgtcttcatagaaacacttttacctaggtcatcttgcttacttaatgacaaggtgtctgttgtggggggggcaattactatcaggggtcttccttgagcgatgcagagcatgtttctgtttatcaatcacctttcggcctacttctttgatgctagagaacatctttgccaatctcttttatcaatcatctttcggcttatctctaacaggtggtattctttaatgtggattgcggacgcttctggggacgatgaggtcctttggcttgctgcctttcagtgaaaccttggtggggttcgtcaaaaactatactgactgtctttgcctttgatccgaaaaagacacatctgaaactcttagtccaaacaaatgtctctttggttgatcacttgattttcttttccatcatcaggttgggtattaactcgaggttagaacatagttcctctgaaatgagaccctaggtctcctttgacagtaaccaattatacacataatcccatatcagcatcttccaaaagaacccccatagaacttgtctgtattacacatttctctccttattacatgaatacaaggcactgctttaaacaaaaagggaaggtgcttaacatcggtacattgtttctgctatggattctgattaacacaaggcctcacgggtacggcgtttgctccagtgaccacaaggcgagtgacctgtcttcttcttgcataatggccggagtgatggcgcaggttacgcttcggctgtggacaatctctagagaaatgacctggttctttgcagttgtaacaaatcaacgtcttctttgctgagctgtccatctggggatgatcattgtgacttggagttggaattggtggttggaaatccttgctaacattggcatcagtggtaccatagttgctatcaccattggagtctttctcagcgtcaaaattgctaaggttgtcattctgggttccaacattgatactatcgttgacatcttggtgaatgctactgacattgcacgctttgttcgagtggtcactaatggggcaagaaccatggttgttggtggtatcatcatcattagtattgctagtgttgttgtctgcattgcgttcatcttcttggggcaggaactcttgatgcacaacagaagatccggtgatctgaagtggctcagtgcgctgtctttggttaccacctggaattactgggatgttgacaatccttctcttgcagttcgtcatccgattatgctcactttcaagttgcatggctttgtccacaagtttctcaaaatcttcataatcctctaggagtagttgcactgcgagctcatcttttaacccctggagaaacttctcttgttggtcttcatcattttccacatcttctggtgcatagtgagccaaacgatagaactcatgcaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataacttgcactgttgctggactgtaggcacttgaacgttggttgcccctgctgggttgttccaattctgtaatagttgaaaggctgttgccaacatgttggtttggttaaccacaacttggattagctctggtgaggtttcgttgatgcttctctcattcccattggcttgggttcttgagtcatcggatccatcattcccatagcctttgttaccagtattatccatctgtcacaaggtagaggttgagaggggaagcatacaaggaaagaatagaccagaactagggacaagaccttaaaggaactaactcttcttattgatgtgttgtttgtttcacttattctgcaagttgattaagcaaacaacctagcatggttacatcacaacccactgatgcaaaccacgcgctacacacacaagcaaggaaacacacgacgaacgaaacactagagggtggcttaggttctgcgacgggttctccaagatcttcactcttgcttcacatctggcttcactgcttcctttgcttcgctagcggatcctgcagtcttccggggcttcggcaaacaactgacgatgtcttcttcttcactgacctgaccatctagtactagttgaaatccgaagaaggaagaaggcagtaaaccttttgcaaatagcattaggggaaggagaaaaaggaactttcgcaaatagttttatttataaaatatgtccttaggttttatccatttggcttatcctacagtcgagatggctctgataccatcttgtcgcgaccgggaaaattgccttttcccgaacgctagtgtattaatccccgtcccaggaaaagccggggtacaccacacaaacatgatataaaagacacatctttattataccgataatatttacattattacaaaggcgcttcaggcctgacaatcaaaaataaacagcagcggactagcgggcctacggctccatcttcacaggcgctcaactggggtataagccaagactccacctaagacttcttctccaaagcttctcttactgaagggggaaaagattgagcaagaatgagtacaaccacagtactcagcaagccacaccggagatgcataattaatgcaagggagtacaaggggataataatataggggttaagttttgcagtaacagcctttaaaagtcacttagttgcccaaagccattttataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattgcacattttagttgtggagcaaattttaagaattagaacactgacttgggtacattgctcggcttgcccataaccgagggcgcggctattcgaatagattatactctgatcagaggtgtacatctttacccacaagacacatcttcctcgcgtgcaaccacgtgccacataccaccacggtatacggacggaagacgtgacatagttcccaacccatcctagccataaacaagagtaccgacccaatcctcctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaagcccgagcttaattcttatagtggacgggg

SEQ ID NO: 59563 - DNA, 20568 bp, Oryza sativa
tgacttatgctttttatttttttaaaaaaaataaataagacgaacgattaaagttatatgtggaaactaatggttacgtttattttggtacagagggagtacttatattcagccaaacattcgggctcacggtaattacttttcagtatactcgtcatcatctaaagctttttggatgtacttggtgaatctttgaatgaaagatgtactgttcaagcgacatgatagtatatatgcatactagatgaaatcccttacgctgttgcgaaatttactatgataaaaatgagtaaaaaaaaaagtgtgagatagtttaaacaacataatcttaaataaacataagtttacgtaagttaatgtgaattaaatttaaatagtatatagaatgatgatccaaatataaaagtaagatgatgttactttatgaggaaacaaaagaagataatttagaccatacatctaagtgctaaaaaaattgagataatataactcaatgagagaagaaaagaaaagagataatttgaaccataaattaatcatctaaggactaaaaataattgatgtgctatgacttaatgagaaaagaaaaatatcataaactaaataaggatgaactatataggtatataggatattatagaaaaataatggagagaaatactgaaacattatgcgaattatgtaagatgatttgacaagtttacattttaaatctctaaaactattagattaataaattataataatatagcatgcatgttgcatgatgtttaaatgttgttatccttagtatgtagtaataatatcttgggggtttgcaatgaaaactcggtatatcgactataattattataattattagttgatgatgatatgatatgtttgcatgttaaattttaggaattagtgatctataaaataattttatagtaagagatgatttatttatacccaatctacaactggagtaactgggacgatagaccaattccctgcttcctctttctcaagccgacgaaggatatcccctgtggttggcctcttatctggtttacccgctatgcatgtctctgatatctcaatgcacgcttctattatttgccggtaacgcatttcgattggcgtctgcctcatctttgatgaatcctgttccaacctatgcctccagatttctagtacctgacaagcaattcaatttcattagcaaaaagttacacacgtagtagtattaactcaaacaatctaaaatgtagtactgattattaattatttcttcttgaatatacattttctgtcgttgttccttcattattaggacccatcaccatctctctgattatcaaacccaagctgtatatatctgacttgactgtgatatctccattaactaagtattcgggtgccatgtatctcctgcatcaatggacacctgtaatctcaggtccaaggaaagcggatccacgggaaaactcatttgcaaagatatatgaaactctctctctctctctctctctctctctctctctctatatatatatatatatatatatatatatatatatatatatatatgggactacatagtgcccggactccaaggtatatgaaacacacaaattctcttaaattttttaaaattttcaaattgtgagtatatacctagatataagaatttgattcatacctatacctatcaacgaaaacaactcaaactcaactttatattcacaattcattattacatacctaactaataatatgtttggatgttatatacctagaactaaaatctaacaaaaattgttcaaactcagttcaaacttgtttgaacttgttagtaaggaagttaatattcatacctaaacatataaaaaaaattcaaactcatttaaattaggtatatattcaatttgaattttagagcccgtgcaccgtgcaccatggagcctgagttaattttactctctctatatatatatgtgtatatatatacatatgtatacatgtatacgtatatacgtatgtatatatatacgtgtatacatatacatgtatacatatgtatataaacacacatatatatatatacacacacacatacttgactaaccttgttccaaaaattctctcagtgaccatgcggcttttttcttcactcaagagccttgacaaaccaaaatccgcaattttaggcaccatactgtcatcgagcagtacgttatctggtttgagatctagatgaattatcttcctctcatgcagatagtgcaaacccaggcaaatacctttgattatttggtaacaaatctgccattgaagcacacaagatccggctgtacgacaaataaatagtacatcatagccttgtagtataaattgcaaaattattcataatgccttttattttggcacaccattgccatgcacttcgaatatatgaccattacaatatatagtggtggctggccatgtagataccataattttgcccgcaactcaaatttggagttaattatatttgcacaattttaggtcaacaaacctcttattactatgttgtatttaccgatacactagtggttttctattactttttccacaatgtaaatatttttactcagaatgaacatcataaatggagcaaatggatcacatatagttataccagtatcaagatgactgcgaaggcttccattacgtagatactcgaagcaaagcaacttttctttcgaatccacaaacatattttcccttccttttcgtaccacatttgtagatgtttcagcacagtacccaacaaaccatactatattgcagtgcctaatcctcatgagacaatcaacctcgcgttgaaatggttcgtctttaattgcatgaaatgagtaaagcttcttcaccgcaacaagctcatctccaagcactccctgtgaattttcaactctatatgttaattgctacaccataccaggtcaaacatgacggtctcatcaactcgtcatctctaacgggttcggtgttcgtcagagttaaagtgaccagtgatgacaaaataccatctttgatgggtgaacacccatcacaggtgagtcatctctgacgagtagtaactttcaacccatcagtgttgagtcatctctgacgtgtcacaacttctcacccgtcactgatgactcatctctgatgggtagtaacttacgaaccatcattgatgttaaatcacgagtcatgattttgaactttaaatgcgcattcaaaaaaaattaaaaaaatttgaatttcactagctatccattctatacatgatgacatgtcactacccacaattccacatttttttagaaacgtagatatgcttgcatttgttgtgtttagtactcaagacctccctctctaaaaagagcacccttacaaactcatcaactatagagcacatgttgatttgatttctctttcaatattattgttttagttattcctctccaaagcatgtaacatatatttaacactctaaatgatttcaaatgaaaacatcatcaactaaaatgttttagatctcatcgtgtttaatattatatatggaatatcttcgtctgagatcatttgaagaatttaaaattttgtttttcaaaatagatctcaccttagggcatgtaaactatcccaaataaaactattgtcaattataatgttgtagatctggttgagctctacgacgactttgatccataccatgttttcatccgaggtcatttgaaaaagtcaatttttcatttttaaaaatagatctcatcactttaatgcatatttggggatgtatacgatctctaatgaaaatattgtcagttataaagttatattgagatctacaacttttatatagggcatttctccaaccgaggttttttagaaaattcgaaatttggaacttttactcattagtgaattttttatccgtgaattttttaaaaaatgagtgatctcatctatgatggttcataacattatctatgatgtcatagatgacatagatcattttgtgacgggttacaattatggcccgtcacagatgacctgacatgtgtgacgggtcctccccggtagccatatcttaaacgagatactttttggcccaccaaagatgactcatctatgacgagccatgttaatccatcatagacaatcgtaataatttctaagtcaatttctgtttttcctgaaatttttcagcccgtgttctcatgaattatcatgtgactttggaggaccctccaatcagtataaaaatatggtatactggttcagttgtacggttccagttggacatttatatattcagttggtaaggtaacatggacttcctgttcgaaattagcaagatggtaggttttgaaatgctcctataactgataaaatcaagaattagtcagacataccttataaactattccgaagccaccacttccaataatctgctcttccgagaagtcatttgtgatgctttgcagtactgatagcttaataggcaatgggtctcctatgtcatcgaatagcaaatcttctagagtgttgcactgtttaccttgcgttgccatttattacctgcctctaccatttgagagcaaaatcaaaatgcttcttttataagactataaatataaaaaatgattataatttgtagtgacaaaattgtggcctaccaggaagatgtatcaaaatcaacccaatctctaaggtcacaaatgacaaaaagatcactgccttgagcacttatttccgaacagctctgttaacaatttttaaatttatgatgttacataagtattactgatgcaacaaaaatatttgaacaacctggaaatatttgtcattgcatcatttagaaatagtaaaatactactcccttcctgtccaattctgtatggagataattatactattcatggagcataatgcagaaatcagtgcaagaatgaattcgccatggttatccatggtgggacattcatcttggattatagaacagctagaatccttgtagcatcaatttttgttttttttttcttttctgcttttcagttccttgactcctccgaactctgtttttatttcaacttattaataatataaaactagtaggatttcactgaactctgttcttatttgtttaaacgtattaatatatactcagtaggaattgatctattgtttcataaagagtaaaatacatagccgatacttaaagttgagcgcgggtgtcacttaggtttataatattgtaaattgcacatatatgtccaccatcttgtttaagtgacttattgaggtccaaaccccactttaccggctctgactgccgacgtggcacgccacacaagcaccaattttacaaacaagcccctccgcaacagtagtgccatggacagcacaaaaatccccaaatccttcgttgtagtcatgccgcgccaccgccgctaccgacggtgccgcgagcgccagtagcaagcaacacactagcacgacacacacgcgcgagtggctgcggctggtagagcagcggtgggcgagagcacgggggcaggcatcacggcaacgccgggatccataacatcgcggcagcgtcgggatcctgctgccacgccgcccctcactagctcaccagcacgacggcattgagaatggcgacggaggagtggaggacgacgacgaggacgacgctcgggcgctagtagcggcagcggaggcggaggttgctcgggcggccgtcggcggagcagagaaggaggtagcgcgagcggccagtgggagaggcggggctcgctcgggcgccggtggcgcgcttgtgtagtcggcagcggaggcggaggcaaaggcatgtagccgcgcgcgggggcgggccagcagtcggcccacacggtgcggcaatggcggagaagcggaagcatcggcgaggcgggcgtggcggagaggcgcagcacccagcgcacgtcactggggccgacgtcggccaccggatctccctgccaccgacgcctcctctctcactgctcaccaccgacgcctcctctcccgcccccaccgacgcctcctctctcgccgctcgccaccgacgcctcctctcccacccgacaccgacgcctcctctcttgccgcccgccatcaacgccatcctccgcacccccaggttgaagacgacagcgacgagctaggcgcggtggcagcgatggagtctcgtagcctcggagcggaagggcagagtcagcgacgccacgtgggagggcagcggggccgtccccgtgcgccgccgtccgatgcccgcccctccacgtcgccgttcgccgctcgccaccgacgcgtgagagagagatttaggaagaggggaagcaaaatggggggcaaaatgcaaatatgttgtcacgctggatcgccacgtaagccagtcaacccggtcaaaggtcctttggacttcaatgagtcacttaaacaagatggttgatctagatgtgcaatttacaagattgtggacctaagtgacacccgcgctcaactttaaggaccggccgtgtattttactctttcataaaaataaagaatccaattctgccatctttaagtatatcgcgaaacccactgcatattcatcttatggaaatatggaagttctctaatatgattcaaaaggatggtacatgtaatactgcataacacacacatcttagcagtaaagctatgagctgattcaataacttcatcagattagacaaccacactttcctgatacctaacccaactactttgactgagaaacatgtgaatatataagttccccttcttggatcacgtacaataacaaatcaggaacacttctatggctgtgtttatggctgtgtttagattcaaaattttttctttaaactttcaacatttccgtcatatcaaatgtttggacatatatatggagcactaaatgtggacgaaaaaaaccaattgcacagtttgcatgtaaatcgcgagatgaatcttttgagcctaattacgccatgatttgacaatatgatgcaacagtaaacatttgctaataacggattaattaggcttaaaaaatttatctcgcagtttatgggcggaatctgtaatttattttgttattaatgtacgtttaatacttcaaatatgtgtccgtatacttaaaaaaaatttggcacacgaattaaacacagcctatgttcattacaaaaggaacaagcctggaggctagagggttgctcgatcattaactgaacgacatgcaagaacacacgaacaaacgcagaaaaactcaaattaatgatagacgacatgggagccaaattatcacatggtataacagccgagatgaatacaaaacaaaaataggtggcattcacaaagtgaagaaaattaaagaaaatattaaatattgcttggcattttctaatttgcagaagagaagttgtgtgtcgtataaaatctgagaaaagctttctcagatgtagggaatgtttgccgcataaaattagtaagcgtcactagcgagagagagagagagagagagaaaaggtaagcaggagctgaactaggatcaactaaccttctatggtgaagcaagtgtagaaaggaagtggcgatcttggatttttgggcgcaatttatgctgggatcaagcatgggagagccatataaattaatatcacttggggagtactaccgagtctacgaccgggtcatgtccagctataccatgaacaattataaggcgcgaaatcagtcgtcttttcaattgattcttttttttctaattgattcatatgactaaaatgacatgactttagatttgcgtgtccattgtaccaatgcacacccatcacccatgtggtatcagacaaacattgtcagatatacggagtcaaacttggcgacataggtcgcctcttggcctaccacacatgcatgcatgagaccaaaagttaagctcgtggattgcagcgatttgtagttatgaaaatgacaactaggaaactaaagaatcatccatccccacccggaaagggagaggagtgaggttgtgtactattgaaaatttaatcttgcgtgtgtggactgacttgctgaagattaaacaaaatactcctttcgtcaaataaaaaaactcaacttagacgaggatgtgatccctcctaacataacaaatctagataaccatttatctaaattcgttgtattaagagagggttaacccttgtagattaagttttttagatggagaaagtatatttgaaagggatgtcttttgaggttgttaagagtcacaatatcgattcctgctagcggcttcgttcgtgaactgagattttaattggcacagaaaccagagcaagcaattaacacatgattaattaataattaattattataaatttgaaaaataggttcatttgatttttaaagaaacttttatatattctttttatcaaaaatacaatatctagaagtttggaaagtgtgctaatggaaaaagagaaagttgaagtttaaagttggagtttaaaacaaacggaaagaaataactactagtagaactttagcaaatctgaaatgaccaaataaaattttgtggctctttcaccttacacaatcgacacatcacctcctgtagcactggcggacccagaaaaaaatcatagccatggcgaagacaaaaagagtcaactaacaacatctcaatccaacccaatgaaacaacaaagacagccaacatggcaattacaaaaataggtagatatatacttcaagtactagttccacatatctgtattagtgaaaagtaaattccaagattggtatatatgtcctcttttatagcagagttagcacttgcgtctagtatcaactcctccttggcacccgccggtggcaccgtttccatgatctcggtcgcggtttgcaccgttgtagcctccattgttcccgtggtcatggttgccattgtgcctgctctgttagccgccacgtcctcgattggccatattgactgtcgcttcggtggtttgtcgacgggccaggcactgctcaaagccaagccactaggagtatgcctctcccagaaattaatcatcggttcggttttactgacaatggatgagatgaccggctcaaagttgtcgtcgagctagcaatgaaataggagatgagatcttcatcgtcgacaaccttcttgacagcggcggtcatctcatcactaagcaccctcatctttgcgatagtcagcgacggatagatctagatcgcccttcttggtgttgaagagagcgattctagtgttgatgaagcacgctattatcaccgaggagtacatctcctcaagcatcctgcacgcctctgcagcagggttggaaatttcggaccaaaatttccgaaatttcgatcatttcagtccactccaatacgatattagttcgtccgaaatttttcaatttttcaattttttcatgaatttggataatatttgttcaaattcaactaaattttgctcaaaatttgggaccaaaatttccgaaatttcgggatttcggtgaccccctatcaaaagtcccaaaccgagaaagtgaaccttgctctgcagaggtgctgcatgtggctacctgtgccaggatttgcttaccagttgccacccattcttcatagactggatttgggtccccggacctctgtccttaattagctcgttgtcaccttgcttcgtgattatagcagtcggagctgccgtcgtgccggtgaggtgcccttcaagatgggctcctcgcaccaatcccagaatctacgctttccttaccgcgtgattggtcttggagagtttctccaagatcgtgcttccaccgagcggattgctggccgtcgccttggatgaactccccatgagttcgagcagatgcgattttagtggggctctgataccatatgaagcaccagaggtgcagaagtgttgaaccctcttgggccgcacctttgttcatatattggtgataataaccatcactgtggtttacaagatagtgcaggttgttggatagataatatctattctgttacaacagattatatctgaacctatctatccattcaacgatgcaccgcatacatcatatatcatctatctatctatcttctatctatctattatattatattatattatattatattatatactaaaagtccattaaacttcctagaaacgctctcaaaccgccacgtgacgttcctataaatactcctagaccgccacatggcactgttaaatctcaccgtcgattttcatttaaattggtggacccaatactttagactattagattagatgtgttatttttttttaaaaaaaaagaatactttcgcatctatactgtgggccggacaaagaaacaaaacgtaagttatctttgtacgtacgtacgtacatacggagaagaaacaatgaatcttatctcctcttcaatggaagaaaagaaaacatgtaccgacttacgataaaagcgattaataagtaaaaaaaacatacgtaaagcaggtacgtagtgccactgaaaaactcgatgctccataaaatatgatattacactattttaaaataaaatatattactctataaagttatgcaaatatacatagctaaactagatcgtttacaatataaaaataaaatatcctatgaatactctttaaacatcctatctataaattattttaaaatcatatatctaatttgtgatccagtcggatcctctaattaaataaaatattgatgtctatgttcataaatacatcattatatatgaggtcaacatataataaataatgttataataataatcagaaaaataatgaattacctcttaaactattacggtcgaccgaattacccctataaacccgaaaaccggacatctttcaccctcaactattaataccggatgaattacgtccccccccaatgcggagtggtttttcgtcctacgtgtcaatttagttagcattttcttaaaaaatggtaggacccatatatcatatctcttcctaaccccttcatcatctctctctttcttctccctccacatatcaatcggcaaggctaggggcggcaagcggcggaggccgctcctcctcagctgactcggcagccacatgcgcattccaatcgaggccgtcgtctccatcatttccgttgcatatcgttgtcgcatgatgagagttgcaggtaccggaggcgagaacctgcgctggtcctcaatggccaggttctgctacacccctgccatctagaacttggccaacaaatatggccgcagctatgtctaccatagcatgtcgtcccaccacggtttttaatcgatccccatcaccaatgcctctctcccgatgagacaacgaggcggatcaatcaagcaagcaagcgtaggggaatagacgaaggaggaggagaagagcggcggggtgacagtgtgcctacccggccggtccagtagcaatgggagggagaagagagaggctggggaatgggattcaggaagagaagcagagagagagaggtgagagaggagaggggtagagagggtacagagtgtcacatatggccccacctattttattttttttaaatgcagactggactaccatgtaggactaaaactactccaggttgagtttttttttttggggggggtaattcatcttttattaataattgagggtgaaagatgtctggtttcgggtttatggggtaattcggtcgaccgtaatagttagggggtaacttgtacttttcctatttcaaataattttacatcatattctaggtgtcaaataacacttgatgactatataatgctaacttaaagctctatatgtaaaataattgaaaacaacacaatttagttgtgtatttttaagcagatatgatttagttttaatatgtctgagattaagattctcatcttttttttaatttttagaactatttcaatagtatatgataagtgggcaacataaatgttacataaatgtaaaaaataattatgaaaaatatttcaagccagtgatcttgctataatataaccatttagtccatcataggatttatggtcatatatgtatgtttttctctttgtcaaatagttttgataacaaatgaacaatcaattaacatgcgcaataaactactcatgatatttttttttatagttgaggaattccaacttatcagacataatttgatgaatgtatgtcatgcactctattgatgtgactatgaattatacttcaatcaattagttattataaataagtttgggaaaatagattcattctctaaattaattagtaaaggtatcttatgtgattatgaaaggcgttgaaaaataagatatgcaaaattatatatatttgtcaaaatataaccaacaatatggtcctttggagattttatcgtggtagtattttaaaaaacactttattcaggtaagaaaatcacatatagtacaaatagaaataaaaaaactccattattccattattgttttattatcgtgacacatgttgttctcataaagtcatgtcattgtcataaatttagggttgtatggtttcatgtaatatgtcataaccagatattaactaaaacatgtttaaaatagagtgaagatctattttgaaaatataatctaaatgtaaacatttataataaaaaaagttaagcaacattaaataagtgtctacgcatatgcgcgggctatttatatactaaaagtccattaaacttcctacaaacgctctcaagccgccacgtggcgctctaataaattaaagaaaatcctagaaattataagaaaaaaaagcaaaacatccaccccttgattttcacttaaattggtgggtccaatattatacaccattagatgaaattgatcataaaacaaaccaaatagtgtggggtcccacctctcctcctcctaccgcgcatgtgtgggtatacgtacgtaacatgtacgtacgcttccttcccttcctctttttttttcctttttttcttctttttcccatttatataatggatattttttaaatcaccataattttacaaacaaacaaatttaccatcatacaactcacatgtaactaaattagctctacaatttttgaaataaaatttacaccattatatgttaccattaaattaataatgtaatataatttccacttaaacatatgtactcattattttatactattattttcaaataatgcactattttaaaataaagtttacacatctatattgcgtacctatcaaataaacaatttaagatctatattaactgatttatacgtacacttaaactgatggacccactatataaatcattgaaactatttttattacattggactattattctcaaataatgcattctttcaaaataaagtctacaacattatatactatatactgtgtacccattaaattaacaatttaaaatctatactcactaatatgcacttacactagaaccactagacccattatttaaatcatttgatatattatttgctaataaataaagtatccgaaatcatctttttggcccgctgcacaatgcacgtctgcacctttgccttttgcacgtgtgtaaagcgtcgtgtctgaggcatctaaggtgatcacgactgccgcagcactaccgctatgccacatatcaaatcatatatggagatgattaattttgttaataacatggaaagaaaattaaaggtatgatgtagcgagagaagaattaaacactgtgggttgtgttttttctaacatttagctctgtttaagctgaaatcgagagttgattacagaataattataatgtatcgtgttatgtcgtatttggattttgtactatttattcatataggtgaaagaaatcattatattataaatctgagcactatattaacgaatatcaagagaactcttacaaaaacaagggtgttataagggagtttaagaccctctttttttctagattacatagttggatttttgtttgcacgctttccaagtttctaaatggtgccttttttaaaccacattttaactttttagaagtcaatttatttgtttataccctcaaatagctacaacataaatcagataattcatcaatttcagctgtcctaaaccttaaatagtacgtatttttttttcatgcgagtgatggtaatctgtaaattgggaatcaacggataatcaaagtcgtaagatgaatatgtaagagctactataaacaactgtaaataggtatcaaaattaattgctattaattagacatctaatggcttgctagccacacaattaatttctctctacatgcatataaacatgcaggaagctggaacaaatattaccatgtgccccatacatatatattaagctacatgcatataaacatgcaggaagctggaacaaatattaccatgtgccccatacatatatattaagcggttaatattttaattacatgtgttaagtcctttaaaatttattaaaatgctctcaagctgccacgtggtgctctaataaattagagcaaatattagaaattctaaaaaaaacagcaaagtatccactgcttaattttcacttaaatcgggacatccaatattataaactgttagattaaattgatcttagaacaaactaaatactacaagatcccacctctcgtcccatggcataggtatgcacctacgtacgtgggtacgtacgcttcctctcccttttttcatttttccctttcttctttttttccatgcatacccttctctctttttcttactatatcatgcgcctttatgagactatttaatcacaagaattttgagtatcttgctctcgcaatttttatttgtggctatactacgcggtatgcatatagatggactatatgataattaactagcaatagtttcttatttactcgagaaaaaaaatgattcaaaagtcgtaagtacttaatccttctcttactcaaaagtttatgaatggtttttaagataccttaagaaaaatagaacccttaaattattataaaataacattatccgaactttagtttgcacttaatctatgagacaaaatttttgaacaaacaataatcttatcttttaataatataagtgcccacgcatgcgcgtgggccaccttcctagttatatactaaaagttcattaaactttctacaaacgctcatatatcaccacatggcactctacaaacgcttctaagctgccatgtggtaaagaaacatctaactcttgattatcatttaaattagtgggcccatctttttttttaccattacaatagatgtagcaaaaaaaagtaatccacccatcctaatctaactctaaattggaccctcactctattcgtgcggatgcatatacatacgtactctgtacgctcctattcccaattctcttttcattctattatctatttatctctcctattttccttcttctaatagaaagcaaaatttacgtcaaaaacatttaggcaactatagcatttaaatcataaaagtattctaatatgcttatgttgttagattatttacatagtaactaaatcatacatatatgatttgatcacactataaaaagacacatagagatcggtgttgtaggtgctggaagtgataaaaccggcacctatatatcatttccgacctctgcgggatgaaaataaaaaaaagactatacctttaatagactgtaggtgtcggttttctataatataggtgtcttttttttaacaaaaactaacacctttaatttactatgagtgtcggttaattaaaaaccgacactcggtttttaaaaaaccgacactaaagagtcgagccgagctgaccggtggtctctatcgcgcggataagaccgagagtctctcgctctcccccctctctctctctctctctatctctcgctctctctgtcgcgcgcattcttctttctctctcacacacacgaacacagtctacgattcatgcccgcgcgaatgcgtgggctatcttccttgttttcttaatagcgggtacatatttacagtaagtatatgtatatatattttttctccaagtgtggactcttgttgtgagccagttctcttaagatctgcattcagccacccacccagctgccttcctcactatatatagcctatactgcttctcccgggaagaattgcacacaaatacacaatgcacacacacagacacactctcgttagcttaccattgatgaattaatacttctgtctcatactcagacagatgatacagagttatactgagtatggaaggcattgggagtatggaagtcgccaacacgtgaagtcagagtactatagatatctagaaacttatccctatatgatatgtaatctcaaaaggtaaggtaatgcgtacggagatgatacgaataagattagaggtgagagtcacctctacctcaacaatatttaccagccttgtgcctaggcttccatgtggttaggggtcgatagtagagcttctgctcaccatccatgcctgaagaagggaacagtggacctagtccaacaaccaatgtggttaatttcccccacaaaatctgtaaaaagtgaaactttgttgcaactttcatggaagataggctctctttggcttgtggtttgcttgatgatttgattgctactttcttgtgcatattaactcatacacctcaactctgctatgcaattgtttttgttatgttatctgtatatctctgtgttgcctcaaaaggacaaagggaattgttagcatttcaaatgttcaggcagaaaacaacatttttatctgcttgaacgtggggtgatggatgtttttgcaagacaccaaccggcaagaaaataagcttgaaatcttcagttaacaaaactcctattcctttacatttacaacacgtatgcacaacaacatttcccatagaaaggggtataccaatatacaatataacactacaacattgtcagctatgtgacttcaaggcatccctaaaaccgctaaaattatgaccgcctttcttcccgaaccctgttgttgttttctgcatcatcgcgacaaactcgttgtaatctatacgcccatcctgcaggaaaaagaatagcacaaaacacatcagatttactgatggaagataatctttcatggttagagttgccaaccctaatagcagcgcaaaattgtaggattggttcttggatgatcttacattgtcctgatctacttcgcctatcatgtcttcgagtcgaacatcctcgataccaaactcatcgcaggcttgctggagctcatcagatgtgatgtatccactgccatctttgtcgaagtattggaaggcggcatatagatgatcttccctttcaactttgttgaggtgtagagtggcagctatgaattctccataatctatggtgccactattgtcgatatcagcctacataaagaacatgataaacgttttgttatgcacttgccacaattagttgcacattgatgaattcagttcagtctttaccagttaacactttgtcaataagtaaacaggcaaagaagaacaaaagaacatgtgactaaactatttggttaaagaattcgatttcccttgttcttaatcgttgttatgccgagctacatggactgggacaatgttctatgcaactcctttgactatcaacagaaaacaatcaagtcagtgtgcttccttcatgtcacattatatctgaagatctgaaaaataataagaagatctgaagaactagagtctaaaatgtaacttctgtgccattccaatctagaagttaaatgtaactaattactactccctccgtttctaaatattttacaccgttgactttttagcacatgtttgaccgttcgtcttattcaaaaacttttgtgaaatatgtaaaactatatgtatacataaaaatatatttaacaatgaatcaaatgatagaaaaaaaattaataattacttaaagttttcaaataagacaaacgatcaaacatatttaaaaaagttaacaacgtcaaatatttaaaaacggagggagtaatttgcaaataatagttttagaaaacatctttaccaaccaagatctccaagtgaatatgattagcagaggggtttagagcacaaacttacagcctgcatgagctgataaatttcagactccttcatgttggcacccactctctccaacccggccttgagctcctcgtagttgatctgcccgctgttgtccgtgtccatcatcttgaacatctccttcaacccggcgatctcctcctccgacaagttctccgcgatcacctgcgcaatcgatcgcccaatcaatgtcacacaccatcaccatgaacaaatctcaatttccacaatgcaagacaggtgctcactctcaatgccatcttcttgagcttgttcatggccgagaactgcctcagccgcgacagcaccgccgagtccagcggcttgtccggcgccgacccgctcatctgcagccatggatggcctgcgagaaaagaacagcagtgtcagtgttgcaggaagcagccatggcggattgccaagagagtggtgagctcacataggacttcgtgcgcggtgagccgcttcttggggtcccggacgagcaccttgcggaggaggtccttggcgccatccgacacgttcggccatgggtccgactcgaagtccagcgtcccgtgcagcacctgctcgaatatcccctgctccgtctctgcgaagacgacgacggcgatgtcgccggcggcggcgagaaatttgttcagcattcgaggtcgaaatttgttcgtcaatggcggcgtcgcctacctacctgcccagaacggcggcacgccgcagaggaggatgtagatgatgacgccggcgctccacacgtcggcctcctgcccgtagctcttcttcagcacctccggcgccacgtagtacgggctccccaccacgtcggtgaacacctcgcctgcagtgcaaagccacgcagatcgatcgagctcctcacgacggcgacaatggcggcgacgaccatggtgcgtgaccggttgtttgtttacctgggcggaaaaacatggagaggccgaagtcgatggtcttgagcggcgcgtcctcctcgttgccgacgaacaggaagttctcgggcttgaggtcgcggtgcatgacgccgagcgagtggcacgactcgacgacggcgacgatgacgcgggcgagcccggccgcctgccgctccgtgtagtgccccttgcgcacgatccggtcgaacagctcgccgccggcgcagagctccatgacgacgtgcaccgccacggcgtcctcgtaggcgccgcggatggagatgatgttggggtggccggcgaggtggtgcatgatctggatctcgcggcggacgtcctccacgtcctcgtcggtgagtagcttccgcttggcgatcgacttgcacgcgtactcgccgccgttcgccttgtcgacgcacaggtacgtcgtcccgaactggccctgaccgagtttgcgccccaggctgtatttgtccttgagattctccgtctttcgccggagcaccgactccacctgcaggccggcgctggagatgcgcttgatgtgcgccggcttcttggcgcgcgactgctgccgctgctgcggcggcggaggctgctgggtggtgttcgacgacgcgggcggtggcggcgagggctgctcctgcggtggcggcggctgcgacggcgccgcgggctgcggttcgggctgcggctgcggtggcggcggctcggagatgacgacgggtacgggcggggcggtctgggtgggcggcggcggcttgaagaagggggccgaggggagcacgacggggatggagcgggaggtggtggtgggctgcgacggggaggacggcgcggcgtggcgcggccgcaggatgccgaggagcccgttcttggcgaagttgcggcgcgggccgatgcagacgttgcccatcaggggcggtgccgcggccccggcggcaatggcggcgtacggcggcggtcaggatcaccttctcttcacacaacaccgctcgtcgtcgtcgtagtcgtcttctcctgcggcgccggcggcggaacggggcgcgttccgccgggaagcgagcgatgatgtgcggtggtggcgaaggcgcggcgggggaggaaggatgggtggagacgagacgatcgggggaagctaaaaatggagaggaaatggaagagaaacggagagggagaggcaacagcggcggcgtgccaaatttggcgggaaacagcgggaggccctgggttgggtgtcggaactcggcgcgggcgctcaactgtgtgagcgtgacagcgcgcggaaaattggttgattggttgcgtgggacgtttttgtgccagtgtcctcaatttaaattttaaaaaa

SEQ ID NO: 59564 - DNA, 15871 bp, Oryza sativa
caatatacaatcaatcaatcgaatcgtttttcatattgcttttagttttctcttagtttgtccatctttgtcggtttgcgctgtaaaccgtctgccgccgttgcaagagtgcgacatctttttgtaggtttgtcctgaaaaccttccgttttgcccacgagacgggtagttatctagaaatcggctccgctagccggtttagttatcaaaaccatctaggtttagctctttgctagatcgaggtggttggcgactctaggatcaccgcaaggcttaaggtgctgtgatcgtgcttgtcaacttgtcaaaaaagttgccaacacgatttttggcgactccactagggacgagatccgttcatcgtcaactcaacttcgacttcgccatgacgaagccgccatccaagacggaggtggagccatccaatatgataccggtcacattggatgatttcgaaggagaagaccgcaaagctatggaggaatacatcaacgaactcacacgggaggcgttgatgagggcaagcactaggactcgttaaggggtgatcatcaaggcagggccacgtcctaagctcgcccccgatttggtaagtaatggtgagataacacaatctatccagcgacaagtagcatctacaatagattcatctataattgcttttaaagataagttagatgcaacttttgagggtaaatttgatgaatttttaagggttaaattcggccctcttatggccgattacatgtcaaaagataaagcctctaccactgctaaccaacctcctatagatcaaacgggtagtagaaccgatggagcggcgcacacggtcggtccgaccgggcctgacgaccggtcagaccgtgacctagccgtcggtccgaccgaccaaacggccggtcagaccgggtattatccccgcggtcagaccaggactcaggcaggtctgaccgcgcctttggatgccagtcagaccgggccctgggccggtcagactgacgcgattataccgatacaggggatagatctgatgactaatgctagttatttgtatcatcttagaacatttgatccctctgtatctactgctgcaaataatccccaagttcccccacatgttcctaatgcttataatgatgttgctagggggtatcctcccgatactagacaaggccaatataatcatattgcgccacaaacacaacctattaggccaccaaatccaccgccaaatcaacatggacctaataacatggaggatataattagtgagattattaggaatagattcgggattgaaactaggaatcgtgctagagtttacaaaaagccgtatcctgattattatgataatgtgtcgtttccccgtaattatagagttcccgaatttaccaagtttagtggtgaggacggtaagaccacataggagcatgtaggtcaatttttggcgcaatgtggtgaggctaatagtgatacttttaaattgcgcttgttttctttatctttgtccggtaatgattttacatggtttacttctttaccggcaaattctatcatacttgggctcaattagaagaaaaatttcatgattatttctatactggagaaactgagcttaggttatgtgatttaatatcggttaagcaaaagtataatgagcctgtcattgattatattaagagatttagggatgttagaaaccgatgttatagcttgaatataactgatagagatttggctggtcttgcttttaatggtttaattgctcctcttagagaaagactagatggccaacaatttcttgatgttagtcaacttatgcaaagggctctggctcaagaaagccgggttaaggataataaaaaacttcttagatcatatgacaaaaagcctaatgttatgattgattaccctgaggctagtgatagtgaagaggagggtgatcatgatatatatgttgctgaatggtcatggactaacaaaaacaagccttttgtttgctctaacctaatgctgactcctcgcaaagatcggcaaagtgaggttaaatatagttttgatgtggctaagtgtgataagatttttgattatcttttacaagagaaacaaattagattacctaaaggccatgtcataccatctcaagaagagttgaaacgtcgagcatattgtaaatggcatgattctcattctcattctactaatgattgcaatgtgtttcgacgacaggttcaatcggccatagatgaaggacgattgaagttcaccgatggctctaagatgaagcttgatcatgatccttttccagtgaatacgattaatttcaatgataagaaggtgttgatccggccggagcaagccgaatctactaagggaaaaggagtggtcattggcgagccaagacctaagatgatagtgccaaagaagccggagattggcgtttggaaggagaataagagtgaagcttcaacttctaaagcccctaggaagaccaaagtgacttttgatatgcttttggagaagtatgagaagcaaggtggtgagaaggctcacaacaaaggaaaaagaccaagatcacctcctagggagtgatttggtcattcaccgagacgatcgcattcacctccatatcatcatctacaagacatgtcatggggttcttattcaatgccgccaccgggttatccttatccttattatataccatggggggcaacaccgccaatgttcaaccatatgcctccaatgcaattcaaccaagggtggggaggaccaagaaggccaattcatgagcgtttgtcttcaccacacaatggccggttttatggtaggaaccgggccaatgaagaaaagagggaaggaaagcgcatcaaggtggaggcaaggacttcggaagtaattaccatcaaagtggggtttcatgatgtgccaataccttctagagatgatgttggagagtcctcaagcaaaaggtccgaagccggtaccagctcatcgcagtcggccggtctgaccaggccttctggccggtctgaccgcagccatacggccggtctgaccgggccatcaggccggtctgaccaccgacccgatagcggtccaaccgacgcctcaggccggtctaaccgtgcgccaaatgtcggtctgaccggcgcatctggccagtttgaccggtggtatacgtccggcctgaccgggctccagcgccggtttgataggaggtttgcaaagggcgatattggattcatcgtcttcaagcaaggttaatagaggacattatttatctcctggaacagagccgaatcctaggtggatgcctaaggatttgacggctactcaaaagagaaggttgcaacgtcttcgggctcaagaaatgggggcttttaactatttgccacttttagatttggcaaataactatttgccacccctatctcaatgacatgtgggtccacatgtatctatgacatgtgggtccagtggcaaaaagttaattgccacatctaaatgtggcaaatggttaaatatctccaagaaatgagagagaaaaaggccgaagaacaaagagataagaggtttaatgagttgcgaccaccaccggtatggaggcgtaagtccgtagagaaggaaaaatcggttgttgtagaggagaaggaggaataatcggttaataaaggtgaatcatctccaaaagaagatatggatatcaacatggtatgtatgttgcctatggagttttgtgctatggatgaagccggggttgctcaattctcattaggtcctaaagacgcggtttttgagaagcccgatgagtcaaaccgtcacatgaagcctctttatctcaaaggccatgttgatgggaagccggtctctaggatgttagtggatggaggtgccgctgtgaacttgatgtcgtattcattactcaagaagttgaggcgtgaggatgatgagttgaagaagaccaacatgattctcaatggcttcaatggtaaaccaacggaggcaaagggtatcttttcggcggagctcaccgtgggaaataagatgctaccaaccgctttcttcatcgtcgatgtgcaaggtaactacaatgttattttgggtcgttgttgggttcatgccaattgttgtgtgccttctaccttgcatcaatgtttaattcaatgggacggcgatgatgttgaaattgttcaagcggatacatcggctgaggttgcaatggccgatgctacttttgagtggcgtcatgggaatatctaatgtttatcggggagggatctttctaactatgattttattagtatctccgatggcaaatttgtacctatctctataaagctggctagtgtagcacggctaagccatataaatttgtataatgagtaaggaggctaatttagagtggttacaaaagagggtgcaagaatatcggtctacaaagaacgatattggtgaaaccattgaagattttgatgaagtggagaagcttggacaagggtttacatcggccgatccattgaaggaagtagacataggtgatggaaccaaaccaaggccgacttttgtaaacaaaaatatgagagccgattataattaaggttaagataatcgagctacttaaagaatatgttgattgctttgcatgggaatatcatgagatgccgggtcttagccgtgagcttgttgagcatcggcttccaattaaaccgggttttaggccttataagcaaccacctcgtcgttttaatcctttgctatatgaccgagtcaaagaggagattgatcggttgttgaaggcggggtttattaggccatgtcgttatacggagtgggtttctagcatagtcccggtggagaagaaggggagtggtaagattagagtttgcatagattttagagatttaaataaagccactcccaaagatgagtatcttatgcctatagccgacatgatgattaatgatgcctcgggtcataaggtgattagctttctagatggtaatgccggctacaatcaaatctttatgacggaagaggatatgtacaaaacggcttctaggtgcccgggatttgttggtttatttgagtgggttgtcatgacttttggattgaagaacgccggtgcaacatattaaagggcaatgaatttgatctttcatgatttgctaggtattatcttagagatctacattgatgatattgttgtcaaatcggatagaatggaaggacacatagccgatttgaggttagcttttgagaggatgcgccggtatggtttaaagatgaacccacttaagtgtgcttttggtgtgtcggcagggaagttcttaggattcatggtgcatgagagaggggttgagattgatcctaagaagatagaaaagattcgtgatttcaaagcgccgacatgcaagaaggaggttcagaagttgctagggaaggtgaattatttgaggaggtttatttctaatctagcgagtaaaatcgatgcttttgttcctatacttcgcttgaaaaaggaagccgattttacccggggggcaaaacaaaaagaggcgtttgaggagttgaagagatatttgtctactccacccgttgtgtgagcgcctaaagccggaaagccttttcggttatatattacctccgaagacaaagtcattggtgccgttttgacgcaagaggaagatggcaaggaatatatcattacatatttgagccgctgtcttttggatgccgaaacgaggtatgtctttatagagagactttgtctatgcttattctatgcttgtaccaaatggaggcattacttgttatctagtacatgcatagttgcttgtcaagccgatgttattagacacatgttgcaaaggccaattctaagtgggagaattggcaagtgggcatatgctttgatagaatatgatttggcttatgaaccattgaaatctatgaaaggccaaattgtatgtgattttatagtggaccatcatgtagatattgcttatgaggaaagggtttgcttagttgaagttataccttgaaagatttattttgatggttcttcttgcaaagaaggtcaaggcataggggtagttttgttttcacttaatggcatgtgttatgaagcatcggttcgtttggagtattattgtacaaataatcaagccgaatacaatgctctattattcggcttacaagttatggagatggttggagctaagtacgtggatgcttttggtgattcggaattggtggtgcaacaagtcgccggagtctacaaatgcttggacggatcactaaataggtacctcgattcatgtttggatattattgccaattttgataattttgctattagacatattgctaggtgtgataattctagagcaaatgacttggcacaacaagcatctagctataatgtgaagaagggattatttctgatattagaggagccggtgcttgcttttaaatctttgtgcgaaattggcgaaactggggaccaggggcggtctgaccggcattgcgtggccggtctgaccggtgaccaggggcggtctgaccggccacatgccgccggtctgaccggcgaccccgagcggtctgaccggccctgtatggtcggtctgaccagttctgggcagagcgctggggggcacgtttcaatcaatttagaggccgaattaattgtgaattcggacatttgtgcctaggaagcagaagaagattggagaattcctttgattcgatatttgaaagatcccacgcttaaggttgatcggaaaattcggcgacaagcgttcaaatacacattgcttgatgaggatttatatcgccgaaatatagatggtgtcttgttgaagtgcttagatgaagatcaatctaaagtgactatgggagaggtacatgaagggatttgtggaactcatcaatcagcccacaagatgaattggttgcttaggagagcggggttctatggccgaagatgattgatgattgcttcaaatattatagaggatgcgaggcttgtcaacggttcggtaatgttcaattggcgcccgccaccgtgttgaaccctataatcaaaccatggccgttccgaggatgggctttggatttcattggtcaaatttatccttcgtcatcaaaggggcataggttcgtgctagttgctacggattacttcaccaagtgggccgaagccgtgccgttgaagaatatgactcatacggaggtaattgactttattttgaagcatattatccatagattcggtattccacaaacattaactacggatcaaggtgcttcttttatatctaaagaagtgaagagttttgccgaatcttatggtattaaattgttgagttcttctccttactacgctcaggctaatggacaagccgagtcgagtaataaaacgttgttgaagttagtgaaaaagaagattgaggaatacccaaagaagtggcatgagatgctttctgaagcattgtgggcacataggatatttaaacatggtgccactaaagtcactccttttgagttggtttatggtcaagaagccgttttaccagtggaggtaaatcttggttctcttcgttatatcaagcaagatgatttgtcaagtgaagattacaagacattgatgggagacaaccttgatgaagtcatcgacaagtgattgaaggcattggaagaaatagagatagagaagaagaaggtggccaaggcgtacaacaaaagggtgaaagcaaagttgtttcaagttggagatttggtttggaagacaattttgcctttgggtactcgatccaaggagttcggtaagtggtcttctagttggagggtccttatcgagtatgcggtattgttcgaggaaacgcatattttttggacacacttcaagaggagcgttttcagtgagtaatcaacgggaaatacttaaagaaatacttcccgagcgtttggcaagacgcttaggaggtactatggtcggtaattggattatcgtcctaagaccaaaacatgttctatgcttttagattcacgttgttcatcaaaaaggcaggggggcatgtgtttactcccaaatttggcacctagaattaaaataggaaagattgccgaaatttggaagtttgccggtttcctccgagtgggccggtctgaccgccgtgtgttgggtggtcagaccgccggttcagggccggtcagatcggcggtgtgtggccgatctgactggcaggtccgagtccgactgtgtttcgtcgggtctcgaggtttccttgctcgagaaggcatgtttcgggtttcctttagtttctaccccgagttggacgtggagaagggcctgtagagggcaagaccaacccctatataagggacatggccggttcattgtaaaaatcaatctacaatcaatcaatcaaatcgtttttcatattgcttttagttttctcttagtttgtccatctttgtcggtttgcaccgtaaaccatccgccgccgctgcgagagtgcgacatctctttgtaggtttgtcctgaaaaccttccgttttgcccacgaggcgggtagttatctagaaatcggctccgctagccggtttagttatcaaaacccatctaggtttagctctttgctagatcgaggtggttggcgactctaggatcaccgtaaggcttaaggtgctgcgatcgtgcttgtcaacttgtcaaaaaagttgccaacacagggtttacaaaaccgcgcggttaccacagtaaccttttcagtttttgaaatcacggtatgtcttgcggttaccacgtgattttcgtggtaactgcgcagttaccgcggtaaccaccttaccgcgggggtgcggtaaccgcgctaaaaacggtaagggaaaccctggtagtaagaaggctattccattggacaagttggtcatacttgccgggtatttgattgagggaatggaattgatctctcttttttttttttgagaaccgaattgatctctctagcgtttggttaggacttaggagacagttttgtcagtgaaaaatcggtatagcttcataccgcatcttgaagagattccgtacatcctccataaaaaagactcttagaatatctagaattatccatagaaattaatatttttgatggaggaagaggttggaaccagactatgttccatacctctatttcttctctatctctatctctactattataaaaattaaagatgtttttgtcaagattttggtaattgtcatccgaatccttttacgatttctagatctttacctatactttttttaaaataataataataataatgattatctactcattattctttcgtttgttatccgactctatctatatgggttcgcaatgcacacgtggtagatgtccgactcagtccgcgagaacatgatgggcgcgtgattgattcagaacgttgtagatgtaacgcgagattggcagctccctattttgtgatcgattttgctacatctcaatcgaaatattttttttcttatctctcacttgattttcccacttaaatatacagtgtattttcttgtaatttacagtgtaatttataaaacttacattgtaacttttgtaagttacagtgtaatttttgaatcttcgtatgtaagttttgaaatttatattgggtttggtctttttcttgaagatatggcaattagtatccattatggtgtttcttagttgctttttgtctttttgctgtgtctattggattttaatctaaagattaaaaatctgtgtgatatgatgtcatgggctttgggccgggaatcctagacccattggatagagttagggtttgttaggattagattaaggagtcctccatctatataagtagggatcctattccagattggcattagatcaaaatttatcttagtgcccatcggcctgccttctcagtgcgacaaagagcgtctcgccgtttacgttcaggaccgttccttgttatttcatttactataatccaatctatttcccttcgtcccttttcatcccaaataatcctaacacgtgataacttggtatcagagcttcggttccgtgcccatgggtgccgagatcgctgtggttctcaacattagcgaaggccttgccgagatctcgaagaagatgatggacttggtggcgcaactctaggccttggcagcccagtcagccgagccggcggccttccttgaggatgccgaatcatcatactggcatgtagcgtccttgcgaccacgagggcgcgtcttcaagcggcacggatggtggcagtaatcggcggtgacgccactccatggcaggccatcgccgacaacctcctttacgtcatttcgtcgaccatagggcgggatcggctgcaggttccatcggcgaccaactatggcgcaactgggtggtgcgctgctaggattagcatcggtgatgcctcttgcctccgccactcacgcatgcgcagcccagcccaccgtccggggtcgtcggcaatggcgttctgcaaccatgcgggggtggcgtgactcacggcgaggcgctcacgcttcctcgagcggcggcgcaagttccgagagtggcaggtacaatttggcgcgggaagatagcgacatacatgcggcgtgaattgcgggaacggcaggtgggcgagcaacctcggcctcgccgctgggcctagcgatggtgccgtcgctgttggcgccctcaacggagtcagagaagacgacggtgagttccacttcgatggcgacacaacacggcgacggttggagcagagccagccggcgtatggcggcgcgattcactagcgcgacgggtgggcgcggcattcgcttgtcgtgatggcgcagatcgcgccgggtccgcgagctggttcacgaagtttgcggctcgaccacggctgagtcgttcctggcggcatgtgcgcgttgagaactgtggacgcggcagttgtgcaaggacttcaagtcgaagttgggggcgatttcttttggcgtggcccaacttctcttctcgcggacggcgctcctcacgcgcatgttgttggaggcagcgctatctacgggaggagcaagggtttctcctcttttctcctcatctgggcaatttaaatgggctagactggtgggctgggcttcgatctgcagctgatccatgttggcctagatatgtttggattctggcatgggcctcactttcctttcaaggcttctgggtggggtccacctgtccatatctatgatgacaacataaaagtaaaagtagggttgttcacaacagtagtattaattatataggagtatatatttcagccgagatgtaaaaggcttgtgaatctttgtttaggctatggtactttgtttgagtctagcggggtgtgcctcgagctgcttaaaaagaggggagtaatgtcatgggctttgggccgggaatcctaggcctattggatagagttagggtttgttaggattagatagggtttgttaggattagattaaggagtcctccatctatataaggagggaccctattccagatcagttaggcattagatcaagatttatcttagtgcccatcggcctgccttctcagtgagacagagagcgtcgcgctgtttaggttcagaaccgtttcttgttatttcatctactataatccaatctatcctcattcatctcgattcatctccacataatcttagaccgtgacatatgatcataaaaatcttttgaaagatgcatggatactctcgatgaatacaaagcccatcttctcctcctacgtaacactgctccctacgttcagatttgtttgagtttaataaaaaaaatatgacttagataaaaaaattaaaccataatttaatatttagcgtaattttattttttttcccgttgcaacacacatgcatttagctagtctctactattataaaaattgaagatgtttttaccggtattttggtacgttatccgtgtatgagtcgctttttaagttcattatttgcatttggaaatacaaatccgtgtttgagtcggtatttgaattcgttcgcttttacaaataaagaaggagaaggagacgtataagaaatctcttttataaacttgcatactaacttgacatgatcaaacttataattgcagttcccaccgtgaattttaccttagttaaaccgttcaacaataatatgattaaattagccttcactcgttgctacatacgtgtattttttttcaagtcatctaataaaccaaacaagctgataatccatttttgcttttcagaaatatgctaattcaatttcttcttgtgccccaaccaagcactagctctgaggcgaggcaaagcttttgcctttcttttaaaaaaaacacccaagcactagctaaaaggtgttcacacgaagcaaaacatatcaaatactcctatctctcacaacgtagaataaggaaaaaaacactgtaaaaggtatggaatattcttaacttgttgcaaggaactgatcaaaagcataacctttttagccaaatgcatgatcatattgttgtccatttatactagtacaatcttaacaaacctgtaataaattttggacaaggaaaaaaatattatccatgaaatttgggtgttcattaccatgattgtgactttatgtcaacactgaaatcaaacttactaaattcaacattttctagatatatcgatctctttttagtataaaaaaatatagttacgtgcgtttataaggttgagtgtacgtatattgtgagcgcatacatgatttatatcatgtttcttattaaaaacagtaatcccaaccgttgatcaataaaccagatccttcaatccgaggagaagatgagcccttcccgttcggaatacagtacgtacatacgtatactccgtaacaaatcaggttaattaatttcctctctataagaaatataaaaaattccgcttaataattacctgatctggactacctgagcgacttggtctcgtctcctcgtcttctcgccgccgccgcgagcggaatccccctctctccgtctaaacctcgccgccgcggcgaagcaaaagcacctccctcttcgccgccgcccgccggcaatggcggggctgtcgctgcggtgcggcgactgcggcgtgctgctgcggagcgtggaggaggcgcaggcgcacgccgaggccaccaaccacgccaacttctccgagtccaccgaggccgtcctcaacctcgtctgcgccgcctgcggcaagccctgccgctcccagaccgtgagatccccccatccccctccccaccttccctttggttttcactttctcgatcgaattccgccggattcggtggttctcgatccgattttagtctcacctggttggttgtgtggatctctgatcttgcgcggcgcaggaggtggacctgcacaccaagcgcacgggccacacggagttcactgacaagaccatggaggcggccaagccaattgatctcgaggcggcgccgccgaagccggccggcgaggccatggatgtcgatgcctcggcaagcgccgagccacaaggtgaggtggttgttgttgagatgatcgaaagggttatgatctgtggccgcctttgggtggcaaagagtgttgaatcttggtggctttttgcttccggcagagatggtggcgccggaggttaacaaggagatgctggcggacctcgaggcgatggggttcacgacggcgcgtgccactagggcacttcatttttctggtatggtgtagcaagatagtatgtcttagttcaacatttgtaccatgctgtcaagttctttctccaacttagattttatttattagcaaattattactagagtactccctccttcccataaaaaaccgaatcttagtgtccagattcatccctaagattcggttttttatgggacagaggagtagactgcagatgcagtagaaaagtattaactgttcaagtgtatatatgttcgctcgtgcgactgagctatttgagactttgatctaagaaagtctcggctagaaggctttttatcacagtaaattctggaccaaggatttcagcatatggtgaataaaggaacgacctcgattggaaagtatatgctttgctattgagtcttgcagatcaaataatgctagtgcttgtgcattgcaacaagatacattatgagtgcaaaattagacatacattctgcattgtagtgcctgtggaccgaaatttacaatatgacagaaaaaacaaggcattatatatgcattgaaagctgaactatttgctgtgcttttggacaaaactgtctcagtggaccagaagtcaataagactacgttttgcagtcttacttatatattatgattgtctcatctatattagttaaataaacataacaccttcagtaagcaaaccatgattaattcataactttgtttgcacccatttaattttcctctaggtaatagcactattgaaggtgccattaactggctttccgagcaccaagaagatccagatattgacgaaccgcttctggtatgatgaatttatattttttgttgctgattaattgattatacctttatttgttttggtatgctggtgtgctaaattgccccttgctgaaaaaataatatgttttggatattaagtggttattttggtattattttcatcgtgcttgtgtagtgctacactgaattgcactgtctgacctctgacattctatccatggagtttcagtaatacccaaaacttttactatatttatttattatttgtgcagctcaatgtatttactgtaacaatgaaaacgcatttcaaacatttgaaaaattggcataggttgtccattttggttttttttcccctgcgtatgcccatgtatctaggaccaaacttgcacatttgaatatatctaacctcccacttcagaggttcaattaattgtgtccaatgggagtaatagatgaattctttctgtgttatacctatacttgtccagaaaatttttgctctccagtacataactttacacttaccttctttcatctctcaggtaccggctaatacaataactgaggctaataaaccctctttgtctcctgaggaaatgaagattaaagctcaggaattaaggtgtgttcatgaacttattgctttcttattatctttaatgagttgatggttttatatatatcttcagaaaattgcattgacttgtgtctgtctgtagcactaccttttcctcgttgaaatcagttcaattgacatttaagtacttgtatgctttgtcgtatgtggttgggctttgtaatcgcatgcattggtacgacaatttttttcactgctttaaaaatgataatttttattggacttgaaactcaatataaatgacaatagaattctcatatttaatccctgaagttctatacttttattacattccctacgtattttctttgcacatgataacccccaatatgcagattgtgcacttttttatcgtaccgccttaaacaggaactttgttcaatatttgctctccgtttgtcatattaacactggaacaaccacagatctggcgttatgattctgattttaactttttgttactaaactattgagtttactcactcgatttgtagggaacgtgctcgtaaaaagaaagaagaagaaagagaaggatggaaagagaaagggagaaggtttgttctcaacttctttttaccttatttaatgtatttagaaatgtatgaatcaagattacctgcagcacatttatatatctggtttcttctgtgcagt

SEQ ID NO: 59565 - DNA, 18160 bp, Oryza sativa
cttacattatgaaacggagggagtaacaacttttagcattcaacatttgtctcaaaatataacaacttcttcaacaacattttcttcctaaccaatcacaaccctccacaattcacttttcttaactacctccacttctcaaccaatcataacatcttcgtatttaattctccctactttcttaataaccgtacccaactctaaaactttttatattctaggacggaggtaatacttctcaatactcatttcttaccttaaaaattcttatatttttagataaatgtagtaaaatttagtcacatgaaacgttctcgctgttaagtttgtcacgaatcaatttgtggaggagctctgcctgttataagagcaagtttaataatagagacaactgctctcgttataagagctatctataagcttatattagaactaatatataattgatactccatccgtcctaaaatatagcaaccttgtactggatgggtcactattttaggacggagagagtaaattataaggttatctctgattgttttctcttatccctttctcatattatataatatacgtagtatatctttattggaacatgttaagagttaatttttgcatggaagctgactcttctcttttccttttttttacatacttcctccgtcccaaaagataataacctataattggatggataaaacgtttcttagtataatgtatcttgatagacttcttatctaaatatgttgtactggaaaatggcttatccaatcctagatttttatattttaggataaaagtaataagtttttatggcttactccctctgttctaaaacacttatttttatattcaaatatggatatacactatatctatatttggcaaaattggttatgtttagatttaaacctaggccgtgtttagctccttcaaaagttgaaagtttgggttgaaattggtacgatatgactaaaaggtgtgtgtatgacaggttgatgttatgaaaaaagttggaagtttgaatctaaacacagccctataaatgttttttttttccggagggagtatagctttgctactgtactcgctctgaccggacggcacgctggctgacgctaccaccacaaggatattctcgcgatcacatcacatcgtcgcgttggtggggaccggccggcggacaacggcagaaacgccatccccaatatccccccatatcccttctggtgggcaagtacggtggatgtggatgctctccgcttccgctcgcccggtcaacgatcccacgcatcctacggtgcgcgcccgcgtcggcgtgacggtctctgccgcgtctcgtcgtcgcccacccaaagccgcccgcccgtgcgccgcgcgcgtctcgcgcgtttccgtcgcacggcgcgcctgggcgtggggcggcagcctcacgctgatccccgacggcgaccggagcggccgctgcgattctcaaaagtccaatctcatatcgtctcatcttgtgtgtgtgcgcgcgcgcgcgcatgctgcgtatcatcgccatcaccgtccactcaagttcgtggacgccagaggcgaaaaaaaaaaaagagcacagaagaccagtctctctggtctctctctcgatcgatgagcagttgcccccacaacattgggaggtagagattccaagtaggtgcaccccgtgctgttggtccgaaatgccgcgtgcatgatcctacaaaagcgcgtgcgtcgcatcctcgcaggggcggggcggagcgtgtggcgatgagcgacgcagcctgtcgattagtggctttctcggtggcatgtgggcaaatgggcgatggtctacccgtatctgcaagttgtgcgtctccatataaagttgggctcacctataattcattgagtcttgtaccttgggcatacccttagagaattatactgatggagatgattaaaagcaagactaataatacagccagctgcttactgtatagatccctatagtttatctctcagctcactcatacagtggctaactctttactatgaatatatggttcacctatctgtctcatagatttttttgattcctgtgcctaagccaactataaacttatatcctgcttcttatctctctcctttcctctcttatccacctcagcatttagcttttttatagccctctattatacttgctctaatatttgttcgcacctataattcatatatcttttcaaaattgtaattaacaaactgaatttgaaatacaaatactatagttgactaccaaaagaccactatcacccgttgcctcaaaaggctcaaagcctcaaaccggtcatggggttgaaaaaaaaaaagaaagaaacatgagaagtaatctcttatttttcttcttttctggagaggaacatgaggcgcaatatatttatctctctagcgttgaaacctagcccttggaacaatttgtttatgttgtcaggctagctgtttttgcatctccacggaagtgattatacgatgatttcctgtattttgcagtttggatcacgtcatgcttctgtcgacggggatacccgtagaccggatatagagggtattggggtacgctggtacgaggatctacataatacgacatcaagcagacagaaaacaaaaattatactggttaaaaccccttgataggtaatagcactaatccagttgatatgggattatatgatggaaaccacatattataaagggaaagcggaacttgatgataccgccgagatcgtaatcgagcaggtccgattagatctcccggcgacttggctcctgcaggcttcaactccgtagatggtggtggatgtattggctatgagattcgatgccttaggtcctcccgggggtcccttttatatcgcaggccaactggtctccaagtaggacacggaggcatcggacccggcacgatacaatgacgacccagttccgtccgagtaggactcctttcatctgtgaactccatgataaatttccttaacgtatgcaaaaaacgtccgtatacgtgcaaaggtaccatatcgatatgtgacgtatatcgaagggtagagggtatcccttacccgtaaccctgacagcttcggcaaggcatgatgcccttttctaaccttttgacaactcgaggtattagactagttagagcatcccatcctagcagctcatctaaatttaatcctccatattctcatatggatggccatccaaaaaagattccttcttcatataccttcctactccaatagatcattcatattacatcctccatatcacaacctcctatattttactaatatcttccaactaaccatatatttgtgttattttttaagggctatatcttgaacaactaaattttaacggtgttatttatcacgataatgtaaataagtgtattttaacctatatatttttaatggataatttaatgcattaaattgtgactttctcccagactatatttctctttttctctccttttctattcctccttctctctgcttctttctacactcttctccattctttccccttctctcttctgccgactgccgcaactctcctctcctctcctctcggcgtgggagacggcggcagcggggcaaccgagctggcagaaagcggcggcaggcgtgtagcctagggacggcggcggccgggcgggcgagtgacgggggcggcggcggaggcgagtggccgggcgagcgaggggcgggggcggccacggaggcaagcgaccgggcaggtgagggccgtggatggtcggggaggaggcagccggcggcaggcgagcgaggggcggaggaggccgcgcatcttgacggcggcaggcgacgcgagcaaggagcagcagcgcgggcgcaatcccgataggggcggcacggatggcggggcctccactccgacgaactccaacgacagacccggtatgtccatcctctctattccccatggtacaatccagatggtggcacgagttcatctgagctgagtagttgggggatagcgtgaggagagagaaacaccaaatttggcatagggagggctcggtttgaaggacctctaaaaatgacgtgtgtgatggaggctttggtggagcgtgttttttcatctccatacgctaaaaatgggatggatggctagatggaagagctgctcttaggctgtgttcttgcgttatgattggaacttcttccctagaaacgtaaaacgaaacaaacttattattgcatattagcttaaaaaactttgaagtggattaatataaatttttaaagtaacttttctatagaaaaattttataaaaaaacatatcgtccaaaaacatgtgcgcggaaaacgagccagtcgaaaaacacagcctgatgcttcggcccggtttagttccccacttttttttctcaaaataccacatcgaatctttaaacacatgcatggagtattaaatatagataaaaacaaaaactaattgcatagttagggagaaaatcgcgagacgaatcttttgagcctaattagtccatgattagtcataagtgctacagtaacttacatgtgctaatgatatattaattaggctcaaaagattcgtctcacggtttccaggcgatttataaaattagttttttcattcacgtccgaaatctcctttcgacatccgattaaatatccgatgtgacacctaaaaattttcttttagcgaaataaacatgcccttctacctttctcccttgctacgagtactagctagtactcgtactttatttgccggttccgtgatgcttcattggtcacaaaaaatactcgacatattgcataagcatgtgatgaaattctttaaaactttgtaatcatatttagatagttgtacgcgtgaggctacctaggcctccaatatctctctagacgagtgttagccacgcacgtggatgtgtgcgtccttgagtttgcctaacttgtactcgaaaagaatatttatatatttttttctcagaacatatttttcatgatagtatagtgtaatattagtttttaatttctcatttattttttgtatgagagagtagattgttcaagaggtcgtcttgatctctggacttaattgtggagctaacctttacccagatatacacctggctcaaccaggtattaatgccaaaaaaaaaagttattttctgctaaatggatgaatgtgcgtgtaacctgaactcctaaaccatgcgattgttgcaaactttttccatatatgatttgttgtaatattgtttcaaatccatttttaaactttaaaatgattgatttattcatttgtgctattgaataacttttgtacaaatcttccatcgaattaatcattcagcccaaaagaacaccggaatgggtagtacgaaaaatattaatggaaaactatatatgcttcacaagttggaaaagtcatattcatcattatatagttagaatctttcccccaaaaaaacggaggcagacaaactgtagttgaatattgcaaaaatagagggagcgttattgttgctagttgtgtatgcctgtgcgtcaataaacaaaatcaatacgtttcgtgagcttgtaaaataagattcattgattctcggtagcgtgacactgcagataggctgtggagtattatgcatttattatgttccgttcatctcaaaattagcacagcacgaaaattaattaattaacgaacccgatttaatccatggcacttgacaccattcgatccctatctggagggattcactgatactgaacgctgaccattcgatccctatctggatggattcactcatacagcacgaaaattaagtagtaagaatgattaattataatacttctaaagataagtatgagatttgatttccccgggtgtaattatcaaataattttgtccagttttggaacagatgtgagtgtagtaggtaaggtgtgtgcggtgtatgaattgggacgacggagcgatgtaaagaattagataagttagaaagggaaatgctgtattacaaatttacgagccctctcatccacgtaaaaaaaaattatactactagctctgtcacctggcacgtaaatgatagtgacgtgcaattagttgatactgtgatttttctcattggttagatcgcacgtgcacggtaagaaaaacgtaaagaaaatgtggttgtgcattcgttgacacttgggtgtgttcttctgggctgaaggaaataaaatgcaatgctgaataaaatgattcaagggcacgacaaaatgaagtatttagtataaagttaaagaaaggatatagaataatattttgagaaaactatatgtagaaagttttctgaaagctcaagaagcatgtgtacttattattatatccaattccattaggtggaaaagaagttcaaaattctaggtttaacacctgtggccgattatattttataactttatatgcatgtatatacatgtatgtaatgatacgtgtatcaatgctcttaaagcatgatgagcttgtttagttcagtaccataccaatattggtagtgctaagatttagcattactacttttttaaagtagggtgcaattgtatttggtttgatgtcaatttagagtcaaactttgagtagaatcaaaaatttttggggagtagctatatttatgacgccatattttttattaaaaaatagtcggcatgtgtttacattgtaagtccctaaattacatatgtaattttagtgtatttacaatgtaagtctcaaaattacatatgtaagtcctaaaattatatatgtaaatttcaaaattacatatgtaagtggtgtgtaagtgggatgtaattactatgtaaatttgtataaatatatgagaagtgtcttttttttttaagaaaagatgtttgctaagctggtatgagcgtgctatgctgtactcccggccttagcatactgctgttttagcaccaatcttgacatcaattcaatgcaccacaaatcgacatatttttaagggaaaaactgtcaccactttttatagcgtttctgaatttaaattagacattaacaacaccaatgattcgacttgaaacaaaaaccattatccagactacccaaatattaatagggcatgttttgacattacggatgtctcaaacaatatttaaagcacgtgtgcacggtacacgtgtcccagatggagtagtttacccaggggaaagggacgccgccgcaccggacgaagctgctgccataccactgccagatggaggtggcggagcaccgaactaacgacgaggccgtccccgttcctgttggattggactggaccttcgcgtaggagcgcgccgatacagacaacgagacaagccgccgtcgcgtatctcatctcgtgtcatcgagtggtgtgtgacgctcgccgaacggcgtctcccccaccccaaatctcacttggttttggacctcccgactttggtacacatcacacaacacaacacaacacccggaaccaacagagaacaaggcgccaaaccaaaccgccgcgcatcctcctctcgccgagcagcagccagccgcggcgcacggccgcacgcacgcgcgcgcggcctcacccgtaaaaacgacgcgggagcacggcggaaatcgctgtcgacgacgatgggcggagagcccccccgaaccgaaccccaccgatcagtttcttccatccaccacgtcgcggccgcccgcccaaccgcctcccgccacacacacacgacacaacccgcgcgcggtcggagaggccattctcgccgtatgccagttggggccgatctcccgggggaaaaaaagaaaaaaaaattaaaggacacgaaacgtttcccagtcgacggacggagcaaagcgagtcgtccggatccgctttaaaaccgcgaccacctctgcttctccccttctctctcctccctcctcccatgtcaacggcggccacccccctcctcctccacctccacctctagagagagaaagccctcggccgccgccgccgtgttcttcgtcgtcgtcgtcttcttcttctgcggattgtggtgctcggtttggtcggtgagtttgggtggctggcgatggcattcgcgggggacgcgcggatcgtcgtcgtggcggtggcggcgttcgtcctcgttggcgtggcggtggaggggaagggggaggggggaggaggaggaggggtgggggtgtgcttcgagaggatattcagcttcggggactcgctgacggacaccggcaacttcctgctctccgtgccggaggacttcccggaccccgcccgcagcctcccctacggccagaccttcttcggccgcccctccggccgctactccgacggccgcaacctcctcgacttcttcggtatcacccccctcctcctcctcctcttcatttcatttttcttcagatttttttttctctcatcctgccatccgggaccgggacccccttcggcttccctgtttgttttgtttattctgttggtgtcgggtccccctctggtaaaatctcctacgttttggtggtatgaatggatcaatcgatgcagcaatctacttgaagattagtagtagccgggtaattggattgattagttactactttttggttcttggtttctctccttgatgaatactccacgcgtttgatttttcttcaagtaataaattcatcatcgtttcttcttgtgagccggcataagcggtgtggcgatgatatagtatgataatttccactgtttttgtatgcctgcaatgcatcgaacaagaataagccacaaatttacttgtgtctgcaaatttatcaattggcctcactgatcataacaatttgaaatgcgcgtgtggttcagagatgtgaactagttatagcaaatttcactgcaaaatacccaacttatacagggcgtatccgcaaaatctgcttaccttccccagtttcccccaaccaacagaccatgatggcatcgtcttcttgaacaagcacacaaatcggtagctccaaccaccactgaatcagcattcacatcactcacgtggtcaacacttttattgcagtcttcccaaattttgtgtcctttgctaatagtatctgttccatggggttggcttcctcatgttcttgtatcttagcagctgctgtcgctagcttcattgtccttagagatgacgtgcactaacattcttttttttttctttgcgtgaccagcggaagcatttggtctgccgttcgtgccgccgtacctggctggcggcgacttccggcaaggcgcaaatttcgcggtcggcggcgccaccgccctcaacggatcattcttccgggaccgcggcgtggagccgacatggacgccgcactccctcgatgagcagatgcagtggttcaagaagctactcactactgtctcctcgtcagagtccggtacgtcaccctcctgagacctggagttctttgctgttgctactagtatgtcggataagctgatcgatgcatgagccgttattaaccgtgttagtagacgccaaggaaacatgtgagcgtggcatcacagcatgccagtggatacagtaaatagtgtccaaacatgctgaaaaccgtgcagatgagctggccacctactggccagaatggttgttcagtacgagcaaattgctgcatttagtagagtggctcctttccctgtttgcaacttgcaagcaagcactttgtttttagttggcttgtaagctaaagttcactagttaaatggcaccgcaaaactgctacttggagccttctgattaggtgaaaacattctgtgtccttatatgtgatgagatagccggctgtgcaaatattgtaggatatttgtggaaccatgtttaaccagcaggctggtttgacaggttttaaccagcagcaacatgttagaaaatctttactgggttgtcaaagcaaaatcatctcgtctaactgttctagagtggcactgaattacatgcatggttgagacataaaagccaagtccataattccaaaatcgatgaagtacacatagtggaactcaaaagccaattataatactttctcagcatcttgatactatgcatacaaaatattatgaacgaaccaccttacaacaacatacggggggtttcatttttggtttctcctcacaagtcacaagttgattccaaaatacctgtgcgtttcatttttctgatgtcacaagtttaaaaacctaaatctcgagctacatgtccgctaaattattgtctatctctgtgcagaactcaatgatatcatgaccaagtcacttttccttgtgggagaggtaggcggaaatgattacaaccatctaattgtcagggggaaatctctagatgagctacacgagcttgttcctaaggttgtcggtaccataacctcagctatcacggtatgcatatcacctgcctttacatttatgtgcgatggtgaatttttatgaagccgtgttcatagtttacagttttgcaggagctcataaaccttggagcaaagaaactagttgttccaggaaactttccaataggctgtgtaccattgtatctctcaatctttccaagccaaaaggaagactactatgatgagaaaacagggtgcattaaatggttaaatgaattcaccgagtaccataatcgattgcttcaggaggagctggagaagctcaggaatctttaccccgatgtatccatcatttatgctgattattatggtgctgcattgaatatattccttgccccactccagtttggtgagttccaccttccaactaaaaaattattaacacagagagcacattttataagtggtaagaatatttgagatttagttataggtcaagcataccttagtcaatttacatgagccttcaaaacttccaagcgtacctggcctgcattacattcatttcgtgaataaacttcaattaggaagaagctgatggttatagtcaacatggatctgatagtatatgctaaaacctgtcagtatttactggatatagcctgtattggccctccatgatatacaaagctctctgacttcgatgagcttctatagacttgatgagtccatgagccaattaaaatttattctattaaattttgctaaaactgttaacatggctagcatatatcatatgaactttatgtatccatattgattctcaatgttctaaaagttacctcatgtccacaaagacatgttttggtgacagatggagtaacttgttgactttaggtataagtaactaatggtctgtaaagttggtatattcttgtgctatattttttattagtaacactatatgatcttagataattcagataggcgaaaataggtattcttttacctatgctactgaataagttgcagaaacctatttcgtgctccactgttcttgatcttattgtgaccttgatgatgcagcacagtctgcaccccaccagcagggatctaaactagccttgcacttatcttcatatgcataggcattcttaaacatggtcgaggtagtttttaatcatctgaagtgttaaataactactggcgattaatcgaaatcagagcttgaagatgcttaacctatccacgtaacacatacagaagccaatgtttacaacataaggttcactagtcgcattcatagcataaggcccagcatttgatacaaagtcaacaaactcgtcggcccccccccccccttttctctattttcaaactgaccacttttaccagatggaagagaagtataagcagaaatagaaacacaggaaactatgtattccgcataaaacttttggttattgacaaaaatggggctaagaaaggttttgtgctattgcaggtttcactgtcccgctgaactcgtgttgtggaagtgatgctccatacaattgttctccgtcaatattgtgcgggcaccctgggtctgtggtctgctctgacccatcaaagtacacttcatgggatggtctccacttcacggaggcaacctacaagattatcattcaaggggtgctagggtcatatgccaaccctcctctttcagaaacttgtcggggtggagcatacaaagtctcacaacttcatcaatgtacagataacccaacaaacactgtaacgtatgattctatgagctcttttatttgatcctctgagctctagggcatgtagagtattaaggagcaatatagatataacaggccccatccccttggacacttctcaaaggtgagaagagcattggttggggatctttgtacttctcaaatccatttttctgctacaggtagaaaagagattttgtagagcagaaatttgcaattgccatgtccatggctttgcccaacccatttagtttctcagaaatttactgcaacgggaaacagaaagtacaccgtatagtttttcttttagtatggtcaggttgccatgctatatagtatactctatataggaaacaaggttcatgattcatctccaaaaggacaatgtattcagtactgtaggcctaatttccttacaacaaaagcgtatacttgatgcttgcttgttcagcagtctgctgtatatgatcaccctgcaatgttcagttccatatctgaaattggtcctcctgtcttctaagagattgggcctgttcggaggaattttagattatggtaaaatgataagcagctagtgaatctgtagaaattgggaaaattggattctgtcttctaattcattttctagattctataagcttagcttctcagaatctgaatgagaagtagactgtttgaagaagttctgattccgagagaagctaaagctgtcagacgagcacatgaatcaactctgaatgtttggcaactaacaatgtccaaagtcaggctccatggagcaattctggcacggttaatttcatcattttgaccaattagttgccaaatattccgagtaggttcatctgttggtgtcatgttgatcaggaacaggaaactgtctcatactcgtactacctagcaacagaatgaaccattcaagaggatccatgtcggccaaaccaatgaacatgcagttccaaacttcacacaaccaggtcaggtggcacctggtattgttcagatacttcgttcctgacatgtcattacatgattcaccctgacacccgacttcttttatttatagtaatcaataatccttcaattaaatgaatagtaattagaggcaacaaattaggaaaatgggcaggacgataccactttctggtattgtcgacggcgtccaaggtctggtcagtgtccactttctggtttcacaaacggaattggaagccttgtctctggtccaccgcgccaatctcctcatggctgcggcccacgggccgccgctctcagctgctcctcacgacagctcccgtggatgatttcttttttttttcagaaataaatacaacttcaatgaaaaattggcaaaatagatgttagttgactgaaattacctatcgaacaacggttgtttgatagggttagcacagtaaaaaaaaaaggagaaattgggatgcgtgcgtatacatatgagtagaccgaaaaggctaacagacgatcgattgcccctagcgatcacgtccccttctccacgtggtttctttttttttttggcaccgattacttttctatttttgtaaatttatgcacctaaagtttgtacacctcaagtttaaacatctaaagtttagagacccaaagtttataagtcaaaagtttatatatctgattcaaatttgaatttgaattcaaatattttttatatatagtacttttatacacctaaaatttatagatctaaaatttgtaagtcaaaagtttacatacctaattcaaatttaaatttgaattcaaatattagtttatagacccaaagtttataagtcaagaatttacatacccgttttaaatttgaatttaaattcaaatattttttatatatagtatttctatacataaattttttcagctttgtttttttattttttttaaaatttatggtgtagcagaaagagaaggagaggagcgtattggggggggggggggggggtgggggtgatcactgtgggcaatcatccgcccattagccacgccctgagtagactgctacatgtgagcaacacctatcgaattttgggagttcgatttatggaactttggggtttcgatagtccacctgcatgcttgctcttttcgtttttttttaatcaagtcaattcccatgcatgctctttttgataggatatgtcaagctacggctgtttggcagggtgctaaatttgtgatttcagtcgaccaacatttattttgcaattttctattaaagttgtattatttctaattttttcccctcatctatcctccgccgccgcgaggcgcgtccacgcgtgtccacctctcgtcatcaccagaccagctttactatggaaacatgtataatgccacatatgtaatggaaatgtacgtttgctgcatatcaatgtcaccgtaaataaaacttttacaatagtaataaagtttcattataagttttcctcatacatgaagtaaaagtttactcatactgacgtgaataaatctcatctaattttacatcctatggtccactatatatttttcctactgactgacagatctgtcgtcttcattcagattggcagatccctcgtctgcaatttagattcagctacttttgtgcttcattgggatttctagaatccttatatgtccgtcttcatatacaatgtctttgtcgtagatcgtaatgtctcgcaactatggtttttaggtagaaaattcgttctgttataaaacttgttcggattgttgatctgagccggtttagtctttaccgtttactatgatacatttatgtttcggaattgctaaccatcatttggtagaattttagggtgaattttctgtctaattctccatcattggatccacaccatgattcgtgttccaatccttcttctctagctctagcacaactccgacgagatggccacaacctgactagttagagtttcgggattgaggtttgggttggaaggggggagggagagggggagagttccccggtcttagagggatgaccgtggcccgtggaggcaacatcccaacagtgggcggtggaatgggtgagcggggaaggtggcgtcaccgttgccgctgaagccacgggggcaggagagggcggttgactggtgttggtagcgggagcaaagctaggagggggcagaggtggcgtctttggtgggggactatcggagatggaaaagatgacgggtaggtactctctgccgatggcttaactgggggggaggggaaggggaaggtatggtggacctcgttggcacgattgactcgtttccgatgctagcaaggctgggtagtgacgtggtgggcagtggcggatcgggaggaggatgaggctgactgatcgattaaagagaagtggtggtgcatgaagggaaataggaggaataggagagagttatggtcaaagaattacacgaatattaaagcagatgtaacgataaaaaaacgaaaattgtggggtggattttctcacatgttgtatagtcaatccatttaggttttcatatagaatgacaaactttgtcgaatgattacgttgacatttagttccttgaattttttagagacatagcacaaacgcatatactctcaatacgcgcacactcgtccctattagcacctccgaaaaactggccaacgtcactgtaattgtctcgcaatcgacgagtatgttgtctatcaatgaaaaaataattagtcataaatgtgaacatccatgttaagttcatgagctgattccaccacaagaaacctaacaagttaagctacgctcacattgtatttagttcatcgatattgatgcaaagcgtaagttaatttttgcactggcttgtttcttgacacgtggactttttgtgaagacaaccgaaatttacgagaatgattcacgtcggtcgcccggcgcggggggagccggattgggcgctcccctcgcgcgcccctccccccacgtgtgggcccacccacttctctctccttttttccacaaaagatgtttcatctagtataattacaatgtttcactatttataaatataatgttgcagtgaattaaaatactctttttcaacaaaaaacccacatattttggaaactctctattaaggaaatttggtttattttttattctaccaaaaatatttcacctagtgtactcacaatgtttcactatttatagatctaatacagtgaacgaaacattccattgcaacaaaaaaaacccacatattttggaaaccccctattaagggaatttggtttattttttgtttcaccaaaaaatgtttcacctagtgtactcacaatgtttcactatgtatagatttaatgttgtagtgaactgaaacattctttcgctatttgctgaaatattgtttttatataaggtgaaacaacacccaatttaaacgagtgaaacattttcgatctacttagtggaacaattctgatatacttggtggaacatcgtgcaacatttaaaaataattcaataataagctaattttttttgtcggaatatattcatgtgtggtcttgttttgaagatttaattacaacaaatttaatggtgcaatcggatcatgatttagataaataatttaagagaaaaatcagtgcgcctgattttttttccaaatcgattgggcgaccgatccataggcgcgtcccgaaatttattcttgatcctgaaattctatcttagaaagaaggtaaacatccaatatttctcctgtgaaatgttctgccgtactgctgctcttctgaatcatgattgtggcaacgagtgtgtatccatactcattagttgagaaaatattcccatgtttttttgcttaacccaaacgtattgtggtcgtttacatttcattgtttttctgtcttgctacagcgcaatttattataacttatatgtttatgcctacagaacatcaaatatctcatccatttatgtgctaacatgtgaggcaaatatccaactgtctctgaagctctacaaataaagacctaccggattccatgatcattatgacaaggttgtgtttgacacaacatggtactcgctctatagattaataatactggtccttttgaaaagaacacggtcttaaaaaacaattttaaccactattcttttattaaaatatatatagaaatatcaataaatctatgattattttgaaatgcattttaagacaaatgatttagatgttatttataattaaagtttttaaaatttgacaataatcttatccaaaacaatgagtattattagcttggggagagtacttcctatagcataagatttgactaactttgaatgttttatcattacagatgtatagtcatgtcgataaatgggagtacgtagtatttttttatgaaaaaaattcaaatgtaactatattttaattaaagtgtaattacatcgtaactctgttataattatactataactacattataactacattgtacattgtagagctacataaattttgataataaccttttagatagaaaacttttaaatgtaactatagtgtaattaaagtataattacattttaaatctactgtaattatactataattgtaacttatatatgtaagtaataagaaatcgtcaatagaaaacttgttcagatagctagttccatgcgcttgtaacgtcgcaccatttttttcccgctttcttgcgcgaatctcaatgcaatatggttcatgaaattatatgttttggaagaatgtcaatagttttttttagcaattccttttttttttctttctagttgtttagtccatcaagccaatttaaatactactccctctgtttcaggttataagacgttttgactgtttcaggttataagacgttttgactttggtcaaagtcaaactacttcaaatttgactaagtttatagataaaaatagtaatat

SEQ ID NO: 59566 - DNA, 18091 bp, Oryza sativa
cccccccccccccccccgcgtcgggcaccggccaggagcattttcaaaaaaaaaagcacggcaaataaagtttctatatatctctttatctcaatctaatctacatctctatctctatctttctctactactttcataaaaaaacatccgacttccgtaaaaaaaggaaaaaaaagaatcaccaataaaagaaaacgaaaaaaagtccgactccgtaaaaaggaaaaaaaattctcacgctcgactccgtaaataaagggaaaaaatgtctcatacgtaaaaaagaaaatttctgactcccgtacaaaaggggaaaaacacttgtctgtacaaaaaaaataacatccgatttctatggaaagtttttttaaaaaaagtatcatcagtaaagaaaaaaaaagtccgactcccgcggaaaagaaaaaaaatacttctcacgtccgactcccgtaaataaaggaaaaaagtctcatccgtaaaaaaaacaagtctgactcccaaaaaaaaaaggaagaaaaacgtcttgtcaaaaaaaagaaaaattgtccgacccaaaatcaagaaaaacgcagtttataaaaaaaaatcccgtttataaaagaaaccgttcgaaaaaaaccactcgactcaacaagagaaaaaacatagtttacaaaaaatgttttaaaagaatattcgactcaatgcgagataaaaaaaaccgctccaaaataaaccgtcagaaaaaaaaacattgtttttttaaaaaaaagatccaagaaaccatccgaattcatgcgagaaaaaaagatataaaaaattgtctgactccacgcgagaaaaagccgccatatatataaaaacccgcgtttataaaaaattctggttcagtactgtgttatgcgaaaaaactatatgatttcagaaaaaaaaaacatccgatttcatgaaaaatgattcgtattgtttgtatcatccatcgtctaccatgtcattttggtttttccaaagtgtcatcgaaagttcaggtatgcggatctaaaacaagtcttggtttttggtttttccaaagggtcatcgaaagttcaggtatgcggatctaaaacaagtcttggttatgcttggttttctcggaacgagatcaaattggtcgaggttttgggtcagatacgatcctcgatttttccatctcctacatggtttgtgttccgcgattatattctcatatattagagaccctgcatatttatatttatgtatgtaattatcatactactggacagtatagctaattcttgatagcttatcatataaaaacaacaataataaataaacaattgttactaagaaatagtgcagtgaggctctatttgtctagacttaccatatgagacaatgtaggatcttattgatccaattattaattgtaagaatgagattaaaagagtaatttagattatatgtgtacagcatacataaataatccacttcatttaggcaaaacatgcgttagaaaggttgtcatcgtcgagatcgggtcattatattgaagatgtttcaatttttcttataatatgtcttagctacaacgatcgatacgattattatcattgacacaattatgcgtggaaagcgtatattgtcatcgaaatgttttcacccgttgcaatgcacggcatttattttctagtatataccaaattagaaaataaggcttctggtagttttcttttttggtccatcttttttttcgcacgcgcgattttttcgtacgttttttgggcccggtttttcccgtccgattgttttttttcgcacgcgcttctaatagtttttttcgaccgtcgtcatttttttccacacgtggttttatttgtggggctggtttttcccatcgccacctgtccctttttttgtcagtccaattattttcctagtgggtggcaatttttttttgttgcggttttttttgggtgggcccaggtttttttccaccactgtttccgatcagttcttttgcgagcgcacgtggaaggactgaaagcccaaatagtcagatacaattacaattacatggctcaggaattacatacagagtccaagaataggaattacatggccaaggcccaagtaggataaaaaatcttctcaacctatatcgtactttggtacgtcatgagtcgatttttttaattttatgttatctttactacttaaatttctgttgtctgttaaaaaaaaaagtccgacccaaaaaggtaaaaaaataataaaaaaaaaggtccaactcaaaagcgataaaaaaaatctgtcgtcagtaaaaatctttatctatagtaaaaatctttatctttatctttatttttatctattataaaagtttaagatgtttttgtcaaataattttgtacgccgcccgctgttggcttgggtctcgagtttgtatcgcgttactccgtaactcatctgatcggttgatccacagcgcaatcggatttcgatttttttttcttccatcgtccgaacagctagcaagcccgcacaaacaatttcgttcacgtttcacccaagctttctttctttctttttttttttcgaggtcacccaagctttctgtctctattccaacctcccacatgcgccagcacgattgattaattaagcatgcaaccaaagaacgtgggagacaaaggcaaggtccagtattgttgtagccgaagtcctcgaggtagccaacgatgcatgcagccttggtatatatggcgctcacctgttgtcccttttcaccatgtccactctaacacacaatatggaacatatatatacaaggttggaaaacgtatgaattattacgacagtatgaattagtccactgaaccataaaaccagacatattaaacctcgaattattgataccggatgaattaccccccctgcccccccccgactcaattcaaagtggttttgatcctacgtggcattttggtacatcatctgtgtatgagtcgatttttaagttcgtttgtttttaaaatacatatccgtatttgagtcggttttaaatttgtttgttcgcttttggtaatacagaaggaatcatataagaaatttgttttaaaaaaaactcgcatgataacttgagacgaccagactcctaactgtagctcatgattttctaaaaatatatatatccaaatgatttttcacagtgagtttcatcttaactaaaccatataacaataataagtttaaaatagacttcactcgttgtaacgcacggatattttatctagtagaaaaaaaacatctcgtccgtcttaaaaaagaagaaaaaaagtctcgccagtaaaaaaccaaaaagaaagtccgtttggtttttaatttggcacgggtatttttttctgatctttttgcacacgaaagagtttttttttcgcacgcgcttaggctcttggttccgtccattttttaatctgatcgcgcctcctgtcaattcgttctgttcgccgcacgtcgcgccgctgccatatcgattgtgtgttttctactccaatttgattgcaaaaatcgattccccactcctccctcatcagttgctaatgatgacggcgatcttcccggttggttgtttttatctcgagctgattttggaaaaaaaaacagaaagaggagatcgagtggataaaaaccatcaaccaattttggtgatcgagaaagattcggatttaattgggaacaaagagttttacactctgattttggagaaaacgggaagagaagatcgactggataaaaaccatcgaccaattttaggtgatcgagaaagattcgaccatatttgatagggagatttgctccggcagctgtacgtccacgtggccacgggacagacaaccgtacggccacgggactatcttcgggaggttgaagatgatagtagactgtgcgagctacgcttatggctgtaggatcgagatgtcgactagaggggggtgaataggcgatttaaaattaaataacacctaatcaaaactaacctaagttgttaggcttggcgagggacaagtctaactaagcaactaagttatgttttgtaatcctagggtgaaagggtctcaagtatgtctctaggaatataaattgcacaaatgtaaatgcgacaaataaatgagacaagttgacaagagatttttcaccgaggttcggaaactcgccggtttcctactccccgttgaggcgagcccaactccaccgctcaaccatgaagacaccgcacgcccccttcgtcaaggggtgtatgcaattgaaatgagtgccaagagagaccccttgctgctggtgggggagtatttatactcccaccaaccaaaactatccgttgggggcgaaatcccccaattttgtgtactgctggtctgaccggaagtatgtggccggtcagaccgtgctactctgcaacggctagttttctagccattgtagccttgtcaaagggcccatcggcctggccggtcagaccgacgttgagtggccggtcagaccggcctcggctcggtcagaccgccctcagctcggtctgaccgtatacggctccgtcagctctgtatcggccaaccccgagcactccatcccggcctctagggggccggtcagaccgcccctggtcaagccgaacacagtgaatgcaagtgtgtgtgaaaagtattaaaacaaatgtgagcacaagtgaatatgaaaatgacctaatgtggcaatcaagatcatctctatgctaggtcattacccctcttaatagtacggagaagctaaaattaaactagcaaatttgatcgccctacacctcgatcaatttaaatataaagccctagtttaccatcttcttttccttcactttgcgccgtcaaattttaatccatcgataataatccatgcgcacatatgacgtggtactaacacaaaataattaactcaaagagaaacggttagtccacaattagcgcttgtcattaattatcaaaatcaatctccccctttttggtaattgatgacaaatacttcaactatataacatcaaacatgaaacacatggacattttgcaatgaaatgaaaatgatcccccgaaacatgtgcatatcaatcacaaatagcaaatatgaaacaaatgcactttcattcacatttcaacatagtacaaccacatatggaacatacaatgtgaacttcacatagggatcaaccaattgcataagatggtcataaatatatcaatgtcagatcaaccagccatcatagcacaagttcatccatagatcataaacatccaacttacaagagtttatccatatagggctcacaaataaacataggctattacaagaccacgaagggtccaaatgacatagagtttaacaaaacaaaaaaataacacacaagataaggtaatagcccatacccatacataattatagcccatccgccttaacctattagataggaggtagctaacctcactactcttagtcccatcccgcaaaataaaatgcaagcctagagttcttctcccccttttggcatcaaggacaaaaaaggcttcactcttgtggaggacaaggaggacgggtcgaagatgaagggcggggagcatcacagctgaagcatcttggcccccggtattaattttagtaattaatgataagcactaattgtggactaaccgttcctttgagctatatattttaagttaggttcacattatgtatgcgcatggatgtctatcgatggattaaaattgacggtgcaaagcaaaaggaagaggagtcggtaaactagtgttttcatttaaaattgatcgaggcgttgggcgatcaaaattgtgctagtttatttatagctttgtcgtactattaagaggggtaatgacctagcaaagagataattttaattgtcacattaggtcattatgcatctaggcttgtgctcacatttcacaacacacaccttttcactgagttcggcctgaccagggccggtctgaccgcttgctccaagccggtctgaccacaggtcagaggccagtctgaccagccacctagtggcggtctgaccggcgtaactggtcggtctgactggcggcacttgtgcggtcagaccgccccctggtggccgggatggtgttgctctggtttgggcgatacagagccgacggagccgtattcgatcagactgagctgagggtggtctgaccgagccgaggccggtctaaccggccactcaacgtcggtttgaccggccagggcaatggggcccaatgtcaggcctacaacggctagaaaactagccatagagtagcactgtctgaccggccatacacctcaggtcagaccggcagtgcactgagttgggggatgtcgcccccaacagctagttttggtgggtgggagtataaatactcttggcacccaattcaattgtatacaccccttgcacctctctcacacacatttgagcttagtgttcatccattgtagtggttgaggttgttatagccaagagtcaagtgcattgctttccacatttctcatgagaagcttaagaaagctcatgacaaccttctttccactactcaacatggagctcacattgatgttggcatatcttgtgatttgcttgatgatagtgcttcttgtcatattcctcatgttgcatcatctagcatttctacctcttgtgatgatcttatagatatgcctagctctaggtcttgtgtttctatttgtgatgtctcacttgttgttgagaacaatgagcttaaggagcaagtggccaagctcaacaagagtttggagagatgcttcaaggataagaacactcttgacaagattttgagtgaacaatggtgcatccttaacaaggagggacttggattcatttcaaagaagggtaagaaaccttctcaccatgccactcgttttgtcaagagcaatggtaagtattgctccaagtgtcgtgaggttgggcatttgatgaatgatggccccggtggtaagccttctaagacatgcatgtttgattctcattatatgtttaggaagactcatgatggtagtattgttgctagatatgtgggttcccctatacttggtggtaaaaagaatgccatttgggtgcccaaagctttggtctctaacctccaaggacccaaacaagtttgggtacctaaaagagtttgatcttcttttgtaggtgaactaccacaccggtgggagctattgggtgcttaatagtggatgcactcaacacatgactggtgatagggctatgttcaccacattggaagtaagagggaaagaacaagagaaagtgacatttggagacaatagcaacggaaaggtaattgggttaggtaaaattgctatttccaatgatttgtgaattgaaaatgtctctcttgttgaatatctaaatttcaatttgctttcggttgctcaaatttgtgatcttggctagtcatgtgctttcttcccccaagaggttattatttctagtcttcatgacaagtcttgtgtgttcaaaggtttttgatatggaaatctttatttggttgatttcaattctagtgaagcaaatttgaaaacttgtttagttgcaaaaacatcattgggttggctttggcataggaggctagcccatgttggcatgaatcaattgagcaaactttcaaaacgtgatctagttgtgggcttgaaagatgtgaagtttgagaaggataagctttgtagtgctagtcaagccggcaagcaagttgcatgctcttatcctactaagagtatcatgtccatatctagaccattggagctcttgcatatggatttgtttggcctaacaacctataagagcattggtggtaatagtcattgtcttgtgattgttgatgattattctcgttatatttgtgtgttctttttgcatgataagtctattgttgccgagcttttcaaaaagtttgcaaaaagggcccaaaatgaatttagttgcactcttgtgaaaattagaagtgacaatggttccgagtttaagaatgccaatatcgaggactattgtgatgatcatgtattaagcacgagctttccgctacctacttacctcgacaaaatggtgtagtggagaggaaaaatcgtacattgattgagatggcaaggactatgcttgttgaatatgatgtttctgattctttttggacggaagccataaacatcgcttgccatgcaaccaataggctttatttgcatcgtctcttgaaaaagacttcctatgagctaattgttgggaggaagtcaaatgttgcctattttcgagtttttggttgcaagtgttatatttaccgaaagggtgttagactaaccaaatttgaaagtcaatgtgatgaagggtttcttctaggttatggctcaaatagcaaggcataccgggtctacaacaagaacaaaggtattgtgtaagaaactaccgatgttcaatttgatgagactaatggctcccaagagggacacgagaatttggatgatgtaggtgatgaaggcttgatgagagctatgaagaacatgtctattggaaatgtcaagcctattgaagtggaagacaagccatccacctccactcaagatgagccatctacttccgctacgccaagtcaagctcaagttgaagtggaggaggagaaggcacaagatccacctatgccactaaggatacacaccgctctttccaaggatcatccaattgaccaagttttggatgacattagtaagggtgttcaaactcaatctcgtgtcgcttcaatttgtgaacattactcgtttgtttcttgtcttgagccaaaacaatgatagtgccataaagatagccaataacccggtccaacattctagaaccaagcatattgacattcaccatcacttcctaagagaccatgttgccaagtgtgacatagtcattagccacataagaaccgaggatcaactagccgacatctttaccaagcctcttgatgaaacctgcttttgcaaattgaggaatgagttaaatgtcatagatttctctaatgtcgcttgacattgtgcaccatggttgcctcttgttcatcttgtagatttgctcttatttgctcttatgctttggatttattgccatttggttcctctttgcgaaaatggagcatgtcacattaagagagagttttgcactcttgcatgtgctctacttccttttatgtgtgggcaaatcaactagaagtgctagtagtgctttcaaaatgcctaagtcaacataagtcaaaacttttgcaaaataaatataatttgaaaactatctcttggaaaatgtttcaaaaggttccctatatgttttccaagcctcacattgcaagaaaaatggtgtttgaatgaaaatgtcgttttggccctcttttgaataatttagattcttatttttggccaaaatgggatttatctccaaaatgagattgagagagaattttaaaaaagtttgaaaacaaagtttgtagagaagaagatttgaaatgtttttggtattcaaacctatttcaaaaacaaatatttcaaaagttgtttgaaaatcaaattggcccaaaaacccctatagaccataaaaggtcacctcctagcacttaagtgagtttagtcatcataattttcaaatattatagatggttagcaatatttaaactcacacatttcaaaaattgctctaaaaatcaaatttttattggattttattgtgtgggggttgccggcttgtgcaagggctgtacacagccggcagggacccgacggtctgaccggcgctatatgtgcggtctgaccgaccgggtggggcggtctgaccggccgcatagggctggtctgactggccaaggtgggcccagggatttattccccccttcttctccaacccgacccctactctctccttctcatctccattcttccccaactcgaaatttccttctctctcacctcccctcaaaccctaactcatccctccatcaaatcccctccgcttacaccgtaagtgattctcctccgcttcctctctctattccatgaattactttgcgtttttattgattttttttatccatggcatggaaccctaggtgaagcacgaggtgttcttctatttgcaccaatagagggtagtttcttggtgtgattcaactccttcaaccggtaaatcacactccctcttgtgcattacttcaaatcgatctatttcaatcttagggttaatggtagtttccccattgttccaatcttgatgaaacagttcctaccctttgttgctcttgttccaaccttgtgctgtattgttctagaaaattttagactcaaatttgtagttgtgaaaatttttggatgcttgaacttgtgggaggtggtctgcccggagccacaggccgtctgaccgtgggtcagccgccggtctgaccgacttgtgctctcggtctgaccggccgacacccgtcggtctgaccggccacctgtgggcggtctgaccggcctgatgccgtcggtctgaccgccctacaagctgcagtctgaccacccctccgcaggatataggcaaaattttcaccgcttccaaaattgcttctaaaattcttgctaatatcctatcctctttgctctttgtcatctatgcctccccacactcgccatggtcgtcatacgcccactctgaatcctgtgagtgagcatgaggagtcgagcggagaggaatatgcttaaagtgatgaagaagtcgaggaacatgttgagggggccagtgaggaggaaagtggagatgatgacagtggtagtggggaggatgaggaggaagaagatgatgagttgcaagttgatccctctattcagtttgtagtcaacatgagaaatcctgctcagtataccatattacggcataatgatcagttcttgagacctagagacaccacggatccccggttccacaccgcttttcagaagacagtgtatgagtagatttatgtggggaaagcttttgcggatcacaagtggatctcttggagggatatcaatgagaccccagaatttcaaagtttgcatgatctcttcaagatagttggcattgaccggattatgaccctcaagcaagattacaatgaagacttgatccgccaattctacgatacagtgtgggtggctggagatttcagtgagatgaagtggatgtctgacaccctccagtgctctatctctcggaggcagttccggaggcagctcaacattcactttgattttgaagatgatttgcatgaggagcacactcacaacccgctctccattgactatctctctcagttctctgaggatggagtgcggtacacccatgggaaggttgccggcttgaggactatccctggtgtggtaaacagaattgtgagagccaccatcctccctcgccttggcaacaatgatgacaatagggggtggcttggcacgtcattgatgctatcattcaaggtcgtcagtttgatgtggtgaatctcatgatgcaagaaattgctatctccaatggcacattcactcagggcatctactatgcgccatatatcatgagattgatactagacaagcttgggggtgccgggaacaatttgaagaagcacaagcagtacaagccctgccttcagcttggaactccccgtgctcctaggacgatgccctcttctcaccctggagctagctcaagcacggcacctcctcgtcctcatgggtttgtttatcctaatgctttctttaatcctcaatatgcttacttcgggttgcaaccaaatgagtgattcaacctggtacttggggctatcaatacccttagtgagagcattcaacgcttaaccatcgggcatgaagcgatgcatgaggatgttcgcggtttgcgaacggatgttggaaatttgaatgcatctgtgggaagattgcacactagggtgggtgtattggatttacgggtccaagtgttggatgcacactacggcgatggtacacaaaagcttgggtgctctccaacacttggatgtgaaaagtgcttttctaaatggtgaaattgtcgaactcgtctttgttgaacaacctcccggttttgaagatcctaaaaatcctaaccatgtttataaactttcaaaagctctttatggtttaaaacaagctcctaaggcttggtatgaaagattgagagattttcttttatcaaaggatttcaaaattggaaaagttgacaccacccttttcacaaaaatcattggtgatgatttctttattgaaaaggattctaatatatttaaagcattcctctactattggcttgtggtacccaaaaggtgttaagtttaagtttgttggctattccaattcggattatactggttgcaaagtggatagaaagagcacatccggtagttgccaaatgcttggtagatcccttgtgtcatggtcatccaagaaacaaaactccgtagccctctctaccgctgaggcggaatatgtttcggcgggtagttgttgtgcccaattgctttggatgaaacaaaccttgttagactatgacatatcctttaccaaaacctcactcctatgtgacaatgatagtgccataaagatagccaataacctggtccaacattctagaaccaagcatattgacattcgccatcacttcctaagagaccatgttgccaagtgtgacatagtcattagccacataagaaccgaggatcaactagccaacatctttaccaagcctcttgataaaacccgcttttgcaagttgaggaatgagttaaatgtcatagatttctctaatgtggcttgagatggtgcaccatggttgcttcttttgcattgtgtatatttgctcctatttgctcttatgctttagatttattgtcatttggttcttcattgcgaaaatagagcatatcacattacggggaggtttgcactcttgcatgtgcactacttccttttatatatgagcaaatcaactaaaagtgctagtagtgtttttaaaatgcccaagtcaacataagtcaaaacatttgcaagttaaatgtaatttgaaaactatctctgggaaaatgtttcaaaaggttccctatatgttttccaagcctcacattgcaagcaaaatgatttttgaatgaaaatgcctttttggccctcttttgaagaaactagattcttagttttggccaaaaagaaatttatccccaaattgagattgagaaggaatttgagaaaagtttcaaaacaaaattggtagagaggaggatttgaaatgtttttggtattcaaacctatttcaaaaaccaaatatttcaaaagttatttgaaaatcaaattcgcccaaaaacccctatagaccataaaaggtcacctcctagcagttatgtgagttttgttgcaaatcatcatagtcttcaaatattatggatggttagcaatatttaaactcatatattttaaaattgctccaaaaatcaaatttttattgaattttattgtgggggggttaccggcttatgcaagggctgtgcacagccggcagggggcctggcggtctgaccggtgctataagcgcggtttgaccggccaggtgcggcggtctgaccggccacatagggccggtctgaccggccggtaggtggtcccaggacttttgtcctttttcttctcccttcttcccctacccgactccatctcctcccattcagttttttccttccccaactcgaaaactctctctctctcacctcccctcaaaccctaactccttcctccaccaaatcccctcggtttgatcgcggatttctctccggttacaccgtaagtgattctcctctgcttcctctctctattccatggattgatttgtgtttttgttgagtttttgatccatggcatggaaccctaggtgaagcagttctttgatttacaccaaaagagggtagtttcttggtgtgattcatctcctccaaccggtaaatcactctccctcttatgcattctctcaaatcgatctatttcaacctctagggttaagggtagtttcctcttttgttccaatcttgatgaaataggtccaaccctttgatattcatgttccaatcttgtgcaatattgctctagcaattttttagactcatttgtgtaattgtgaaattgttgtggatgcttaggccaatgtcagtagtggtctaactggagccaaccgacggtctgatcgcggccttgccgtcggtctaatcggccgatgcgcgcggtccgaccgccgcatgcacgtggtctgaccggacgttggccgttagtctgaccggcaggtgtaggcggtctgacgggactgatgccgtcagtctgaccggcctgcagtctacggtattggatgtgagcacaatttcacttcaatcaagtggcttctaaaattcttgtaatatcctttcatcctttgctctttgacagtgatgcctccccgcactcgccatggtcgtcgtgcgcccactccggatcccgtgagtgagcctgaggagtaaagcggagaggattatgctcaaagtgatgaagaggttgaggcaaatgttgaggggactagtgaggaggcaagtggagatgatgtcagtggtagtggggaggatgaggatgaagaaagtgatgatatgcacattaatccctccagtttgtggtgaacatgaggaatccagcgcagtataccatcttgaggcatcatgatcagttcttaaggcctcgggacatcccggatccccagtttcacaccgctttccagaagactgtttatgagcaggtttatgcagggaaagcatttgcagagcataagtggatttcttggagagacatcaatgagactccagagtttgagagcttgtatgatctcttcaagactgttggcattgaccggattgtgaccctcaagcaacactacaatgaagatttgatccggcagttctatgctacagtgtgggtggctggagactatagtgagatgaagtggatgtctgacaccctctagtgttctatctctcggaggcagtttcgacggctcctcaatattcgcttagattttggagatgatttgcatgaggagcacacttacaatccgctctccatagactatctctctcagttctatgaagatggagtgcggtacacacatgggaaggttgccggcttgaggactatccccagtgtggttaatagtattgtgagagctactatcctccctcgccttggcaacaatgatgacattaggggggtggcttggcacgtcatcgatgcaatcattcagggacgtcagttcgacattgtgtctctcatgatgcaagatattgctatcaccaaggggacattcactcagggaatctattatgccccttacatcatgaggttgattcaagacaagcttggggctgctgggtaaaatttgaagaagcaagcagtaaaagccccaccttcagcatggagctccccgtgctcctaggacggtgccttcttctcaccctggagctagctaaagctcagcacctcctcctcctcatgggtatgatccaaatgctttcttccatccacaatatgcttactttgaaatgcaacccaatgaatacttctacccggtacttggggctattaataccctaagtgaaagcattcaacgcttgtctaccgggcataaagcattgcatgaggatgttcgtggcttgtgcaccgatgttggagacttgaatgcttccgtgggaagattgcacactagagtgggtgcattggattctcgagtccaaatgttggagagcacccaagcttttgtatatcatcgccgccgtgatgctcctcatccttcatcttcggcacgtccttcttctcctccacaagaatgaagacatttttggtacttgatgctaaaagggggagaaaactgtccttaggtgtgctttatgtcttgtgggttgggactagtggtagtgaggttagtcacctcaaatctaataggttaagttgctttgggctatattttgtatgggtctgggctattactctatattgtgtgttctttatcgttttgttgaactctatgtcatttggtctattcgtggtcttgttagcctatgtttgtttgtgagcccttttaggatgatttgtgacttatgtgatttggatggttaagtgatgtgaacttgtgcgatgatggatggtgtatgtgatattgatatatgtgaccatcttatgcttatggatgaatatttcttgaagttcacattgaaatattggttatgtgtttgtgcttgttgaaatgtgaaattaaaatgtgcattggctccatttttgttgtctatgattgatatgcacatgtttagggggagcttttgatttcctttgcaatatatgtccatatgttccatgtttgtttatatatgtttgagtgtttgtcatcaattaccaaaaagggggagattgaagcatcaaggcccccttgttaattttgttaatgacaagcgctaattgtggactaaccgttgctattgagatatattttaagttaggtccacgtcttgtgtgcgcatggatgactatcgatggattaaaatttgatggcgcgaagcgaagaaaagaaaacgttaaaactagtgctttagttttaaaattgatcgaggtgacgggcgatcaaatttgctagttttttttagtttcgccgtactatcaagggggtaatgacctagcaatggagattaattgccacattagatcattatgcatttagacttgtgctcacatttcatctcacacacacaatcaccttgtatttcacttgttcggcctgaccaggggcggtcagaccgaccacatagtggcggtctgactggcgtgccctggccggtctggccggccacaagacggcggtctgaacggcgcataaggccggtctgaccggccctctagtggccgagatggtgctgctcggggtggccgatacagagccgacggagctgtattcggtcagaccgagctgatggcggtctgaccgagccgaggccggtctgaccggccactcaacgtcggtctgaccggccaagctgatggggccctctgacagggctacaacggctagttttctagccgttgcagagtagcacggtctgaccgtccacatacctccggtcggaccggcagagcacagagttgggggatttcgcccccaacggctagttttggttggtaggagtataaatactccccctccagcagcaaggggtctctcttggctcctaattcaattgcatacaccccttgctctcacacacctttgagcttagtgttcatccattgtactggttgaggttgttctagccaagagtcaagtgcatttgcttccattgtagagctagtgtagcacttgattgatcatctctacgccgcgtcattgctttttactcttagagggtgccgcctcctagaaggcttgtggaggagttgcccggtgacctctccgagaagattgtggaggaggcccggtgccggtttgtgagtggtttggagttcaccaccttcggagtgaaggaaaaactaccccgagtgatcgaggtttgggtagtcctctccgggggccggttccgccttgcccaccccttaacgaagggggcgtgcggtggcttcgtggttgagcggtggagttgggctcgcctcaacagggagtaggaaaccgccgagtttccaaacctcggtgaaaaatctcttgtcttcttgtttcatttgattgtcacatttacatttatgcaatttacattcctagagacatacttgagatcatatcaccctaggattactaaacattgacataggagtatgatttaatttcctagagatataattgagccactcaccctaggtttgcaaaacataacttagttgcttagttagactccctcaccaagcctagcaacttaggttagttttgattaggtgtcatttattttttaaatcgcctattcacctccccctctagtcgacatct

SEQ ID NO: 59567 - DNA, 37337 bp, Oryza sativa
  unsure (1)..(37337): unsure at all n locations
catcctgttcgtcagattatcccatgcacaacatgagtatctatctatctatctatatctatatctctatatcttctatactaattgggcactttctatgaactctcatattaatcaggcagatctaaccgttaattaagtagatcagataatcttaaccatagattattaatatctacttaacgtcacggcctcatgggccacgcaaagcccatccaatttttcactaatgtatgtacacaacatatctgccatacgtacttaatataatttttttaaaaaaattgttgccacaataaatgtatgtatttgtacgaattaactactttgccggattcgatagattaattcgaagaaaattttaagaactatatattatatctttactttcttgttcactcacgcttcaattagtttgaatcccataaggtttaatttttttacttatccatgagaattgaaacatctttctaagtgaagaaagtacgtatgcacatattatacttagtacaaacagatagcctacacataagtgaaaacacattcatatctagcagaaacccataaagttaatataacaaacttgtcaaaaatattatcttatattatttgacaatcagaaatatatctatctatctatacctatactaattgggcactctaaagaagctcccacgttaattagaaacatcccactgttgatttgatagatcgaattatcctaactatagattataataaattttaataagcattaattaacgttatgggccttctttaaagcccatcaaacaaccaatactttaatgacctttccaatatctgtctttatctcaacgcctcttcgtttttttgttttgtccacactgcaacgtcgtacaacatgggagaacacaagaatatcgatggagaacatggcatcgatcaaatacgagagatttctcagcacttgcgcacattgatcaggcacgcaacaagtcatcccggctccatgcatggtggcagcgcaatactatcaaacctagctaggtaatatgcagcttatacgtatacagcagattgcacgcaggaggcagtggtctgcgcttgcgatatgcttaacacatttattgtatcagctagcaatcagtcaatcatatgcatgtgtaagttttagacgcttccacagcaacagcaacagttctctttgtacctatcaaatacaagtctctcatatggttaattggataatttccctttatatatatgtatataccatatttttcattcttgttttgatgaattgttatttgttgtccaaccggtttgatttttctcctcaagcttttaaaagtacatggttcgagtatcctattatattgatgctgttgctgtcatgtcatgttttttcaccaatatcaagaaagccctaacttccacttcccgtatatttcattttatgtgagtatgtgatgggaaaaaaatcaacaaacaagtagactttaacttccccgcatgcatacaaaacgagtgttaactatacaaaattcctgcatgcatttatatgcagactcaatttgcattcataaaataatgctacatgtcagacgaggcttacatgatgatcaatttgaaaattcagatttttagttatatggtaaccaatatggagcggtgggagtaatttgtaactagattttggaagtattacttagctaccctcgataatttccatgtatatatgaatataccgtatttttcattttcttttgatagtttgtgtgtatttaacttggtccaagtagtttgatttcgtcctcaaaatttatattttaaaatcgtattctttaaaaaaaatcaatttgattgtttctttatacatgtttctcatctgaaacaagattgaccaggatttaaacacaccgtcaactgactcgataaaaacaacttcattgcaatttaaaaatggtgtacttcactattcatgaacttaaatatcatggtcctaatacaattttaagatctgcattatgaacttaaatattgtggtaaataatttattatttaatatcttaattgaattaattagttttttcattaattacacaatcagttgaaagacccagtgttctagttgcagtcatgataaataatttgtgttcaaaaacatgtataattgaattcaattaatatatatatatgtagttatatattttaatttaattttgacttccagaaacatatataataaaatatacaacgacttatacatgtaacttactttcaaacataatgtagtaaccaaaatattcaactaataacacaaatttagtatggtaaattaacaaaactagcccgtgcaacgcatgggatggcgactaataatactaaattactagggatactactaggtagctcatccgtagaaagtgcttgggcggttgggccccttagcccccattctttgtccaccactgcttctcctcgctgctctgcttttactctgagtcagttacaccatcttgatcaacagcttccacgttgcctttcccatcttcatcttcaaatgttaacacatggtttttatttttcagttgttcttatgctgagactttcgctataatttttaaataagatagtattataaaatttaataagtttatgatgtcgtgacagtagtttcaaatataaatctaaatataccatttataattttaaaacatatatttttaatttattgatagtttttttacaactaaacttattgatagtaaaagtttcaaaagtttgataaagagagtcaaacatctttttttttaccctttttctttcctcgagcaatagtcccacatgtcaattcctattttgttctaaatagccataggttaaacctttaacctatatatgttgcaatcgtttatagtactgtttatatcaacttgtaattagccatggtaaagccttacccaaacagttttctttttctcaacaccacctgaatttctgtggtatttctatggtgaacatatatagactgaattaactgggtgagcaacagaagtgaatccatcttctcaaaacgtaaggatggatagcaacaagctagatgggcattgaaaggagagaaaagaagctgtgctaactcatcttgcatttcctatcaccatccttcccattttccagcaaatacatcatttacagtgtgtgtgcaggacaatgaaacccgctactgctaggggggactcaggctgctgtctccttcacacggctagctgtatggttctcaccaaatgttcgacaagagttcacgactggagaaactatcattcgtgggtcggctaaaaatcacaatagtcttggttactcaaaaaaccgagactaaaaatcatttttagtttcggtttaaaagtgcaacggaaatatatgatctttagtcccggttggtgttaccagccaggacccgtttatttttttgtcagggtgtgtcaggtcccccaatatctttaactaaatatattcactttagtcccggtttgtttaaacaactgggatagaaaaaagagccaagctacagagtcatccttctctcccccttcccttatccttattttcttctcccctcctccttcccctcccctctccttatactctcctccccttcacagggcgctgcagctgctctggcggccccttgcggtcgtggtggaggggcgtggcagcgggggagcggcatggtggggcggcagaggagctgcacgcacgcacggctgctctggcggccccttgtagcagcggcggaggggcgtggcggcagcgtgggagaggcatggcggtgcggtggaggggcgtggcggcgcggcggcggaggggatcgtccagggcgcggtcgtcgccgtattttggggattttttttttgagattttgtgatgtaaatttttggagattttgtcatgtaaatttttggagattttgtgatgttaatctgtcatgttgttgcattccatccgtttgcattcgatttgtgattgatggaaaaaagcaatgaaaaaaaacacatgcaagcaactaaaaacaatcgaaaagaaaaaaaaactttagtcccggttggttattttaacctttagtcccggttatttcaaccgcaatccagtagtaaagagggttgcaaaccgggacagaagaacgtttctccaatagtggttggatcatgcactgtctagaaacttagatgtttggtgtcgctccgagctcgcctcacttgttttttcaatgcctatcattctcaaatctcaactctgaatgatacctctcactcttacggtgctccgatgcttgcacaattactcgattaatcctgttccatccccatcgttttccgatgtttcttgtttcccttttataagacaaccataaatcatctggtagtggagagtttgatggatgtgtgcctttccagttgtatggagttattgttcagttatcttgttaggtcccatgttcaatgagagtgtaaaccttggcatttatgcacatcagggaagtgttgttcaaatgagaaatatgaaaaaaaaatgttattttcagaaagaaaaaaaatggcttaatcttcacaaacatcgaaatgcaaaatatagctaactcactgctgtcgaattgactgactagtttttggtaaacattgttaatattattttttagactgtaagaaatctcctataggcgtacttgtactctgcttctgtgaaaattactaaattgggaaattcttattactattattgaaggaccaatttagttaattactcatgtggaacggttgtggctcacagtgtgtcagtaaaatccacatgtcagtgccatagttttggaaataagtacttctacatctgaatgtttgattattctttttaccgttttgaagataaaatcatatttgctttagtgggaaatttcatcatatatcctttgttttgatcgaaaattgcgtgattaccatctcatggcaatgacatgtgggaccatgtaaggtcactagcatgcatctcccacgatggtaaatctaaatttcaatatataaagagagaagatgatcacattttactttttttaatataactaggaaggtggcccgcacgatgcgcgggcatttatattgttgaaagataagattatagtttatttagaaattgtctcataggtaataaacttgggatcgaacaatatccttttaaaatgattcaggggttctattttcttaatgtaactcaaaaaacattcagactcttgaatacaagatggattaagttagtacaactttactaccgctagcttaattatcaaccatatcacttgtatacataccatgcaaatatgggtacaagcgaaaattgcaaaatcaaggaactcaaaatggatcatcctatgaaggcatataacgaacaaattaatggtaaattaaaacttggatttcccccctgtatataagttcaacaatttcatattttctccatagttttgaagaactttaaaaggttttggtgcatacaaatcacctacaccatcgctttgcttggtattgcaaaatatcaacattgtttgaagctaatttctttagtttttgcaagtttcattattttcttgaaacaataattgtttaaaataagactataattatataaatttaattagtatgggtagtttacttataaattttgaagtgttttgaagtaaagtttttctatcatgtagtctggttatatcaataatatagttttgttcaataaattcaatattatttacatcaccagaattaataaaaatttatgaaaccatccatgactacttaaaattttggtttgtctgatttgtttatttcaaatttagataatcacatattctccttctaatcggtgtgtttgtcattattcataataaaaaaaaacactccttgtacagctgacacatcatattgtcactcaatcacatacaaacgtaaaatatttgtcattattctcggaccgctcattcctcattggtatcttccactcatccatcatcttataatagaagtatacaccatattttgtctaactatttagtttacataagggacaacaccacgctcctcctccctcatgcatgggacacagtgtccaattttttttccaaagcaagtttttaattaacacatgtaattagaatattacatgtgtaatatatgtgtatgtgacacatggtaatttttattctagcttcgccctgcttatatactgtatagagagattaattatattcaacctgcagtgcttgattcttcttctttctacattgcatcttcgcgatttgttttcatgttattaaaaaaaccaatcgttgcccattgatgatttgacacgttttcattttagcgaagcaatagcgctataacatcatgatcaccttagctaccttaggtatacgatgcttcgtcatgcgtgtaaaaggtaaagacgtcaatgtgttgtatagagagacaaagaggacttccgaggctagatctcatggtctaaataatatgtccaccggtttaactaaaaatcgataaacaaatatttttattaggaaatagtctaaaataattggtacataatatcatataatggtgttaactctatttttaaatattgtagatctaatttatttacatctaattgtaaagagttatatgttgacattcaatgttagtaaagcaactattatgtaaagtttattatcatgaataataataattatagtggctcaactaaatacatggaaaaatggaaagggaaaaagaggaaggtcctcctgagtggaaggaaaggagggtacgtagggagagaagaggtggaatcgtagtttaatctaacggcttataatattggacccaccaatttatgtggaaattaagggatatatgttttgttttttttctcaaattttgtagcatttggtaacttgagagcgttttgaggaactttaatggacatacgttgtatcgtttggttgagacacttatataaggacaatattaaccggagaacatccagcacgttttgtccctaaattgttttcgtcagttttgctttttataattttgtaacataatagttatctttatactatattgtatttatgtaatacatagaagcaattatttataatgttattcatcaactgtaaagaatggtaggcttattttctttaaaaaagcatgcatactaaattaagtgttaaatgaaaattaagactttttaattggatataggttattgttttctattaatggatgaattgggtggacatgaaagtccactaaatgcattggttatatagtctaatatgatttggtgtagttcgagatgcggcccaggaatccaagaattgagaatttttttacagtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacatacctcataactgttgatcttcgttctttctgccccataatgttttcttgtctgtaaactcaaagtagtagtccgagaaacattcatttttgctttgacctattttattattgtatcgtgataaaaaaagattttgagatatctttcggtaccagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagataataatcttgcctgcttgatcgatttaaaatttgctaatctactgaccggtgtatatatgtatatgtagagataatgtgatattaagttgaccggtgtatatatgtatatgtagagataatgtgatattaagttgacgtaggatagctaatcttgccagcttcattgattcaaagtaggaaactaatcttgagataaatacgctccatgttatgatcatggcaaaagcgcacgtgtgggtcctcaacttctaggcgcgggttcacgttgtgcccatgtggcatattgagagcgttttgaggaagccacatggcagttcgagaacgtttgtagaaagtttaatggatttttaatatataatagataggttataaagtctaataagtttataagacaataacaatacttttcactattgcaaaaatacgcacatataccattttatatgattaaaccaagtatttaaaatttatcgtagttgtaatcgtttcagaaaacagcaaaatgtcataaaatttgaccggagggagactttttttttttggacttaagcaaaggacccatgtgtcagtgtctaattttaatttgttctaacaaatgtgagcctactctttcttctccattccactggtcagaatttgttttctacagcatgtctgcatttgtatatagaatctgaatttacagagttagcatcacaagtgaatacatttcttgaaatgttcgggtagcagcggagtctagaccttgtttagatggtactaaaacttttaagtccctatcatatcggatatttggacactaattataaatattaaacgtagactattaataaaacccatccataatcttggactaattcgtgagacgaatctattgagcctaattaatctatgattagcctatgtgatgctacagcaaacattctctaattatggattaattaggcttaaaatatttgtctcgcgaattagttttcatttatgtaattagttttgtaagtagtctatatctaatactctaaattagtgtctaaatatagggactaaagttaagtccctggatccaagcaccaccttataccctttgaaaactccaagcgtttttcaaactaatgactcaatccgaaatcaaagtgcaacataactttttttcttcgcttataccactcggccgccttgttcaccaaatacatcatctagaatatttgcaggtcaaagcacctactgcagctatgcttgtggcagaccgtgtgattcttatgccggtgtcttcatccatcttcgatcagtgtggcgtctactgcttctgacttgcttcctggatacctctcattcccttgacccacatttatacctctcattctcatttttgtacacagccacacctctcattctcatagcactctgatttctttaaactatgccctctgcatcaactatagacgcacacaacaatttaatttgtgggaactctgatccatgcttgcacaacacacctagattgatctttgtttcatactcatcgtgtagtcttttcacttcctttttatacactcgggatgaaggctgtgtttagtttctaaaattgggttcaagtttgagaaaagttggtagtttgaaaaaaaagttgggagtttatgtgtgtaggaaagttttggatgtgatgtgatgtgatgaaaagttgaaaattggggggaagtttggtgtgaactaaacatggcccaattgtcaggctgtgtttttagtgtggagttattgttcagtaatcatgttaggcacattggccccttgatgaatggatcgagtgtaaacctttgcatttatttatgaacaaatgagcaacctttttttttttgttttttcagatgacaacgcttgcaaaaattttgttcatttttaaattgtcgcgtgacctctagaaacatcaaaacgggaaactgaagaccaacattccattggccaatgccaacagcaagagcacgtcgtcatgtgctctgcaggtgtcttcctcttccacctctctgatggtttttcttgtacaaaatttagttggacttgtttcataaatcattgtttgtgtccatgaacagacaaggaaacgataaataatccaaatgtgttcttttatgtttatttattattgagccctttcatgttgctccacttacttccatatggggtaagagctcaaagaaatcccaaccgttgattattgataattgttttgttaaataaaaacatatgagatcatttcattaatgatgtaattccggaaagggaagtaacggtagatatattatacttccaaatttaattatacatgttaattctaccatatatgcaacatcatctgttaaaaaaaataggacccttcttgtcaaaaaaaagtgagagagttttgactaaattcaaagtaatttcaaaatagtttttgaacatgaaaataattattgtatttggagtctctaaatgtcatatgtgaaaaaaaaaatataacttaaaatttcaaaattatttttctaaattcaaatacaaaccgcagcaagaaatagaaatagcatttgactatcacagttttcattcaaaatttgaacttttaagcagttttaattatggtattactgatgaatcttctaaatacaaggaaacattgccctcttctttaaatgctaattagtaacaacttaccacctaagaggtaagaagaatattaacccttggatcctaacataatgcattgatggtccagaaagttttggagtacggtaaaaaaatcctaatttatttattttgttcatgtacaacaaaaaaaaagagaggatacaaacttcattgttgttcaccaaaaatttgaaaatgtgcatgtatttctccatcttatatctttgcaagttcatttctcttcaagttccatccaaatagtcgaaaagtgcttaaccttccatatcaggcaaccaaatgaatcaactaacgtgaattcaggataggtctaatgttaggatccttgtggaactcgtccatttggattcaagtcttaaaatctagaatgggtgcatgtattttcgttgaatttaatccaagtaggtaatacatacatgcatgcacatgtgggtatgtctatgtggtaaagttattatccaaagctatgttaggctatgccttcaatctttgttgagatatgtggtaccatgcactgacggaatgtgtgcgagtctgaattatagtaaaaaaaaaaagaaatcaagtagatggatataatgtactcgcttggcactgcaatcatttgtattgttgcttaagttaaccgagtgagaaatcacaagtgcatccatcttctcaaaactttaggatagcaaaaagctgtgcattgaaaagaaagaataagctgtaaaaactcattttgtgtttcccatcaccgtcaatcccagtttccagtaaatacacgatccacaagggttgcaggtcaaagcaaccacttctgctgtgtgaggtactgaggcaggcagtctccttcactatctgtctagctatcgccaaatgttcgtcgtgagtcgcagggacaaccccaggtcctgggcagcatcggccacggcctgatcatggggcgaaaggccaatttaactttttatccaacgtttaaccattcatcttatttaaaaaaatttatgtaattactatttattttattatgacttgattcgtaatcaaatattctttaatcataacataaatattttcatatttgcatgaaaattttgaataaaatgaatggtcaaacgttggtcgaaaagtcaacgacgtcatacatttaaatatggagggagtactatttttcaccatgtaaatccgtgttgctccaaaacttccatgggcggccccggctatatatggtccaattcctggtccgcccctcactggtctggtgggttagatcatctataattttgaaacttgttgatttttgagtttctctcacttgtttttccgacgcctcacatcctcagatcttaacggaataccctctcgctgtcatggcattctgatgcttgcactactccttgatcaatcatgtctcattcccatcatcgtccagtctttcttgtttcccttttatagatcaggatgaatcgtctggcagtggagacttcgatgggtttgtgtttacagtactatggagttattgtccagttatcgtgttaggtctcctgttcaattaattcaatgtgaatcttggcatttatgcacatcaggaaaccagtgttcaaacgataaatatgaattttttgttattttgaaatgaattatggtgttctttctgcccaacaacagaacagagtcttacaaagtaaccaaaaaggaaaggaacaccaacatattttcatacagctgctgggtatgccagctttcaaaaatgcataacacctctaagtttctgaactagtttgttcatagaacccctcctgacaaaaacttcagatgtccatcggcaaaacatcagacgaaatatggcttaatcttcacagacatcaaaatgggaaatgtagctaactcgctgccatcaaatcgactgactagctagcttgtaaacattgtttatatttggtttttgagtaaagtccatcaccggtccctaaacttgtaccgctgtgtcatcccggtccctaaactcataaatggaccattcaggtcctcaaacttgttcgactgtgtcatcccagtccctaaacttacagatcactcgtttaggtcctccaacttgttcagttgtgtcaccccggtccctaagcagaacggtctaaaaactttatataaaaaataattcataactttttcatgtgaaccctaatgaagacaaactttatatcaaaattatagcccttgacgtgacctacaactttgtagttgataagtttttgaattaaaactgtttagggtcccaaaatattgttgcatgtttatagattttgaaattttaattttaaaattacattttgggacaaaaaatgacttgaaataaaaaaaatcaactataaagttgtagatcgtgtcgagggctacaagtttgatataaagtttgtctttattagagttcacatgaaaaagttatgaattatttttaaatataaagtctttagaccgtcctatttgacccagatgatattcaaatctaagtttagggaccgaggtgacacaactgaacaagttggagaatctaaatgagtgatctgcaattttagggaccgggatgacatagttgaacaagtttgaggacctgaacggtcgatttgcgagtttagggaccgctatgacacagcggtacaagtttagggacaggtgatggtctttactcttgtataaactattcgttttatatgggccattctttttccaacatagtacgatagaactatttggttttctataatttttttcccaaaaagtgtgcaatcaaattggtccggtctttttcgggtggtgaggtgtgaggaaaacaactgcacttttatagaagtagataaattgatattaccatcctcagacatgtaagtgacttcaaattacccccacatgcttttgaaatagatattgaaaatccttaatttttggtcaaattaatggtacttgatcaaatttcccaacaaacaatgattttaccttcaaaaccgaaaaattcagttttaaaggctttggctaactgaaaattttgttaatactcataactgaaatttttgttaatactcataacttcgaaaccgaaaaactcagttttaatggatattaatttgttctgttcttccaaaatttaccctctttttttatattcaaaaactgaaattgagcacagacattccacatgactaattaaccaatctggtccttcaacactaacatgaatttccctagaatttagttatttccacagaagcacgtacgcatgtgggagatttcttactgactaaaacataatgtaaacactgttttagtcagttgattcgacaacagcgagttatctatttttcccattttgatgtttgtgaagattaagccgtaatttatcccaaaacaacaaatttttcatacttttcatgcgaacaccgttttcctgacgtgcataaataccaaggtccacattcagttcattcaacatgggacctaacacgataactgagcaacagctccatactacagtaaacatacaaccatcaaactctcccctaccacactattgaccttggtcctatgaaaggaaatcatgaaagattggacaactatgggggtgaaacatgattaatcgagtaattgtgcaagcatcatagtaccataagagtgagattgggggtattcagttaagatctgagaatgagaggcatcgagaaaataagtgagaggaactccaagccaaagagatcgagaaaatgtctagattaaagatgctctatctgatgatggacatttggtgagagctagacaacaattaatgtgattgaatcctgcctcacacttagcagcagtggttgctccgacctgcacgcacggtagctcttgcatttacccaaaaatggtacagcttcttttctctccttttgatgtgcaacttgtttaattatcttaacgttttgagaagatggatctatttgtgatgctcacctggttaattcggcctacatatgttcaccatataaatgccacacaaaattcagctggaacagataagaaaatactgtctggagaaggcttaatccatggttacaagttataaacagtaatacaaatgattgcaccatataaattatttttttctgaggagagaacatacatatttaaattaaatcatgttttcatatgtagatttttatttgaaactttcatttgaacaaatcttttttaactcaacagtaaaaatatgtatatactcaattttttaatctatcagagtactttgaaaaaaaataaatctgtattcagtgatgtggaaatttatcttacacgtgatgagcctgctttgttagatgcgccgagtcataacaatacccaatttcagagaaatttagtttattaaattaagtgtaactgaatatttttgttaaatatttttcaaaaactagtttatttcaataaaataaatcatgcacagccatttcacgcgactaattagccaaatttccatgcattgtcatgtacagactgctgagcactaagttataataattgtaaggccatatgggatacatatatctacaggggtgttaacatgtgtcatataacccaacctaaaatagttatgcagttgcagaaaaccatgctatatatatctaagttcggagttgctagaaatatggcgccatatgctacagtcgattttttttcagccacttacacaatagttatacctcatttacaccccacttacatatataattggtatgtaattttcgaatttacatatgtaattttagtacttacatatataattttgtgacttacattgtaaatacactaaaattacatatgtaatttagggacttacagtgtaaataaataccgactattttttgatgaaaaatatggcgccatatatatagctacacccatcaagttttagataatccgatttacaattacagtaaactaagaaaaatataactgagattggtgctactcatattatcatatattgtagatcaaacgactagtaaatctgaaatctatttgcgcgaaaaacacaccccctgccaaactttccactgcccgagtattcatccagtagtatataaaagcgaagcaagaaaggtcagacaatgaggatggaacaagtattcatcgatttgagtccaattcgttacagattctagagtatggtattgacatgtggatcaaacatacacatgatgaacccactttgtacgttaattatatgatagcctggctattaaccgagtcccaaattttttggaaaaaaaaacagtttttgacgtttgggactgacagaaaactttggttgctatcatagttcagtagcattacggccggtcctgacattttggaggccctaggcagacttgacgctatgggtcttagagttagcccttaaggagttatatctaattttttttacttctaatacatacagtatactctataaagcacatataccatagagtgacacaaataaacatttttaacacggtaaataataaatcaagcagtttgcaagttgcgatagagcaatttaatctttaataaataatatcaatagtataattgacaactaaaaataccatagaaacaaattagtatgaacaccttaataggagaccacaaatatcccatgtcccttataaaaaagagctttttcgcgaccttatgagttatgtatagcacccaacaaatgtttctaggtaacattgtaacacctgaagcagtgaaattgcaaagtaaattgataaaggcatagctgcatagagcttgtcgattgacttctaggtctgtgacctaccttcagcctgaagaagggggcgaatgggaaatggccgatgagccgatgacaatcacagatcacgcgggtagggcagggaccagccaccatccaggcaagccggcaagaagcgtcgacagcgataccgccttggtggcttggccgatgggccacggcgatcaggcgctataggctagtggggccgatgcggtctttgcactcacggcggcctctcgcggactagggcatcggcgagacggcgacgaagcgacgcggctcggcctgggcctgcactgcagttctcgtggtgtagggccggtgggcaggncggcaggcgaagtgacgcgcacgcgcacgcgcactgctccctggctgatcgctgattcgctgagcagttgagggcggcctgaggcgcgcgtctggggctctgggctgtggctaggcctgttggccgggctggggtgggaggggataagtgatgggtcccctctggcctgggccctaggcggtcgcacaacccgcctaggcccagggccggccctgagtagcatatgtagttaatttacatgatgagactcgctttgttggatgacctaggtagtaatcgagacataattgtagaaaaacttagttctaaaatttgggcaaacaaataatcttgttgcatttttcaaaagtaagctcaagtcaaaaacctcgtaacagtgctcaagggggttatttgtccgatttgcgtagttgggggtgagggtgaaggatgtctggttttgtggtccaggggataattcaatcgaccgtgatagttcggagggtaatttgtactttttctatttaaaaatgaacaaaatttccgcaagctttgtcatcaaaaaaacaaaagaaaaaggtttctcatttgtgcgtaaataaatgcaaaggtttacactcaatccattcagcaaggggccaaagtgcctaacatgattactgaacaataactccacactgaaaaacacagccaccaaactttccactgcctgacaattcatcctggtgtataaaaaggaagtgtaaaaattacacgatgagtatgaaacaaagaccaatctaggtgtgttgtgcaagcatggatcagagttcccacaaactaaattgttgtgtgcgtctatagttgatgcagagggcatagttaaaagaaatcagagtgctatgagaatgagaggtataaacatgggtcatgagaatgagaggtatccaggaagcaggtcagaagcactagacgccacactgatcgaagatgattgaagacattgccatgacaaacacatgatctgcctcaagcatagctgtagtaggtgctttgacctacaaatattgtagatgatgtatttggtgaacaagtcatccgagtggtataaacgaagaaaaagaattatgatgcacgttgatctaggatctcactgtcttttcttgcatagcagaaatcaggtcattaatttgaaaaacgcaggagacatacttcctttttgacaaatattacccactcttggagttttcacaagagtacaaactcggctgctacccaagcatttcaggaaatgtattcacttgtgatgctaactctgccaattcagattatatatgcaaaagcagagatgctatagaaaactaattctgaccagtcgaatggagaggagaaagagtacgctcagatatattagaattaaggtttaacatattgatttttagaacaaattaaaatttgagaataacatgtgggtcaattgcttaagtccaacaaaaattctccctcctgtcttttgtcaaacgattacgactgcaataaattttaaatacttggtttagtcatagaaaatggtatacatgcgcacttttgccatcgtaaacgatactcttctagtcttataaacttattagactttataaatctgttataataaaatgtgatcatcttcccactttttagattaaaatttagatttaccattgtgggagatgcatgccagtgaccataattgaccctacaaatcattaacatgagatagtaatcgtcaattttctatcaaaacaaaggatatatgatcaaatttcccactaaaacaagtatggttttatatgattattcatttttactgttttgaagataaagcctgtcggaggatgaactcctccatcagagaaccgtgaggcccccctttgtgagttcggccgggggcagcgggtgagattcgagggcttggtgagcgaagctgtgtgatcttgagggcgttcaatcccccaaagacgatgagacaaaagaggtttatacagattcgggccgctaagaagcgtaataccctactcctgtgtttgggattatggttgagtgttacaagggttcctaaactccggagagcactctcgctcttcttctccttgagttcgggcctactgagtatcgtcccttttatcggtgggcaaggtcctccttttatagttcaaggggataccacataggcccaacaacctaacttcctcgagaagtattaccatctttgcattaaatgcatgtcttgttccttaacttggataccgcatacacgtcgcctcggtcgtggggcctaccacaccatgccgcctgacacggggggcgcccatgtcattcaccatttaatgggtgaagacttctgggctcctattataccgggaaacgggagcctagctttgaccagagcgggaggaccgactccggctgggataagatgatgagaacctctcaccatcattatttgatgggacatgtcaggctgcacgccgcctgacacacgagcagcgcacaggcgcactagccagtccgatcggtcattcgaccggtcacagaccggttgagtacactgcacgccgcattaaatgcggcgtggcgcgaccgcttgggtcgccataaatgcaggtaggtgggcacctgtacgtggtgatctagagagggggtcgggggagcccgacccctagtcacgggagggggccgccgccgcccgacctcaggcccgatcccccctcgggggagggccccgtggcgcctggggcagccttctccctctagtctcggccagggagtggccgccaccccacctcgggcctgactccccttgggggagggccacgtggtattggggagcggcctcctccgacttgtctttgggaaggagtggctgccaccccacctcgggcctgacttcccttaggggagggccacgtggcattggggggctgcctcctccgactaatctttgggaaggagtggccgccaccccacctcgggcctgactccccttgggggagggccacgtggcattggggggcggcctcctccaactaaacatgataccccgggctcatatcaccgacaaagccatacttgttttgatcaaaatattcatatgcagaagtacttatttccaaatctatgcactgacaagtggattttacagacacacgatgagccaatgtttgttggatggcctcggaccaaggtgataactgatacccaattttaggaaactcacttttaaacgttggggctaactgaatttttgttaaactcttgctagatatttgttatgttgttccaaaattttctctctttttttttcagaaatataaattgagcactgctgttccacgtgactaattaactaacttagtccatcaatattttttccctataatttagtaatttccacagaaccacagtacaagtatgcctacaggagatttcttacggactaaaagaataatataaataatgtctaccaaaaacctagtcagttgattcgacggcaatgagttagctatatttttcatttcgatctttgtgaagattaagtcatatatttttctttctgagaataacaaaattttcatatctcatttgaacaatgctttcctaacgtgcataaatgtcaaggtttaaactttgttcattgaagatgggaccaaacaagttaactgaacaataactccatactattgtaaacgcatacacctatcaaaatctccactgcaagatgattcatggttgtcctataaaagggaaacaagaaagatcggcaagacgatggggatggtacatgattaattgagtagttgtgcaagcatcagactgccgtaagtgtgagaggtatcattcagatttgagatttgagaatgataggcatcgagaaaacaagcgaggggagctcgaaccgacaccgatcatccaagtttccgcattgtacatgatctcagtcttgatgaacatttggtgagaacacacctggcagcagcgggttttttttttgtaccgcacacacactgtaacgatgtattttgctggaaaataggatggatagtgataggaaatgtaagatgatacctcctcttgttgctatccatcctaatgattcaagaagatgaatccacttgtgttgctcacttgctcacctggttaattcagtctatatatgttcaccatagaaatgccactgaaattcaggtagtgcagaggaaaaaaacactgtttgggtaaggctttaccatggttaattacaagttaatataaacatgattaattgagtagttgtgcaagcatcagactgccataagagtgagaggtatcattcagatttgagatttgagaatgataggcatcgagaaaacaagcgaggggagctcgaaccgacaccgatcatctaagtttccgcattgcagacgatctcagttttgatgaacatttggtgagaacacacctggcagcagcggttttttttttttaccgcacacacactgtaacgatgtattttgctcgaaaacaggatggatggtgataggaaatgtaagatgatacctcttcttgttgttatccatcctaatgtttcgagaagatgaatccacttgtgttgctcacctggttaattcggtctatatatgttcaccgtagaaatgccacagaaattcaggtgttgcagaggaaaaaaaacattgtttgggtaaggctttaccatggttaattacaagttaatataaacagtaatataaacgattgcagcatacataggttaaagggttaacctatggctatgcagatcaaaatagaaattgacacaaggacctatagcttgaggaaagaaaaaggataaaaaaatgatgtttgactctctttatcaaacttttgaaactttgattatcaataaaattaaaatattttgtttacaactataaaaggtatatgtagatttatatttaaaattactgccacaacatcataaacttattaaattttataatattattttatttaaaaactgtagcgaaagtctcaccagaagaactactgaaaaaaaaatataaactatgtgtcaacatttgacaataaagaccaggaaggcaactcggaagctgttgatcaagatggtgtaactgaagcagagtataagctagtaagcagagcagcgaagagaagcagtggtggacaaacaatggggggcaaaggggcccaacacctcctatagatgggctacctagtagtatccctaggaatttagtattatttctgattgtcaaataatacaagataataattttaacaagtttgttatattatttttatgggtttctaggaacatattacataccatcgagataactcttttgatgtattttgctttcttctaagttactatcccttttatgtgtaattgtatactggaaaaggcaattagttctatttaatagatagtttgtatgctatgttttgtcccattgacaccctctcaaatttaatcgtgcattcgccactgatgacgcaaacgttggttccagaaatacaaaagctaatttaaattatattgggccaacatgggcagtgtagtgaatatgtactatgtgacccatgttagagaaccaaacagatagagagctaatcatgtttatcgtgtttgtacatatcttgttttgtgtgtgtgggagggggggccaggtgttgaatttttggaaagttcaatttttgacgtttggggctgattgaaaatttggttgttatgaaacattgaaatggtggcagttcagtaccatgtgtacttagtttacacgattagactcttctaccaagattatttgttatgtttggataacaaataaccttacggaatggtcgggtaacaaataatattgttatgtttatcaaaaaacttttggacctaattttctagttttgattttttaagattaaccaaattctctttttcttttgtcagacgaagaacgaaatttccactagtgtcatgatcggaagaagagataaggttgctcatctgagcatccttttcctgatgtgcgtacataaatgctcattcacattcagtccaatcaatatgtgacctaacaaaattgctgaacaataaattcaaacacacacccacaaaactttgcactacatgataattcatcttggtctataaaatgacatgaagaaagattagacgatgaggatggaactagataaatcatggaattgcgcaagcatcatggtgttgtgtgcatctacaattggagcccataacagaattatcattaaaatgttaaaagtgccatgagaatgagaggtattcatgaaacaagtcagaagcccaatatgcttttctatccgattacgcttgcaagttcaggattaccaaaatgttctcgaacatttggcaagaactactcctcgtgggagcttctaatcgggtggtcgtcgagctcgatctcgtcgatatgcccatcgcatgtccctctcccgtttctcacgaaccctgctagaatttcttaaacaattaaaaataagtttaaaaagagaaataggaagaagcataatattagtgtgtatagattttacacatagaaataaatatattgtaatctttatgtgtataatagaaacattatatataaatttttatcttataaactttagatgtctaaaggtgtgtaaacttttgatacataaacttataaaaaaagtatgatgtgaaaaagggaaaacggtgaaaaaaaataaaaaaaaatcgcttggggcgaccagtggctaattattgatttagactcctctattcgagtccaattcgttgcaaattctagcagtagctaacagtataggcgtatggcactggcatgtggaccctacttgcacatgataaacccactttgtaccttaattatgatggcctggctatatagtaaccgagtcccaaattttggaaatttggtttttgacgtttggggctaactgaaaatttggttccaaatttgctatcaaaacattttgagacggtggcagttcagttgtatctgtacttaattacactatgagactcatttttgttagattaccttggtagtaatcgagacataattttaggaaaacttagttttaaagtgggctaaaaaataatcttgttatgtgtttcaaaagttctgcttttttttaacaaaaaaatgaattcaacacgggcacaacagtcccaaacttgcaagcaactactctctctcccggaatatagcaagctataacctaggatcggataggacgtatctggcgtgtccagatttatagtaataagataagtcccatccgattataggttactgtattctgggacaggagagtaattatccaatttcttgtgcttgatcacgcccagacaattgagctcccaaaacgagttacaccatttggtggccctgatctaaatttccatttttaatttcttaagattatgccaagtcctttttcttttcaaaagagcgtgatgaccggaagaacaaataaggttgctcgtgctgatgtgcataattttgtagatgatggataaaatccagcttttggttcaatgaagaatctttttctcttttaaaaaaaagccaaacatgaaagtatatgagaagacaagtttaaccagctggatacaacttattcagatgctgatgtgcatgtataaatgctcctacacactcagtccaaccaataatggacctgacaaaactaatgaacaataacttcataccgaaaacacatcccgtcaaaatttgtactacatgataattcatccccgtctataaaagggcacgaagaaagatcagacaatgaggatggaacaagatagatcaaggaattatgcaggcatccctcctagagtcactgtattgttctgtgcatctacagttggagcacatgccataattatccttttttttaaaaaaaaatcagagtgccatgagaatgagaggtattcagggaacaagtgaaacgcggaaaatacattgtagccaattaggcaattactcttgcaagttaaggatgactagatgactgatcagcaagattcggtgagctagacaaccatgcgtggacgtgatggatcaggatctcctgcctcgtgagagtgcagtcagtgtttacccaccgttcaagcaatccgtcggctggaatccctcgtgcgcttaacagccgatagaaccagcaagccaaagttgccgaatagcgcgaatgagagcacattaatagagttgtggatggaaaattgggcatccctgctctgtttttgcaccgaaaatactaagattgttggtcttccttcccgcctcacctcttcgcagtccaaaaaattgagatgcaataagacatgcaggtttccacaaaacaatttgaaggatttttgctttctgaattttatttgcaaatatttagaatgttacatctgctgccagtagactatttctagtcttctactaccagcatcaattttctcgcatacaacaaattgggtcactagtttgaacaacgcaactatgcaagagacacatccctttttataattttgtctaaggaattggattaaccgcttagagttctcacaagagcatcttcatgtgatgtattcacttgtgacgccaattctgtcaaatacaccaaagagaactatgtctagtggaatagcgaagaaagaccaggatcatatttgttagaattcaggttaatttaacctacggttatatagatcaaactaaacactgacacgtggatctattgcttaagtcccacgaaaatagcccctccagtcagaattttatgacattttactctctgtcaaacttttaaaaatccaattatttttgaatacttagtttatacatataaaaataggtttggattttgtcatcttaaaaagcacttgttagcttttataaatctatcctactaaaaatgtaaacagttccctccttttatattgattagtcacactagtggccaacccgtgcattgcacgacttctgttattgacatttaaatattttcaaagtgatttgttcatgatttagttcgaaatattataatcaataaatatcaaattgtaatcgatttggagtctaaaatcataaaaatgtaaaaactaaaaaatatttgcttctgttattattttttcttttattttaacaagtaattatttttaatattgtaaatattgaaattttaaagtgtgctgttattttccagtggctttgacatatagtacagttcatatcagttactaacaggtttgaaatttataaagtagtaaaaattaatttttatttatcttttctaaattttagaactcataaactaaaattggaaccgatagtattttcggtagcttgttttattaactaggaaggtagcccgcgcatacgcgcgggcatgttgtttaatcttgtttgaaattttattattacgaatgtttgtgtggatgatatttttgaaatatttttttactctattttaaacgtatgttcgttaataactgttgggtgtattacttgaacctgtatatcctcaaatttaatagaaaaaatatgccccaataatggagttagttcatacctatttatattgtgtgtgattctttttttaaaatttttccaaactttatataacattttttttgttttgtatgctatagatgactttaagtaatattttaattttattatatattaatgaaatatattttctattaaaaatataactaatgatactacttcatctaatcaaagatagacttatattacttatattccctctgtcacataaatcgaaggaggtaaattttatcccaaaacaatagaagaatttatacgtaaccaggacgttgattttctaaatactaccacgataatctccaaagtaccgtatcatattttgacaaatatatgtgctgtagtgcatgttcgttcagtgtccggtttgttttccacacctattgtttctaatcacatgagacacctttagtaatttggagaatacatatgttcatttaaattagtgttgtatatttgtcaagtgtttttcacacctaaaatatgatgtgaaattattatcgtaacattaattattacatgttggttccataattgtaatgtatttatggctatagatattagtagtttatttatttaaaggaatacaaccggatcacaaattggatatataattttaaaataatttaaaagatagaatgcttaaaagcattgaatgtatattttatatttacatttacgtaaatttgaagattattatatttttatccttaattcgtagaaaattattttttaaggactgccattttttgggggctttatcataaatacgttttatgttattccggcaaacaatatgtaagcattattgttttttttcaaccatatgtacgtacggagtactttttccggtcaacagttatatatttgtcatatatccgtatataggagaaacaattaatctaacggtgtaaaatgaaacaactaaattgtgttgttttcattttcacaaatataaatttaaattagcatttaatatttgtcgagtgatatttgacaccctaaaatatgatgtgaaataagaaaatatcaaaacattaattattatatatatcaacctcgtatgttaagatcgaacgaacaaagatcattgatgggatatttcatatttgtaatatagatttagtttaactacgtatatttacgtaaatttgtagagtaatatatttatctttaaatattatataatactatttcaaaagaccatcgatctttttcgaatgatacgcttttttttttgtttttatagtaagggattttgaaaatactatttcgaaagaccaccatgcggagatttttctttgttccgaactttcgatggatagcggttaagctttatttattttttcaagtcgtatgtacgtagggactacttatgtttttttttctttttctagcctaattgttatatatatctcccgcatacgtacacagagtaataagttattagtttttaaaataaaatatatctaatggtttaaactattgggttcaccaatttaattaaaaatcggcggtgatatttgcttaaatttatatagtaatagattttatctttaaatattacaaaactctattttaaagataatcgattttttatggtactatacacgtatgttttttttttctttgttgtttttacagtaagtctgtgcatagtttttttctttcaataaacagtaggtaatatattcattgttttttattcttacatatgtacatatatatggagtactcgtgtttttttttctttttccggtgaagtaaggtatgagtttctttttaaataaaatacatataatctaaggtaagattcattgttttctattcttacgtatgttcattagtacgttacctgtacatacgtatatacggggatggatgcatatgtccgcgcagggtacaggggaggactaaaatcagtttaatttgttttctttttccggtgtatagtaaggtattagtttctttttaaataaaatacatctgatctaatctaatggtccaaattatcaggtccaccgatttaagtgaaaatcgacggtgagattagacattgccacgtggcagtctaggagcgtttgtagaagtgccacgtggcggcttgagagcgtttataggaagtttaatggacttttatttagtatataatagatagatagatagatagattgcagatggaaatgtcgatggtaataatatgtcctggcatgatcaacattggcaatttcattttcaaaatatgaccacctaatttttaagtgaaatatttataatactttgacaatatgttttattatttaatttttttataaaaaatacaaccatataattttaatccattacaatctaatcgtttgaaagtactttgttatcaaaagtgagatggccgtagttaacagcatcagtaatttgaatggtatattttatttgacacaaataagtgcaataatcatagtgcacaaatttaacatgcaagctccaagcacaataatttaagggtgattactatcgtgaccttgacataataataaaaaactacttaatccggcagacagtaattcatagaagtagaacttaagtgtaaaaacatggaaaatttgctgtcatgttatcgtaactgcactatatggctatgtaatgtttgaaccaaagcgaattagagcaagcatgctgacttatttagaataaaagcgtatatgcattctagctttgagaagcacatgcaacgcggtgaagttagtttctgtgaagatatatcaaatgctcgtcgctttgatttgccgtgccttagatctatatctgttgtagctgccaatgagattagttaagaataatactgttctagatatgaatgtgttttcactaatgtgtaggttatctgtttgtacaaagtataatatgtgcgtacgtactttcttcgattagaaagatgttttcaattcttatggataagtagaataataaaccgtacgggaatcaaagaattatgttgcgttgatctaggaactcactgtcttttcttgcatagcagaaatcgggtcattagtttgaaaaacgcaagagacatatatactacccttttaacaaatattaaccactcttggagttttcacaagagtacaaaatcggctgctacccaagcatttcaagaaatgtattacttgtgatgctaaccctgccaattcagattctataagcaaatgcaaacatgctgtggaaaacaaattctgaccagcggaatggagaagaaagagtaggtttacatttgttagaacaaattaaaattagatactgacatgtgagtcaattgcttaagtcgaacaaaaaagtctccctccggtcaaattttatgacattttactgttttctgaaacgattgcaactgcgataaattttatatacttggtttaatcatatgaaatggtacatgtgtgtatttttgccatactgaaaagtactcttatagtcttaattataaacttattagactttataaatctattctattaaaaaagtaaaatgtgataatcttctctctttatatattgaaatttagatttaccatcgtgggagatgcatgctagtgaccttacatgaccacacatgtcattggcatgagatggtaatcgcgcaattttcgatcgaaacaaaggatatatgatcaaatttcccactaaaacaaatatgattttatcgtcaaaacagtaaaaagaatagtcaaatattcatatgtagaagtacttatttccaaaactatggcactcacatgtggattttagtgacacatgatgagccacaaccgttccacatgagtaattaactaacttggtccttcaatagcaataagaatttcctaatgtaataattttcacagaagcatattacaagtacgcctaaaggagatctcttacggactaaaaaataatataaacaatgtttaccaaaaactagtcagtcaattcaaaagcagtgagttagctatattttgcatttcgatgtttgtgaagattaagccattttttttctttctgaaaatagcttttttttttcatattactcatttgaacaacacttccctgacatgcataaatgccaaggttttcattgaacatgggacctaacaagataactgaacaataactccgtactactataaacgtacacacccatcaaaccctttactaccagatggttcatgcttgatctataaaagggaaataagaaagattggaaaacgatggggatatggaataagattaatcgagtagttgtgtaagaatcagataaccgtaagagtgagaggtatcattcagagttgagatttgagaatgataagcatcgagaaaacaagcgaggggagcttgaagcgacatcgataacccaagcttccggacggtacacgatccaaaactcatgacgaacattcggcgagaatcagacaaccgggcggctagaaagtgggatggatgggtgatagaaaatgcaagatgagttagcacagcttcttttctctcctttggaggccctacttgttgctatccatcctaacgttttgagaagttttttttttttggggggtgggggggggggagatgggggtgacaaagagatagagactgaaaatttggttgctatcaaccatttagacggtagcagttcagtaccatctgtacatagtttacacgattagactctaattcgctttgttagatgacccaagtaataatcgagacacaatgttaggaaaacatagatttaaagttgggccaacaaataatcttgctatgtctatcaaaagttgggccaaattcttttttttttctcaaaagaacgaaatttccactagtgtcacgatcgaaagacgaaataagattgctcatttgagcatccggtccatttcctgatgtgcgtacataaatgctcattcacaattcagtccaatcaatttgtgacctgacaaaattactgaacaataaattcaaacacacaaccacaaaactttgcactacatgataattcatcctggtctataaaatgacacgaagaaagatatattagacgatgaggatggaacaagataaatcgaggaaatgcgcaagcattatggtgttgttgtgtgcatctacagttggagcccataccagaattatcattaaaatgttgaacaagccagaagcccaaaatgcttttccgttcgattacgcttgtaagttcacggttacttgaccgacctcgtacatttaggaagaactactctccgagggtgcttaattttctcatcaggtggtcgtgccgctcgatatggccaataggccaatcgtgtgcccctttcccatggctcccccttcacatgaaaccagatagaatttcaaaaacaattaaaaaataataagttttaaaaggataatagaaaataaaataaaaattaagtttaaaaagaaagtagaaaaaagataatatccatatgtatagattttacacatagtaacaaatatattgtaaactttatgcacataatagaaacattttgtataaaagaatatttaaatctgaatttaaatcggctatataaatttttagcttataaacattgggtataaggtgcgtaaacttttgatacacaatcttatacgaaaagaaaaactatgcagtgaaaaaagggaaagtggtgaagaaaataaaaaaatcgctcagggcaaccgatggctaattattgattttgactcctcgatttgaatccaattcgtggaaattatagcaatagctactagtataggaaaactacaatgcgggataccgttcggacatggcagtttaatggagactactatgatcactccctccaatacatacataagtcaatttgatttttgtgcgcaatcaagtgctcatgggcacgtgaaacacggacattagcagctaaccggcatacggacacgagcagcttactgaggtgtgctgcagccctccctcaagtgctcatgggcacgtgatacgaggaggtgggccacaccagtacctaagttggtaacatcacggtatgataaagctgcacaaatcaatacattcatttgtgcatactcacggtgagaagacatggggctttctaatattacatttttttatctttatcgttcatctctttagaaattttcttttctcattccggaaatgctataagatggtattccgttcggaatgatactggttaagtatcaagtccagatatatctaaggtattatgtcctgatacctaaccggtatcaggtgatatctctcaggtatcagttgatacttgcaaggtatgatgtcacctgatacctggtaggaatcgcctaatacaagataggtatcatctgataccgattagatcggcatcaaatgatatctcacaagtatcacctgatacttattacgaatcaccttatcctagttagtactactagaatagagggagactatagaaaagtataccgttccaatggaatagctaatgtacatgatatcagcatgataccagagagataacggatctggtacctccggtaccaaacatgataacccataggtattatcagcctcattggatggcatattatatgaatatgccaaatggcatacttataaacgaaaatcaagttgtgaataaaacttttatatatgtgtttttagcgatccaaaagtaaaggctgaaaaataaacttcgatgaaaaaaccccaaaatcagctccaaatttaacgttgaaaattcaaattttggttgataagcatatgaatatgccaaacgatggggacctatatctgatacctaggtatcatgatgacatcagcatgatacctcataggtatcagatctgatacctatgtatcatgttgacatcagcatgataccgaatatggtgtctccggcaccaaacatgatactccgtaggcatcagatttggtacctaggtatcatgctgaagtcacaattggaacaatatattgatctgttcaaactcaagggagcgctcgatgcacgtggggagacatatagatttttttgagagccatgtacattgatacatcacgctagctgagtccgtttttatccttatccatatcttgctcagggaggcggaggtgtcattcaattatcccatttggacggaatgccgtacactagtcgttctcagtacagtatagcacaggcatgtgggccctacttacacatgataaacccactttatacgttaattagatgacagcctggctagtactaacacagtcccaaattttggaagattcgatttttgacgattggagctaactgaaaatttggttgctaactttagtatcaaaaagccgtcgcagttcagttgtatctgtagttaattacactatgagcctcactttggttagattaccttggtagtgaactactaatcgagacataatttcaggaaaacttgttcttaaagttggataaaaaataatcttgttatgtgtttcaaaagctctgtttttctaaaaaaaaatgaattcagcacaggcacaacagtcccatacatgcaagcaactaattaaccagtttcatgtgcgtggtcacacccggacagttgagctcccaaaactagtcacaacatttggtggcactgatctaaatttccaattttgattttttaagattatgccaaattctttttcttttcaaaaaaacgaaattttcactagcgtcatgattggaagaagaaataaggttgctcatttgagcacctttctgcttatgtgcatatttttgaagataatggataaaatccagcttttacttcaacgaagaagctatagccaattatatcgtttttctaaaaaagccaaacatgaaagtatatgggaagacaactataaccagccagatacaacttattcagatgctggtgtgcatatataaatgctcattcacattcagtccaatcaatatgggaccagagaaaattactgaacacaaacttcacactgaaaacatacacccaccaaactttgtacagcatgatatataattcatcctcgtctataaaaaggcacaaggaaaaagatcagacaatggggatggaacaacataaatggaggaattgtgcaagcatcatagtattttttgtgcatttccagttgaagcacatgctctagttattatagaaaagaaaatcagagtgccacgagaatgagaggtattcaggaaacaagcgaaacacaaacaatgcgtagctgccagttactcttgcaagtgcaggatgaccacatgactgatcaccaagatttggtgagatggacaaccatgtgtggaggtgactgatcaagatcgtctgccttcactccttgaaagcaggagcatgcagtcagcgtttatccaccgtccaagcaatccgtcggctcgggtcgctcgtgcgcttaacagacgataaaaccagcaagccagagtagctgcatggcgtgaatcagagcacgttaatagagttgtggagggaaaattgagcatccctgctctgttttgcaccggaaatacagagattgagatgcaatatgagcacagccattaaacagtgattttaccccttcaaaaccgaaaagttgcaggatattaatttgttatattgttccaaaatttaccctcttttttttcctcaaaaattgaaattgagcacagacattccacgtgactaattaaccaatctgctccttcaactctagtatgattttccatatagtttagtaatttcaacagaagagtacacatacgcatgcgggagatttcttactgactataaaaataatgtaaacaatgttttaccaaagctagtccatcgattcgtcaacagctagttaactgtatttcccattttgatgtttgtgaagattaagccataatttatctcaaaacaacaaagtttgaacaccgctttcctaacgtgcataaatgccaaggtacattcagttgattcaacatgggggcgaacaagataacagaagaatagctccatagtccatactgtacagccaacacacaaccatcaaactctccactaccacactattcatcctggtcctataaaagggtgtcaagaaagattgtacaacggtgcggatgaaacaggattaatcgagtaattgtgcgagcatcatagtgtcataagagtgaggttgagatcgatattcagttaagatctgggaatgagaagcattgagaaaataagcaagaggaactcgaagcaacagtgatcaaccaaatatccagattgaagacgatccgtctcacgacagacatttggtgagagctagacagcaacatgaaggatatgtccatttgtacggtagcttttgcatgtgctgggaaatgggacagtaatatgagtttgatggtgataggaaaagtaagacgatttggtacagcgtcttttctctccttttgacgcacaacttgtttatcctaacgttttgagaagatggatccatttgtagaagatggatccatttgtgatgctcacccggttaatttggcctacatatatatgctcaccatataaatgccacacaaattttcaggtggaacagtgaaaaaatactgtttggataaagcttaatccacggttacatgttataaacagtaatataaatgattgcagcatatatggtgattccatttgtattcatatactttgatttgattttttttctgaagagagaacatacatatttaaataaaatcgtattttcatatgtagacttttatttgaaactttcatttcaaaaaattatatttacctaaacagtaaaaatctatatatactcattttttaatctatcagagtactttaaaaaaataaatctgtattgaacgatgtggaatttaacttacacgtgatgagcctgctttgttagatggaccgagtcgtaaccgagacccaatttcaatgaaatttagtttttgaaattaaggtaactgaagatttttgttatgcttttcaaaaactagtttattgtaataaaataaatcgtgcacagccattttactggtagagaaaccatttttggtcggtcgacccaaatccacagtagtcccggttccattaaaaaccgggactaaaaatgatttttagtcccggttaataagaggaagatctttaatcccggttgttgttctttagtcccggttgataactccaaccgggactaaagttcatttttagtcccggttgattccatgtcaggccgtgtcagggctctaggatctttagtcccggttaataacaccaaccgggactaaaaacctatttttagtcccggttggtgatactaaccg

SEQ ID NO: 59568 - DNA, 33796 bp, Oryza sativa
aagcaaaaatccttcaaattgttttgtggaaacctgcatgtcttattgcatctcaattttttggactgcgaagaggtgaggtggaaggaagaccaacaatcttagtattttcggtgcaaaaacagagcagggatgcccaattttccatccacaactctattaatgtgctctcattcgcgctattcggcaactttggcttgctggttctatcggctgttaagcgcacgagggattccagccgacggattgcttgaacggtgggtaaacactgactgcactctcacgaggcaggagatcctgatccatcacgtccacgcatggttgtctagctcaccgaatcttgctgatcagtcatctagtcatccttaacttgcaagagtaattgcctaattggctacaatgtattttccgcgtttcacttgttccctgaatacctctcattctcatggcactctgatttttttttaaaaaaaaggataattatggcatgtgctccaactgtagatgcacagaacaatacagtgactctaggagggatgcctgcataattccttgatctatcttgttccatcctcattgtctgatctttcttcgtgcccttttatagacggggatgaattatcatgtagtacaaattttgacgggatgtgttttcggtatgaagttattgttcattagttttgtcaggtccattattggttggactgagtgtgtaggagcatttatacatgcacatcagcatctgaataagttgtatccagctggttaaacttgtcttctcatatactttcatgtttggcttttttttaaaagagaaaaagattcttcattgaaccaaaagctggattttatccatcatctacaaaattatgcacatcagcacgagcaaccttatttgttcttccggtcatcacgctcttttgaaaagaaaaaggacttggcataatcttaagaaattaaaaatggaaatttagatcagggccaccaaatggtgtaactcgttttgggagctcaattgtctgggcgtgatcaagcacaagaaattggataattactctcctgtcccagaatacagtaacctataatcggatgggacttatcttattactataaatctggacacgccagatacgtcctatccgatcctaggttatagcttgctatattccgggagagagagtagttgcttgcaagtttgggactgttgtgcccgtgttgaattcatttttttgttaaaaaaaagcagaacttttgaaacacataacaagattattttttagcccactttaaaactaagttttcctaaaattatgtctcgattactaccaaggtaatctaacaaaaatgagtctcatagtgtaattaagtacagatacaactgaactgccaccgtctcaaaatgttttgatagcaaatttggaaccaaattttcagttagccccaaacgtcaaaaaccaaatttccaaaatttgggactcggttactatatagccaggccatcataattaaggtacaaagtgggtttatcatgtgcaagtagggtccacatgccagtgccatacgcctatacttgtagctactgctagaatttgcaacgaattggactcgaatagaggagtctaaatcaataattagccactggtcgccccaagcgatttttttttattttttttcaccggttttcctttttcacatcatactttttttataagtttatgtatcaaaagtttacacacctttagacatctaaagtttataagataaaaatttatatataatgtttctattatacacataaagattacaatatatttatttctatgtgtaaaatctatacacactaatattatgcttcttcctatttctctttttaaacttatttttaattgtttaagaaattctagcagggttcgtgagaaacgggagagggacatgcgatgggcatatcgacgagatcgagctcgacgaccacccgattagaagctcccacgaggagtagttcttgccaaatgttcgagaacattttggtaatcctgaacttgcaagcgtaatcggatagaaaagcatattgggcttctgacttgtttcatgaatacctctcattctcatggcacttttaacattttaatgataattctgttatgggctccaattgtagatgcacacaacaccatgatgcttgcgcaattccatgatttatctagttccatcctcatcgtctaatctttcttcatgtcattttatagaccaagatgaattatcatgtagtgcaaagttttgtgggtgtgtgtttgaatttattgttcagcaattttgttaggtcacatattgattggactgaatgtgaatgagcatttatgtacgcacatcaggaaaaggatgctcagatgagcaaccttatctcttcttccgatcatgacactagtggaaatttcgttcttcgtctgacaaaagaaaaagagaatttggttaatcttaaaaaatcaaaactagaaaattaggtccaaaagttttttgataaacataacaatattatttgttacccgaccattccgtaaggttatttgttatccaaacataacaaataatcttggtagaagagtctaatcgtgtaaactaagtacacatggtactgaactgccaccatttcaatgtttcataacaaccaaattttcaatcagccccaaacgtcaaaaattgaactttccaaaaattcaacacctggccccccctcccacacacacaaaacaagatatgtacaaacacgataaacatgattagctctctatctgtttggttctctaacatgggtcacatagtacatattcactacactgcccatgttggcccaatataatttaaattagcttttgtatttctggaaccaacgtttgcgtcatcagtggcgaatgcacgattaaatttgagagggtgtcaatgggacaaaacatagcatacaaactatctattaaatagaactaattgccttttccagtatacaattacacataaaagggatagtaacttagaagaaagcaaaatacatcaaaagagttatctcgatggtatgtaatatgttcctagaaacccataaaaataatataacaaacttgttaaaattattatcttgtattatttgacaatcagaaataatactaaattcctagggatactactaggtagcccatctataggaggtgttgggcccctttgccccccattgtttgtccaccactgcttctcttcgctgctctgcttactagcttatactctgcttcagttacaccatcttgatcaacagcttccgagttgccttcctggtctttattgtcaaatgttgacacatagtttatatttttttttcagtagttcttctggtgagactttcgctacagtttttaaataaaataatattataaaatttaataagtttatgatgttgtggcagtaattttaaatataaatctacatataccttttatagttgtaaacaaaatattttaattttattgataatcaaagtttcaaaagtttgataaagagagtcaaacatcatttttttatcctttttctttcctcaagctataggtccttgtgtcaatttctattttgatctgcatagccataggttaaccctttaacctatgtatgctgcaatcgtttatattactgtttatattaacttgtaattaaccatggtaaagccttacccaaacaatgttttttttcctctgcaacacctgaatttctgtggcatttctacggtgaacatatatagaccgaattaaccaggtgagcaacacaagtggattcatcttctcgaaacattaggatggataacaacaagaagaggtatcatcttacatttcctatcaccatccatcctgttttcgagcaaaatacatcgttacagtgtgtgtgcggtaaaaaaaaaaaaccgctcctgccaggtgtgttctcaccgattgttcatcaaaagtgagatcgtgtgcaatgcggaaacttagatgatcggtgtcggttcgagctcccctcgcttgttttctcgatgcctatcattctcaaatctcaaatctgaatgatacctctcactcttatggcagtctgatgcttgcacaactactcaattaatcatgtttatattaacttgtaattaaccatggtaaagccttacccaaacagtgtttttttcctctgcactacctgaatttcagtggcatttctatggtgaacatatatagactgaattaaccaggtgagcaagtgagcaacacaagtggattcatcttcttgaatcattaggatggatagcaacaagaggaggtatcatcttacatttcctatcactatccatcctattttccagcaaaatacatcgttacagtgtgtgtgcggtacaaaaaaaaaacccgctgctgccaggtgtgttctcaccaaatgttcatcaagactgagatcatgtacaatgcggaaacttggatgatcggtgtcggttcgagctcccctcgcttgttttctcgatgcctatcattctcaaatctcaaatctgaatgatacctctcacacttacggcagtctgatgcttgcacaactactcaattaatcatgtaccatccccatcgtcttgccgatctttcttgtttcccttttataggacaaccatgaatcatcttgcagtggagattttgataggtgtatgcgtttacaatagtatggagttattgttcagttaacttgtttggtcccatcttcaatgaacaaagtttaaaccttgacatttatgcacgttaggaaagcattgttcaaatgagatatgaaaattttgttattctcagaaagaaaaatatatgacttaatcttcacaaagatcgaaatgaaaaatatagctaactcattgccgtcgaatcaactgactaggtttttggtagacattatttatattattcttttagtccgtaagaaatctcctgtaggcatacttgtactgtggttctgtggaaattactaaattatagggaaaaaatattgatggactaagttagttaattagtcacgtggaacagcagtgctcaatttatatttctgaaaaaaaaagagagaaaattttggaacaacataacaaatatctagcaagagtttaacaaaaattcagttagccccaacgtttaaaagtgagtttcctaaaattgggtatcagttatcaccttggtccgaggccatccaacaaacattggctcatcgtgtgtctgtaaaatccacttgtcagtgcatagatttggaaataagtacttctgcatatgaatattttgatcaaaacaagtatggctttgtcggtgatatgagcccggggtatcatgtttagttggaggaggccgccccccaatgccacgtggccctcccccaaggggagtcaggcccgaggtggggtggcggccactccttcccaaagattagtcggaggaggcagccccccaatgccacgtggccctcccctaagggaagtcaggcccgaggtggggtggcagccactccttcccaaagacaagtcggaggaggccgctccccaataccacgtggccctcccccaaggggagtcaggcccgaggtggggtggcggccactccctggccgagactagagggagaaggctgccccaggcgccacggggccctcccccgaggggggatcggtcctgaggtcaggcggcggcagccccctcccgtgactaggggtcgggcttccccgaccccctctctagatcaccacgtacaggtgcccacctacctgcatttatggcgacccaagcggtcgcgccacgccgcatttaatgcggcgtgcagtgtactcaaccggtctgtgaccggtcgaatgaccgatcggactggctagtgcgcctgtgcgctgctcgtgtgtcaggcggcgtgcagcctgacatgtcccatcaaataatgatggtgagaggttctcatcatcttatcccagccggagtcggtcctcccgctctggtcaaagctaggctcccgtttcccggtataataggagcccagaagtcttcacccattaaatggtgaatgacatgggcgccccccgtgtcaggcggcatggtgtggtaggccccacgaccgaggcgacgtgtatgcggtatccaagttaaggaacaagacatgcatttaatgcaaagatggtaatacttctcgaggaagttaggttgttgggcctatgtggtatccccttgaactataaaaggaggaccttgcccaccgataaaagggacgatactcagtaggcccgaactcaaggagaagaagagcgagagtgctctccggagtttaggaacccttgtaacactcaaccataatcccaaacacaggagtagggtattacgcttcttagcggcccgaatctgtataaacctcttttgtctcatcgtctttgggggattgaacgccctcaagatcacacagcttcgctcaccaagccctcgaatctcacccgctgcccccggccgaactcacaaaggggggcctcacggttctctgatggaggagttcatcctccgacaggctttatcttcaaaacagtaaaaatgaataatcatataaaaccatacttgttttagtgggaaatttgatcatatatcctttgttttgatagaaaattgacgattactatctcatgttaatgatttgtagggtcaattatggtcactggcatgcatctcccacaatggtaaatctaaattttaatctaaaaagtgggaagatgatcacattttattataacagatttataaagtctaataagtttataagactagaagagtatcgtttacgatggcaaaagtgcgcatgtataccattttctatgactaaaccaagtatttaaaatttattgcagtcgtaatcgtttgacaaaagacaggagggagaatttttgttggacttaagcaattgacccacatgttattctcaaattttaatttgttctaaaaatcaatatgttaaaccttaattctaatatatctgagcgtactctttctcctctccattcgactggtcagaattagttttctatagcatctctgcttttgcatatataatctgaattggcagagttagcatcacaagtgaatacatttcctgaaatgcttgggtagcagccgagtttgtactcttgtgaaaactccaagagtgggtaatatttgtcaaaaaggaagtatgtctcctgcgtttttcaaattaatgacctgatttctgctatgcaagaaaagacagtgagatcctagatcaacgtgcatcataattctttttcttcgtttataccactcggatgacttgttcaccaaatacatcatctacaatatttgtaggtcaaagcacctactacagctatgcttgaggcagatcatgtgtttgtcatggcaatgtcttcaatcatcttcgatcagtgtggcgtctagtgcttctgacctgcttcctggatacctctcattctcatgacccatgtttatacctctcattctcatagcactctgatttcttttaactatgccctctgcatcaactatagacgcacacaacaatttagtttgtgggaactctgatccatgcttgcacaacacacctagattggtctttgtttcatactcatcgtgtaatttttacacttcctttttatacaccaggatgaattgtcaggcagtggaaagtttggtggctgtgtttttcagtgtggagttattgttcagtaatcatgttaggcactttggccccttgctgaatggattgagtgtaaacctttgcatttatttacgcacaaatgagaaacctttttcttttgtttttttgatgacaaagcttgcggaaattttgttcatttttaaatagaaaaagtacaaattaccctccgaactatcacggtcgattgaattatcccctggaccacaaaaccagacatccttcaccctcacccccaactacgcaaatcggacaaataacccccttgagcactgttacgaggtttttgacttgagcttacttttgaaaaatgcaacaagattatttgtttgcccaaattttagaactaagtttttctacaattatgtctcgattactacctaggtcatccaacaaagcgagtctcatcatgtaaattaactacatatgctactcagggccggccctgggcctaggcgggttgtgcgaccgcctagggcccaggccagaggggacccatcacttatcccctcccaccccagcccggccaacaggcctagccacagcccagagccccagacgcgcgcctcaggccgccctcaactgctcagcgaatcagcgatcagccagggagcagtgcgcgtgcgcgtgcgcgtcacttcgcctgccgccctgcccaccggccctacaccacgagaactgcagtgcaggcccaggccgagccgcgtcgcttcgtcgccgtctcgccgatgccctagtccgcgagaggccgccgtgagtgccaagaccgcatcggccccactagcctatagcgcctgatcgccgtggcccatcggccaagccaccaaggcggtatcgctgtcgacgcttcttgccggctgcctggatggtggctggtccctgccctacccgcgtgatctgtgattgtcatcggctcatcggccatttcccattcgccccccttcttcaggctgaaggtaggtcacagacctagaagtcaatcgacaagctctatgcagctatgcctttatcaatttactttgcaatttcactgcttcaggtgttacaatgttacctagaaacatttgttgggtgctatacataactcataaggtcgcgaaaaagctcttttttataagggacatgggatatttgtggtctcctattaaggtgttcatactaatttgtttctatggtatttttagttgtcaattatactattgatattatttattaaagattaaattgctctatcgcaacttgcaaactgcttgatttattatttaccgtgttaaaaatgtttatttgtgtcactctatggtatatgtgctttatagagtatactgtatgtattagaagtaaaaaaaattagatataactccttaagggctaactctaagacccatagcgtcaagtctgcctagggcctccaaaatgtcaggaccggccgtaatgctactgaactatgatagcaaccaaagttttctgtcagtcccaaacgtcaaaaactgtttttttttccaaaaaatttgggactcggttaatagccaggctatcatataattaacgtacaaagtgggttcatcatgtgtatgtttgatccacatgtcaataccatactctagaatctgtaacgaattggactcaaatcgatgaatacttgttccatcctcattgtctgacctttcttgcttcgcttttatatactactggatgaatactcgggcagtggaaagtttggcagggggtgtgtttttcgcgcaaatagatttcagatttactagtcgtttgatctacaatatatgataatatgagtagcaccaatctcagttatatttttcttagtttactgtaattgtaaatcggattatctaaaacttgatgggtgtagctatatatatggcgccatatttttcatcaaaaaatagtcggtatttatttacactgtaagtccctaaattacatatgtaattttagtgtatttacaatgtaagtcacaaaattatatatgtaagtactaaaattacatatgtaaattcgaaaattacataccaattatatatgtaagtggggtgtaaatgaggtataactattgtgtaagtggctgaaaaaaaatcgactgtagcatatggcgccatatttctagcaactccgaacttagatatatatagcatggttttctgcaactgcataactattttaggttgggttatatgacacatgttaacacccctgtagatatatgtatcccatatggccttacaattattataacttagtgctcagcagtctgtacatgacaatgcatggaaatttggctaattagtcgcgtgaaatggctgtgcatgatttattttattgaaataaactagtttttgaaaaatatttaacaaaaatattcagttacacttaatttaataaactaaatttctctgaaattgggtattgttatgactcggcgcatctaacaaagcaggctcatcacgtgtaagataaatttccacatcactgaatacagatttattttttttcaaagtactctgatagattaaaaaattgagtatatacatatttttactgttgagttaaaaaagatttgttcaaatgaaagtttcaaataaaaatctacatatgaaaacatgatttaatttaaatatgtatgttctctcctcagaaaaaaataatttatatggtgcaatcatttgtattactgtttataacttgtaaccatggattaagccttctccagacagtattttcttatctgttccagctgaattttgtgtggcatttatatggtgaacatatgtaggccgaattaaccaggtgagcatcacaaatagatccatcttctcaaaacgttaagataattaaacaagttgcacatcaaaaggagagaaaagaagctgtaccatttttgggtaaatgcaagagctaccgtgcgtgcaggtcggagcaaccactgctgctaagtgtgaggcaggattcaatcacattaattgttgtctagctctcaccaaatgtccatcatcagatagagcatctttaatctagacattttctcgatctctttggcttggagttcctctcacttattttctcgatgcctctcattctcagatcttaactgaatacccccaatctcactcttatggtactatgatgcttgcacaattactcgattaatcatgtttcacccccatagttgtccaatctttcatgatttcctttcataggaccaaggtcaatagtgtggtaggggagagtttgatggttgtatgtttactgtagtatggagctgttgctcagttatcgtgttaggtcccatgttgaatgaactgaatgtggaccttggtatttatgcacgtcaggaaaacggtgttcgcatgaaaagtatgaaaaatttgttgttttgggataaattacggcttaatcttcacaaacatcaaaatgggaaaaatagataactcgctgttgtcgaatcaactgactaaaacagtgtttacattatgttttagtcagtaagaaatctcccacatgcgtacgtgcttctgtggaaataactaaattctagggaaattcatgttagtgttgaaggaccagattggttaattagtcatgtggaatgtctgtgctcaatttcagtttttgaatataaaaaaagagggtaaattttggaagaacagaacaaattaatatccattaaaactgagtttttcggtttcgaagttatgagtattaacaaaaatttcagttatgagtattaacaaaattttcagttagccaaagcctttaaaactgaatttttcggttttgaaggtaaaatcattgtttgttgggaaatttgatcaagtaccattaatttgaccaaaaattaaggattttcaatatctatttcaaaagcatgtgggggtaatttgaagtcacttacatgtctgaggatggtaatatcaatttatctacttctataaaagtgcagttgttttcctcacacctcaccacccgaaaaagaccggaccaatttgattgcacactttttgggaaaaaaattatagaaaaccaaatagttctatcgtactatgttggaaaaagaatggcccatataaaacgaatagtttatacaagagtaaagaccatcacctgtccctaaacttgtaccgctgtgtcatagcggtccctaaactcgcaaatcgaccgttcaggtcctcaaacttgttcaactatgtcatcccggtccctaaaattgcagatcactcatttagattctccaacttgttcagttgtgtcacctcggtccctaaacttagatttgaatatcatctgggtcaaataggacggtctaaagactttatattaaaaaataattcacccctttttcatgtgaactctaataaagacaaactttatatcaaacttgtagccctcgacacgatctacaactttatagttgattttttttatttcaagtcattttttgtcccaaaatgtaattttaaaattaaaatttcaaaatctataaacatgcaacaatattttgggaccctaaacagttttaattcaaaaacttatcaactacaaagttgtaggtcacgtcaagggctataattttgatataaagtttgtcttcattagggttcacatgaaaaagttatgaattattttttatataaagtttttagatcgtcctgtttagagaccggggtgacacaactaaacaagttggaggacctaaacgagtgatctgcaagtttaggaaccgggatgacacagtcaaagaaatttgaggacctgaacggtcgatttatgagtttagggaccgggatgacatagcggtataagtttagggaccggtgatatactttactctttttgttttttagtcggtaagaaatctctcacaagcgtacttgtactctgcttatgtggaaattactaaattacacggaagttcatattagtgttgaaggaccaaattaattggttaattagtcacgtgtaacggctgtgctcaatttaaattttttgaaaaagaattgtaaattttggaacaacataacaaatattcagcaagagttttttttaaaaaaaaacttcagttagctccagcctttaaaactgaagtttcggtcttgaagataaaatcatttttttgggggaaatttgattatgtcccttcattttgatctaaaactataaggattatcattatatgccaataacatgtggcaggtggggtcataaaggtcactaacattttcaaggatggtaaatctcaatcaatcaatcaatatatctaatatctaatgctggcttttctgccagtttctgattggtccgaattcggacctacgattttgcgacacgtcgcactaggaaagaggagtatgagctttggaacaagtaggaatactttatcagggcaaaggccctctgcccaagccggtgggccgagcctgccctactggtctggcctggtatcagcagcaatgctcaagttaatcggtttatttaggaaatttcaatcgcatcaattaatggattacataaatttcatggggaataaatcatttttatcaattaatgcaagaaatcatccaaatatagatcagattattactgcatcaatgtcaagtggcatagtgatatcaattttaagatttaaaactccaagtcaaccaccttcaaacaagcacagaaaaaactttgtcctgcatgccttaattttatctacaattttataatgaattttacaataattaacttaaaaaaatgtaagacttatattttttttgaacgagtttatgttatatacggctatacaccgtctcgcgtgcctattgggcacacctattttctagtttcaatataaaaagagggaatatgatcacattttactatttaaatggaatagatttagattatgaaaggactttataagactacaaatccgcacataccatttcacatgatcaaaccaagtattaaaattttattccagttttaaaggtttgagaaaagagtaaaatgtcataaaattatggctggagggattattttgttggacttaagtaatggacccgcatgtgagtgcctaatttgatctaaaaaaaaccaaatgttaaacatcaattctaacaaatgtgagcctgctctttcttctccattccacttggtctgaattagttatctatggcatctctggttttgcatatagaatctgaattgacagagcaacacaagtgaatacatttctcaaaatgcttgggtgaatcgcattgcacagataagtttgttaaaatggaagtgtctctcgcgtttttcaaaccaacatgacccggtttgtgctatgcacgaaaagacaatgagatatgcgagataatcagcatgcaacattattttcttttttggctataccatcatcagtcgccttgttcaccaaacacaccaaccatgaatgtgtgctgttcaaagcacccaccgctgctaagtgtgagacagacagtatggtgttaattaatggctatcaagcttctcccgtttgttcggcaccggtgagatactcttgcacattcaagaatcgttgatcaatgaggcatcttatgtttctcacttaattcctgcattcctctcattctcatagcactctgaatctgttatatacataattctgcccttgcacacaacaatataacttgtggacactctaatgcttacacaactcctcagttaatctttttgcatccttatcatctgatctttcttgctcacgtgtagcatatccttatgtagcattaataatttcatattaaaagcgtactcacgtgtgcctaatatttatatgcacttggattaaaacctatttggtgagttatttttaaataggaatgaatgtttaactttaacaaatcatcaaacataaattaggtgatatataattgaatagaaaaccaaaaaaaatgtaaaaaaagaattaatcactgacaaacttatcaagtatataatgtctaataagaatcctaattaaaaagcatgtcatgtgtagagaattagtgcaaatttagaagaggaatgaatcaaccaggatggttgtacgctatagatataccaaggcattaattatgttgaacatcatgtaagaagttataatataccaacctgttcactcaaactcctaactcaaacagttagctgtgactgagatcttacgaactaatggaaatcatcaaagttcgttcttttttttaagattaattagtggtaatctaaaacgagattagttaatgcaacacaaatcaagcatatagcccaaactatatagatgcacttaactagacaaccggaggcccttagacacctggggcccagggcggcctcactgctcgccctgccccagggttggccctggcagcaaaggctgaagcatttgcacctaagttagggccggcgctgggctaatgtggatggtgcgaccgtactaggacttaaaaaattaggagcctccaaaatatgtattctatggtaccacgctgctggatgagattgatattgacactatcatcattgattttgcatctagaattgttagaagaaattattttaaatgatctagagacatttatttttttattttaaacttattagtgtgaaattcgttaatgacaatgagtttttaaatattatcttgtatttttatagtgaatgggggccttcattttttattccacaccgggccaccaaaaagtcagggccggccctatcctgagtcctcggcgatggcgagcaccatggcttgaggcgctgaggggttcaaatacggtgacaatgacagtaagagcatgatggcccagatactctttagttctttaaaaactttttggcaatgtgcaactacttccgaacatccactacaccatgtaccaaaattggtgacaaacatcgtcaaaaaaattcatttttcgttcattagaaacttggaacaacaaggggaggtaaacaaaggaaaggcaaaggttgaggtcaaaggatcaggcaaaccttattgttatagatgttatactaaagggcatacaatgcaggaatgttcttctaggttttactatgagatttgtgaaagtgaggatcatgttgcttctcgttgcccaatttttaggtcatctgttaaacctgttgctcagttatgtggttatgctggagatggtttgggtttcttccatatacctctttcagctggaatgagggttaagcatgagcctaaagcggctatggttaaggtcactaaaggacagatgtctgtaagttctattatttctgagttggagaggttcatacctggtagatggaagtgggtggtgcatgataatggtgatgggacttttcgttcttctgcagctgaattaagtcgtatggtcgaatggggcaaggtacacactaaagttggtgaggctgaaatggagattgtggaaaggggagttgggaatgaggtgaaatatgtgatgccaaaagtgtgggtatagtgcaaaggtcttccttctgaattgagagagtatttaatcatttgggctgttggttccatccttagaattactaaagctgttgatatgatatttactagaaggtatgatatagctcgcttacaagttttggttcttgatccgtctctgattcctgatgtggtggatatggttattggtgatcacttgtatgagctgtttagagtagaacctgaaaatgggcctaaggagcctgtgcctatggagatggagaatttggatgatggggatttggaaaagaaaaaagaggggaacgtgaatcaggatctggggaagggggctggtttatttgattcaggtaatagctctaagatgggttctggtggtcaatttagtgagaggggttgtccttctgctccctcttctcagctaaatctgatacctgaatctgatggcttgactgtttctgatgaagaatttgatggtttagatgaggagactataatggttgacaaggcccagattcaggaaagtcttgtggcaaagctctctgttatccctgaggcagtaatctctccatcaaggaagagtaagagaagggaaagtgatagcgattagcttgttcttgaaagggccgaaaagttgaaggctgataagaacttggagaacctgcaggcttaaggtaattcagttaataatgtttcttttacacaattttcaaatgatcaaatatctgcacatcttcagaatcttggtgttataccttctagtaaaaatgttgttttagatgatgcaattaatgatttgaaatgtgtagaaaataataggataagcgaatatgcttgttcttctattaatcaagtttgtacccctaatgttgatactgagtcattagatgaccagttggaggataattttttactacaacatttatgtagtgaaattatggaagagatcatggattttagtgaggactgtgagaatagtcttaaaaacactttaaatcctatggcatcttctcctaactctaagaaaaagagtaaaagggggaaaaataagaaaaataataaaaatagtttcaaatgaagggaatcttttagaattgtgatgggtttaaggacccaaaataacataagtttatttctgacttgaccaaggaacatcaacttgactttatagcattgtctgagacggttaagaaagaatttactccagctgcacttaaaaatctttgtgctggtaaggagtttttgtggcattgtaaacctcccagaggtaggtctgggggtcttctgttaggcatcaatttactaaacgttgatattggtttaattgatgaaggtgatttttatattaagttccatttatgtaacaaagttgataagttcaagtgggctttagttttagtttacggaccggcacaaaatgaacttaaggatcagtttcttgctgaattagttaatttgtgcagtcatgaatccctaccaattctcattgatggtgattttaatattttacgtagccctgatgaaaaaaataatgacagttacgatgatagatggccctttctttttaatgctattattgatggactgtgtcttagggagttgcaaatgtcaggtacgatttatacttgggcaaataacttagcaaatccaacttatgagaaacatgataggattttgatgtccactgagtgggaacataaatttcctttatcctcggtggttgctcttaatagagatatttcagatcatactccactttttttaaatacaaactccacctcttcaggtaatgcacaacatagttttaaattcgaacttggttggttattacgtgatggctttgtagatatggtaaaggaggtctggtctagtgtacatgagggtaatactcctatggagcgatggcaggcgaagattcgccgattaagacagcatttgagaggatgggctaaacatacaagtggtatgtataaaaaagaaaaaaaaggagattttggataggttggatttgttggataaaaaggctgaatctgttcttctaattcacgaggaaattgattttagatggttttgtaggaatagattatctactcttatgagagaagaagaaattaagtggtatcaaagggctaaaactaaggatattttggagggtgattcaaatacaaagtattttcatttggttgctaacggcaaacatagaaaaactagaatttttcaacttcaagacggggatcaattgataaatggtgatgcaaatctaaaatcgcatattaccacttattataaagacctctttggtcctcctgatgattctgatctccagtttgatgaaaataattttgtggacatcccacaagtatctcaattagagaatgaagctttaatacaagaattcattgaaaaggaaattaaagaggctattttccaaatggaacataataaagctctgggtcctgatggatttcctgctgagttttatcaggtcttttgggatgtcattaaggatgatatgttggatcttttcagagattttcataatggtactttgcctttattctcccttaactttggtactattattcttttgcctaagtgtgctgaggccatgaaaattcaacaatataggcctatctgcttacttaatgttagttttaagatctttaccaaagttgctacgaatagaataatgagtgttgctcaaaaggtgattagccctactcaaactgcttttatacctgggagaatattatggaaggtgttgttattttgcatgaaactatgcatgaattacatcgcaaaaataaaagtgctgtgatttttaagatcgattttgaaaaagcctatgacaggtttaaatggtcttttgtacatcaaacgctcagaatgaaaggtttctctcctaaatggtgtgagtggataacttcttttattcaagggggacatgttggtattagagtaaatgatcagaccggtaataattttcatacttacaaaggtctaaggcaaggagatcctttatctccaattctttttaatatagtagcagatatgcttaccttattaattaagagggctaaagatgctggttcattgaatggggtagtccctcacctagtggatgatggtttatctattttatagtatgcggatgataccatcatttttttggaacatgacttacaacaagcgaagaatcttaaattgattttatctttgtttgaaaagttgtctggcttgaaaataaatttttataagagtgaattattttgttttggtcaggcaaaggaatattatgatgagtaattctaacatctttggttgtaagtttggctctctccctgttaaatatcttggtataccaatgcatgttagaaaactaaataatagagattggaaaatgattgagaaaagaattgagaaaaaacttagtagttggaaaggaaaacatttatctgttgggggtagactggttttgattaactctgtactttcaagtttagctatgtttatgatatctttttttgacataccgaaaggggttcttcaaaaaattgattattatagatcatggttcttttggcaaggggatgaccataaaaaaagtagacttactagatgggatatcatttgtcaacctaaggatcagggaggtttaggggttcataacttggaaatacaaaacaagtgtctcctgagtaagtggttgtttaagttgattaacaaggaaggtgtatgtcaaaatctattgaagagaaagtatctctacagtcagtctataacccaagttaataagaaacagggcgattctcatttttggtcaggtctcatgaaggtcaaagataccttcttagatatgggtttttggattgtaaataatgggaaacaaataaggttctgggaagataaatggctaggaaacctggcttttaaagacaaatatacatctttatactctattgtccgaaggaaaagttctactattgctaatgttatgagatctgttccactcaatgtttcctttaggagatcattagttggtcagaatcttgcatattggcacgaattgtgtgcttctattgtacatattcaattgaatcaatcctctgatagctttagatggaattatcatcagaatggaatattttctgttaggtcgatgtatctagctttaattaataatggttatattgagagaaaaaaagattatttggaagcttaagatgccacttaagattaagatttttatgtggtacttgcttaaaggggttgtgctaaccaaggataatttggcaagatgaaattggaatggcagtttaagatgttgtttttgtatgaaaaatgagactattcaacatctttttatagagtgtcattatgcaaaatttgtttggagagcaatacagttctctcttggtttataccttcctactaccatatctaatatgtttgatggttggctcttggaggtagacaagaagaagagtaaactcatatttgtaggagcttctgccatatgttgggctctgtggttgactagcaatgatatggtttttgacaaatcaccatctatctcatatatgcaggtaattttcagggcaacatattggctccgattttgggcacaactgcaaatgtgtgaagatgatcgagatcttatgaaggttgcatgtcgtaggcttgagataacggtcatgcaactccttgcaaactattgatggagattcacaaatagacttgaataaatgtgctctccttatcttagtttgatcttttattttgttgggtgtgtttaattaatttgaactacactcagtgtttgggtgttacttttgtaataattggctatagctctgatgaacaaaggccgggatgttttattccattatctaaaaaaattagaaacttggaaatgtgcatgcacttattcatctatgactatgttcacaagatcaaatcaatccgtatgaaggaaatggttacaattacatgttaactgttcatgtgtggatgcatccaacatgttctcgaaaaaatcaaatcaaataatggatacaaacgtaatcactatatatgatgcaatcaattatattactgtttatagcttgtaaccgtaggttaagccttatccaaacagtattttttttctctgcgctccacctgaattttctgtggtatttctatagtgaacatgaatagaccgaattaactgggtgagcatcacaattagtggatccatcttctttgtacgttaggatatatagcaacaaattgcgtgtcaaagggagaaaagacgaagctgtacgaactcatcttgtgttttctatcatcatcagtcccattttccagcaaatgcatgacctacaatgcatgcaggtcacaaccgtgggtaagtgtaagacaagccgtctccttcatataattttatacctctcaccaaatgttgttcatcgtgagttgcaaggggaggggggacacatgcatgccctaggcaacctgcgcgacgacccggggcctgtggcagaagccccatttagtacttctattgtgtaggacccaaacttccatggacggggctaaggccttggccaatttctagttccgcccttcagaagttcatctacaatctagaaattcggttaatccgtgttgcttagagttcatctcacttgttttctcgatgcctctcattctcagatcttagctgagtacctcaatcttactcttatgacactatgatggttgcacagttactctactaatccttccatcccatcgttatccaatctttcttgtttcacttttataggacaaggatgaatcgtctaggggtgaagagtttgatgggtgtatgtgtttatagtggcatatttattgttcagttggcgtgttaggtcccgtgttcaatgaactgaatgtgaacctttgcacttacgaacatcgggaaagcggtgctcaaatgagaaatatggaaattttgttgtttcgagataagctatgacttaatattcacaaaatcaacatgggagatatagctaactcgttgttgaggaatcgcttactagttttggtgaacactgtttaattttagtaggtatgaaatctcctacaagcgaacttgtactctgattttgcttggatggttagtctcaatttcaataacaaagaagagggcatatgatcaaaatttactttttaatataatagatttatataatccaataattttataagaatataaaaatacttttaagatgacgaatccacacatactattttatatgtttaaactaagtatttaaaaattattgcacttttaaaattttgacaaaataataaaatgtagtaaaattttgacttagccgatagatctatgtgtcagtgtatagtttgttccaaaaaatcatatgttaaaccttaattctaacaattgtgagtctgctctttctgctcaattccactggtcagaattagtttcccgtggcatgtctgcatttgtatacagaatctgaattgacagagttagcatcacaagtgaatacacaacacatttctcaaaatgcccgagacgtactcttgtgaaagctccgatgcaagcggttaatccaattccacggataaagtttgttaaaggggaagtgcctcttgcgtagttcagactattgatccaatttgtgcaatgctagaaaaagacaatgacatctggccaacttgcaagcttgtcttgcttttcctatacatcatctacaatgtctgcaggtcaaagcaccagctgttctaacggctattgatctacactgagttgtttggcactgttcagttcagatgctcttgcgccttcaaacttgttcgatcggtgaggcgtctagtgcttctcccttgtttcctgcatacctctcattctcacccacttacctctcattataatagcactatgatttcttctacaaatataataactctgccccctgcatcaactatagacacacacaacattaatttgtggtcactttgatgcttgcacaacaccttgactagtctttgtttcatactcattgtctcgtcttttttacttctcttttatacagcatgcatctcattgacatcgttgtcaagctctaaacagatactcgtaatgagccaaaatgccaaatattcacatggttgtcaagatcagcgaatgatcaaatgcctcgcacttctttcctgaatgccatcattcttacctgaatgcctctagcttttatggcactctcctgcttgcactacttatcgattaatcccttctatagagtagaatgaatcgtctggaattggagagtttgatgcgtctgtgtttgcagtactatgaatgaagttattgttcagttatatcgtgagaagtcccatgttgaatggactaaatgtgaatttgtgatcctttccatttatgtgcatcacgaaaacaatgtttaaatgagaaatgcaaaattttggtacttttcaaaaaaaaattggggcaaaaccttagtaaacagtaaaatggaaaatattaatctctactgccgaatcgaccgactagttggtacacatggcttatattatatttttagactgtaaaagatctcttacaagcatacttgtactctgcttttttggaattactactaagttctaggggaaaagcagttcatattagagttgatgatgaaatttggattctaaatagagtccaaggaccaaaatgcttctttccaccggtcagcacttgtttcttgtggcatctatacactggcatgtataatctgaattgaccgtgtgagcactgagcatcgtaggtaaacccatcttcgaaaaattctttgataacaatttacttgtacttctgtgaaaacatctaatggttaatctgattccacagataaaaaatttgtttatttaaaaggattgtgtttcttgcaagcttgtgatgctgttcagagtaatgatccaatctgtgccttctgcgagaaaatgacagtaaaaatccaatcaccacgcgcaaggtcatcttgtgtctcctgaaatcatcagtcgccttcatcaaatgcgtcgtctacaatttgtgcaggtaaagcaccactgctgctgagtttgagcaaatagtagattatgtgcttcacaatactatcgaattcacctcagaagtttgtcgccggtgaaatactattgcagcttcaagctaaccgatttagtgacgcatataatgcttctcactcatttcccgatggcctctcattcttgcccaaatacctctaattctaatggcgctctaacttactcaaggtaattctagcatatgccccaattttaatttgtggacagtctaatgcatgtacaacttcagaatttcacgaataatcttcattccatccttgttgtttgatctttcttgcttcccttttatacaaggatggattgtcaggcagtggaaagtttggtgggtttctattttcagtgagaagttattgttcagtaatcatgttatgcacttaggtcccatgttgaatgggattaaatgtgaatttttgcaatttatgcatatcagggaagctggaaaggggtgctcaaatgagaaaccatttttgcttcttcagaagatgacgccggtacaacttttgttattttgatgaaaatttgtggcatgaccttcagaaatatcagaatgggaaatttaggtcactgccaccaaatggttctctgctccacctgattctgtgtctggtacttgacaaatgatcattctgagtcgggtcgtcttgaatccggaagatcggttcatcggtgacctatcaagtgcctcccacttctctccggggactcctaactagcgcgtgctcgctgctagcgagcactctttccctattaactacctctattaacactattacttaatatacttaactacctctattagttaatatacttaacactaaagatagtaattaggaaagattcaggagatgtttttactaatagattgaaaattttttaagttacatttgaaaattttcgatttaaattttaaagtcaaattttaaaaactttcaactcagatttgaaaactttcaactcaaattcgaaaactttcaactcgagattcgaaaactttcaagtccagatttgaaaaatttgaaaactttcaatttgagatttgaaaactttcaactcgagattcgaaaactttcaagtccagatttgaaaattttgaaaactttcaactcgagatttgtaaactttcaagtccagatttgaaaattttgaaaactttcaactcgagattcgaaaactttcaagtccagatttgaaaattttgaaaactttcaaatcgagatttgaaaactttcaagtcaagatttaaaaactttcaagttcaaatttaaaaattttcaactcaaaatttaaaactttcaaactcaaaatatgctaaagattaaaaaaataatcacaaaaaaaggaaaaagcgaaaaaaaatgggtaaaaaatgaaaaaaaaaaaaagagtgggaggcgcgcgcgccggcgctgggccttatgggccagaaatgcgcgcgcggcgcgcgccgattagcaatcgcgcttttctcctgactcctgactgcatctcattccaacatggcactctgatgcttgcaaccactcctcgattaatcctgttccatctccattattatctaatctttaatctctctgatttcccttttatagaccacgttgaatcgtccggcattggagagtttgatgtgcgtgtgtttagaatattatgaaattattgttcagttacattatgaagtcccgtgttgattggactgaatgtgaacctttccttttatgcacatcaggcaagcggtgttcaaatgagcaatataaaataaaatataacacactaacacagatctttctatctgtgacggcctctaacaagcctagaaatagcgggccatcacaaggaagtcatctcaatcggaccaaaaagtgtccgattgagatatgatcgcacagacatattagatgggcataaaacttaaacccgtcacggataacacctatcagtgacgggccgtagtttagtcccgattgagataacattccacatctcaaacgggcctaaagttacggcccgtcacagatgaccatcatatgtgacgggcaccaactttaggcccgtttgagataacattccatatctcaaacgggcctcaagttgggacccgtcacagatgaccatcatctgtggcatgcaccaacttgaggcacgtttgagataacaattaggcccgtcacagatgactcatcagtgacgggctatatactaatgtccgattgagatgacttaatctctatcgggcatgaactaaagcccgtcaccgatgagtacttttccatttttcatatgaaatgtttatatttataagctgaactgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccatcccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagccccctagcattgggcaccaaccctctgccgtatgacatctcgactaccgggccgcagctcgtgtagccttcatttgccctggagaatgtccatcgacccccgacttcatccatctccaatccgtgtacttttgtttatgaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatgttgtcctattaatcagcgaagcatctacctaaattcatactagtggaaccataaatagagtgtccactagttggggttttgtttattctagggtgaacaaggtaataataacaataacaataattgtatggtcataacaaaggtaaataggcatggctaaataaaacagtgataacgcgggaatttaaataaagcgataatgcattaatttaaattaaaaataattttgtaaactgggattcaacatgctcaaggatgatgtgacttgccttgctcgctttcccaaacgacggcttcaacttccacgaagagcggatcttccgaaactgcagcgtctacacgaccaacggaaaagaaaaggcttaaacactaaataactccacataacagcagaaacaaagcacaaaaatgggttcttgacttcttaaggaaaaattagagacttgaacggtccaattccgagttcaaatggccaagatatggccctttgaagtttatatgctctttaaatggatatttgcgaatttcttcatttaaattttaattaaaaatcccatttattgcgtcagccgagggagggggcgcgcggaccgggtccacgggggtgggggcccacgcgtcagccccacggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgacgagaacggcggccggagcggaggaagacggcggcgcggctcgggatgacgatggcgacggcgctccgacggtcggcgagcgaaacggaggcgcggacgaggtcgacggcgatgcggcgatgccgagggaggtggcgccgagtaaggaggaagtccggagcggcggcggcggcggaacggagctcggcggcgatggcggagagagcggagcacggtgcgagcacgaatccgacggcgagagcgagcggcgagcggcggaaacggaagagcggagctcgggcaacgtttaaatagcgccgggggaaggaaagagcggccggagagggaggaatcggtcgcggagatttcggccgccatagatgcgccggcgatgaatgcgggaaggaaatcggacgaatccgagggagagagagaggggaaaacgggggaaacgggagagggaatcacggggagtgattcccctctctttaatgcgcgcggggacggcgggatgcggcgcaatccgcggcggcggcggcgctaaggcacgggcgcggcggcgggcgcggcgggaggaaggcgatgacaggtgggtcccacccgtcagcgagagtggcgggcgggcccgcctgtcagcggcgcacgcgcgcgggggaggccgatgggccgcgggggaggagagagagagagggagggagaagtgggccgagccggcccaagagggaagggggggggggaaaaagaacttcttttaagattttctttttataaacctttttaactttgtttatttcttctcaattattatttgtgctctgaaaattccactaaaatttgagggctcctttttgaccaaggggaatttgacaaaaattctccgggccacatttgaatttttcttgtacgtattttagtgtttgccaatttcttttcgaattttaattaattctattattccttttagagaatgatttttaattcgggatgaatttatcaggacgtgacaggtcggtactcttgtctatggctaggatgggttggaaactatgtcacgtcttccgtccgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtaccccaagtagtgttttaattcttaaaacctgcttaacaactaaaacgtggaatggttggcctgggttggcttgggacgagctgggacccaaggtcaggttgccagatcggtctgaatcatcataagcctttggttaaggccgggttcctgtgcggtcacggccttgattaataacattgtatagttctaggatcgtgtttacaaaatagctttgagcaactaaatgtctttaaatgctgtttactgcaactctaaccctttatattataattcccttgtactcccttgcatttattctgcatttgtgggtgtgtcttgttgagtacggtggttgtactcagtcttgctcaattttttcccaagcccagaagaggagctccttgaagatgaaggctttggtgtctagctcgtgcctgccgtcaagcgcctgtggtcgtcgccctagtcttccgctgtttcccgtttgtctttgtgtgtgctgggccttcgctgcccatgtaataagttaactatttacgcttccgcttgttaaactctgaattgtatcaacttttggtgtaccttgcctcctgggacaaggattaatgcacgcacgtcagggacgcccgttgggttatttccggtcgtgacagtggcttccttggttggaccggaactgcgctacctttctcttcctgtccattttgttgcgctgatcttcctgacagattgccttgtcaaccagcttctcaaagtcggcgtagtctccagagattaactggttggtcagctcgtcatccaggcctgctaggaacttctcctgcttctcggcgtcggtacggacatcctccggtgcatatcgcgctagacgattgaactcatggggatactcagtcactattctgttgccctggtggggtgcccggaattccctcttctcctctgccacaaccccgtctggcacctgcgccttcctgaagctacgacagaactccgcccaagtgacttctgtgcctggcgggtgggtagccatgtgattgtcccacaaagctgacgcgggaccctggagctggtgtgtggcaaaggcgaccttgtcctgatcattgcactgcataaggtttagcttcttctctatggcatggagccagtcattcgcctccatggggttggtggtgctagagaaaatgggtggcctgacgcgtagaaactccggcagtttggactaagggggaggaggaccaaaccgctgctgccgttgctcggcttgctgatgcatcctctggtgcatctgctggtgctgctgctacatctgttgcatcatggccgccatcatctgggtcttatgggccatcacttgtgcgagcgtcgggttctctgggagcggtggcggaccgttgctagaggcgctgttggggtgtccaccgtcagtgcgttcttcaccgctgctgcccttacctgctgcacggctgccattcctggtgttgaccatctgaagggagagcaggcgggggaagaaaaagaaaataagaaaaacagatgctcaggagctaagctttattatataggaatttaaactgcaattgttctgatctgaattaaaacacttaaaacggcaagcaaaatccttattaagacagccatatcataggcacatgatatcgaccatcgactgacccacaagcgaacaaacctagacacacaaactaacagacaattactaagcagtcggtaaactaagggaaagcgagcctaatgctcggaacggctcctgcagtcggtggagtcgaaggcgtcctcctgctcgtcaccaggtccctctgagcggctcctggagtctggcagatacgtctcgccgctgcccggctctgtgccactagaactgctgctgctatggtcgcggctgccactaggagtagcaggtaaccaacctccgttgccaccggttggccccctgacggctgacgctggagcgaaggagagagcggatgcgggagctgacactggagcaggagctggggctggagctagagctgcgggcactgcaggaactgcgtgagctgcgggaactgcgggcggatgtgggttcctgggcgcgagctgaatgcgcacaggtgacgtcgtcgacttgcgggacgtgttgctgacccggactcctccgggaatggggagacccttcaactgagcattctccttcttcaagcgtgctatcttatccttcagagctatgatcctcacgagcttcccgtcattcaaggccttggacgcctaacgcatatctgagtgcatcctgtccattcccctcattacggcacacatgtgaccaaaggtggtgtcgttctcaccggctatcggacggaaggtgttgacgtcatcgccacttgcttgacgagggtgaaaccggtacgccgtgttgcagaagatgtagttgtggcgctcacgaagtctggccatcatcaggtatgctgcctcctgacaggcgtgatctgctgtgcctccagatgcctcaaccaccatgttagcgaggcaggtgcccacatagccatgaacctccagacgaacacggtgaggaaactcgccactgagcggcggaacagtcgagtactccggcgcgttggggtagctcaccaccagtgtcatgcgagccaactctgccacaaagtcatccatgccttctccacggtggttgggtgggtgatcggctatctagagaagacaaaggggtaggatcaatgcatgctcaaatccaattttaatgaagcagtaaaagactcaaattaaataggcgaataaaagcggaattttatacacagatcatttgttttgcatgaaggcgaataaataagacggacttacatagcgataaaatgatgagaaaattaggtacatattaataataataataataataataagagcataaataccttgcaacccatattcctgaattaggacctaatgcattcctcccatcaaatcccgattgactgtcgaataaatctcaaacagtttcactaaaaccctagactgacctgatttgacaaatctctctttaacgagcgaccaagatttttcccttgaaccacaaaaacagatcccaaatttcccagaacaaatccaattgcaaagaacatatgcaatgaaaaggattcagagggctcttaggttttcccatttggcttgtcctacggtcaaggtcggctctgataccaacttatcacgcccagaaattcccgaatagaattccaagcagagtgtgcattaaaatccccatccaggacaggctggggtacacaaacgacaaagttgacatacagatccacgtcttacaaacattataaaagtcttacataagtgcagtggaaaaacaaaagataactggagctaagccttgacttgaacggcagcgggaacaccactccacaggcatcctcaacagcacggacgaagcctactcctcggagaaaccaccatctgacgcatactcaaactctagggttggggaaaaatagagcaagactgagtacaacccactgtactcagcaagtcataccggaaccggggtatgctgcaggatattgccaaaggatagctagagaggttcttttgcataaagcgagcatttataaacagtagttgaaagcggtaaaacaattgtactaattaatcaatattaaccatccactgttcaacgctacaccacattgtaacaggcccaaccaataacctgaactaatcagttccatcagactacactagggggagactaatcccggcgaatctggttgaccggccataac

SEQ ID NO: 59569 - DNA, 16841 bp, Oryza sativa
  unsure (1)..(16841): unsure at all n locations
agatgatcgagatcttatgaaggttgcatgtcgtaggcttgagataacggtcatgcaactccttgcaaactattgatggagattcacaaatagacttgaataaatgtgctctccttatcttagtttgatcttttattttgttgggtgtgtttaattaatttgaactacactcagtgtttgggtgttacttttgtaataattggctatagctctgatgaacaaaggccgggatgttttattccattatctaaaaaaattagaaacttggaaatgtgcatgcacttattcatctatgactatgttcacaagatcaaatcaatccgtatgaaggaaatggttacaattacatgttaactgttcatgtgtggatgcatccaacatgttctcgaaaaaatcaaatcaaataatggatacaaacgtaatcactatatatgatgcaatcaattatattactgtttatagcttgtaaccgtaggttaagccttatccaaacagtattttttttctctgcgctccacctgaattttctgtggtatttctatagtgaacatgaatagaccgaattaactgggtgagcatcacaattagtggatccatcttctttgtacgttaggatatatagcaacaaattgcgtgtcaaagggagaaaagacgaagctgtacgaactcatcttgtgttttctatcatcatcagtcccattttccagcaaatgcatgacctacaatgcatgcaggtcacaaccgtgggtaagtgtaagacaagccgtctccttcatataattttatacctctcaccaaatgttgttcatcgtgagttgcaaggggaggggggacacatgcatgccctatgcaacctgcgcgacgacccggggcctgtggcagaagccccatttagtacttctattgtgtaggacccaaacttccatggacggggctaaggccttggccaatttctagttccgcccttcagaagttcatctacaatctagaaattcggttaatccgtgttgcttagagttcatctcacttgttttctcgatgcctctcattctcagatcttagctgagtacctcaatcttactcttatgacactatgatggttgcacagttactctactaatccttccatcccatcgttatccaatctttcttgtttcacttttataggacaaggatgaatcgtctaggggtgaagagtttgatgggtgtatgtgtttatagtggcatatttattgttcagttggcgtgttaggtcccgtgttcaatgaactgaatgtgaacctttgcacttacgaacatcgggaaagcggtgctcaaatgagaaatatggaaattttgttgtttcgagataagctatgacttaatattcacaaaatcaacatgggagatatagctaactcgttgttgaggaatcgcttactagttttggtgaacactgtttaattttagtaggtatgaaatctcctacaagcgaacttgtactctgattttgcttggatggttagtctcaatttcaataacaaagaagagggcatatgatcaaaatttactttttaatataatagatttatataatccaataattttataagaatataaaaatacttttaagatgacgaatccacacatactattttatatgtttaaactaagtatttaaaaattattgcacttttaaaattttgacaaaataataaaatgtagtaaaattttgacttagccgatagatctatgtgtcagtgtatagtttgttccaaaaaatcatatgttaaaccttaattctaacaattgtgagtctgctctttctgctcaattccactggtcagaattagtttcccgtggcatgtctgcatattgtatacagaatctgaattgacagagttagcatcacaagtgaatacacaacacatttctcaaaatgcccgagacgtactcttgtgaaagctccgatgcaagcggttaatccaattccacggataaagtttgttaaaggggaagtgcctcttgcgtagttcagactattgatccaatttgtgcaatgctagaaaaagacaatgacatctggccaactgcaagcnntgtctgctttttcctatacatcatctacaatgtctgcaggtcanagcaccagctgttctacggctatttgatctacactgagttgtttggcactgttcagttcagatgctcttgcgccttcaaacttgttcgatcggtgaggcgtctagtgcttctcccttgtttcctgcatacctctcattctcacccacttacctctcattataatagcactatgatttcttctacaaatataataactctgccccctgcatcaactatagacacacacaacattaatttgtggtcactttgatgcttgcacaacacctagactagtctaaatttcatactcattgtctcgtcttttttacttctcttttatacagcatgcatctcattgacatcgttgtcaagctctaaacagatactcgtaatgagccaaaatgccaaatattcacatggttgtcaagatcagcgaatgatcaaatgcctcgcacttctttcctgaatgccatcattcttacctgaatgcctctagcttttatggcactctcctgcttgcactacttatcgattaatcccttctatagagtagaatgaatcgtctggaattggagagtttgatgcgtctgtgtttgcagtactatgaatgaagttattgttcagttatatcgtgagaagtcccatgttgaatggactaaatgtgaatttgtgatcctttccatttatgtgcatcacgaaaacaatgtttaaatgagaaatgcaaaattttggtacttttcaaaaaaaaattggggcaaaaccttagtaaacagtaaaatggaaaatattaatctctactgccgaatcgaccgactagttggtacacatggcttatattatatttttagactgtaaaagatctcttacaagcatacttgtactctgcttttttggaattactactaagttctaggggaaaagcagttcatattagagttgatgatgaaatttggattctaaatagagtccaaggaccaaaatgcttctttccaccggtcagcacttgtttcttgtggcatctatacactggcatgtataatctgaattgaccgtgtgagcactgagcatcgtaggtaaacccatcttcgaaaaattctttgataacaatttacttgtacttctgtgaaaacatctaatggttaatctgattccacagataaaaaatttgtttatttaaaaggattgtgtttcttgcaagcttgtgatgctgttcagagtaatgatccaatctgtgccttctgcgagaaaatgacagtaaaaatccaatcaccacgcgcaaggtcatcttgtgtctcctgaaatcatcagtcgccttcatcaaatgcgtcgtctacaatttgtgcaggtaaagcaccactgctgctgagtttgagcaaatagtagattatgtgcttcacaatactatcgaattcacctcagaagtttgtcgccggtgaaatactattgcagcttcaagctaaccgatttagtgacgcatataatgcttctcactcatttcccgatggcctctcattcttgcccaaatacctctaattctaatggcgctctaacttactcaaggtaattctagcatatgccccaattttaatttgtggacagtctaatgcatgtacaacttcagaatttcacgaataatcttcattccatccttgttgtttgatctttcttgcttcccttttatacaaggatggattgtcaggcagtggaaagtttggtgggtttctattttcagtgagaagttattgttcagtaatcatgttatgcacttaggtcccatgttgaatgggattaaatgtgaatttttgcaatttatgcatatcagggaagctggaaaggggtgctcaaatgagaaaccatttttgcttcttcagaagatgacgccggtacaacttttgttattttgatgaaaatttgtggcatgaccttcagaaatatcagaatgggaaatttaggtcactgccaccaaatggttctctgctccacctggattctgtgtctggtacttgacaaatgatcattctgagtcgggtcgtcttgaatccggaagatcggttcatcggtgacctatcaagtgcctcccacttctctccggggactcctaactagcgcgtgctcgctgctagcgagcactcttcccctattaactacctctattaacactattacttaatatacttaactacctctattagttaatatacttaacactaaagatagtaattaggaaagattcaggagatgtttttactaatagattgaaaattttttaagttacatttgaaaattttcgatttaaattttaaagtcaaattttaaaaactttcaactcagatttgaaaactttcaactcaaattcgaaaactttcaactcgagattcgaaaactttcaagtccagatttgaaaaatttgaaaactttcaatttgagatttgaaaactttcaactcgagattcgaaaactttcaagtccagatttgaaaattttgaaaactttcaactcgagatttgtaaactttcaagtccagatttgaaaattttgaaaactttcaactcgagattcgaaaactttcaagtccagatttgaaaattttgaaaactttcaaatcgagatttgaaaactttcaagtcaagatttaaaaactttcaagttcaaatttaaaaattttcaactcaaaatttaaaactttcaaactcaaaatatgctaaagattaaaaaaataatcacaaaaaaaggaaaaagcgaaaaaaaatgggtaaaaaatgaaaaaaaaaaaaagagtgggaggcgcgcgcgccggcgctgggccttatgggccagaaatgcgcgcgcggcgcgcgccgattagcaatcgcgcttttctcctgactcctgactgcatctcattccaacatggcactctgatgcttgcaaccactcctcgattaatcctgttccatctccattattatctaatctttaatctctctgatttcccttttatagaccacgttgaatcgtccggcattggagagtttgatgtgcgtgtgtttagaatattatgaaattattgttcagttacattatgaagtcccgtgttgattggactgaatgtgaacctttccttttatgcacatcaggcaagcggtgttcaaatgagcaatataaaataaaatataacacactaacacagatctttctatctgtgacggcctctaacaagcctagaaatagcgggccatcacaaggaagtcatctcaatcggaccaaaaagtgtccgattgagatatgatcgcacagacatattagatgggcataaaacttaaacccgtcacggataacacctatcagtgacgggccgtagtttagtcccgattgagataacattccacatctcaaacgggcctaaagttacggcccgtcacagatgaccatcatatgtgacgggcaccaactttaggcccgtttgagataacattccatatctcaaacgggcctcaagttgggacccgtcacagatgaccatcatctgtggcatgcaccaacttgaggcacgtttgagataacaattaggcccgtcacagatgactcatcagtgacgggctatatactaatgtccgattgagatgacttaatctctatcgggcatgaactaaagcccgtcaccgatgagtacttttccatttttcatatgaaatgtttatatttataagctgaactgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccatcccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaaattataaaaccacctaatgttgcctaatgaatcagcgaagcatctacctaaattcatactagtggaaccataaatagagtgtccactagatggggttttgtttaatctagggtgaacaaggtattaatatcaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcgacttccacgaagaacggatcttccgaagctgcagcgtctacacgaccaacggaaaagaaaagggcttttactctaataaactccaaataacagcataaacaaagcacaaaaatgggttctttacatcttaaggaaaaattagagacttgaacggtccaattccgagttcaaatggccaagatatggccctttgaagtttatatgctctttaaatggatatttacgaatttcttcatttaaattttaattaaaaaatcggattattgcgtcagccgagggggcgggcgcgcggaccgggtccacgggagtggggcccacgcgtcagcctctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgatgagaacggcggccggagcggaagaagacggcggcgcggctcgggatgacgatggcgacggcgctccgacggtcggcgggcgaagcggagcggcggacggggtcggcggcaacacggcgaagcggacggaggggtcgccgagtcggaaggaggaccggagcgacggcggcggcggaacggagctcggcggcgacggcggggagagaggagcacggcgcgagcacgattccgacggcgagagcgagcggcgagcggcggaaacggaagagcggagctcggggagcaattatatagcaacgggagggagagagggcggccggagagagaggaaacgggcgcggagatctcggctccattgaatacgccggcgaggtttgcgggattgattccgagcgaatccgagggagagagagaggggaaagagggggaatcgggagaggggattgcggggaataattcccccctcattaaggcgcgcggggaaggcgggatgcggcggattccgcggcggcggcggcgctagggcacgggcgggcggcgggcgcggcgcgaggagggagatgacaggtgggacccacccgtcagcgagggcggcgggcgggcccgcctgtcagcggcgcgcgcgcgcgggggagaccgatgggccgcgggggaagagagagagggagggactgggccgagccggcccaagaaggaatgggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttgcgtcttgacaaacttccagcaaaacttcaccactcggaactgcttggcttgacctcctgttgaggatggaatcttctcttcacctgacttggaccagggtgcaccttttggctgactcagactaggttgcggtagtgcagtgatgcttccgttccagaacttctcatgattcctatcttcggagtcaacctcagacaagttaccacttcacgtcatgcgtcaacactagcttgtcattactaggatactatgtttgtcatcataagaatatcatgcttgttattcacttctaacttgccatcaactgtctcatattagctttcctggtctccggtgctaggtacttcggctattcgatgcaagggtcaaccactctaactataagttatgcttcccaagagaaccaatttatcccacttgacatactttgacgtcttctccaatggctgtattgctggatttgttattgtctaatcattaccctgtcaaatctgaggcttcgttgtaagaggtgattttaatctgacctctatagactatcttcgaacatatcactggttctataactgggaatggctctcacgaacaagcagctcggattcactttctttacattcagtttacttcccattattatcttcaggttgtcctcagttagtattcaacgtattcctttacacctttaaccttgatgtgttctttcccattggatcatctcccaagacttggcattacctggtaaccggtgcttgcacttttcacttcgtgtagcatctgataccgagtggaagatttcactctttgccttcatagaaacacttttacctaggtcatcttgctgacttaatgacaaggtgactgttgcggggcaattacaatcaggggtcttccgtgagcgatgcagagcatgtttctgtttatcaatcacctttcggcctacttcttttatgctggagaacatctttgccaatctcttttatcaatcatctttcggcttatctctaacaggtggtattctttaatgtgggttgcggacgcttctggggacgatgaggtcctttggcttgctgcctttcagtgaaaccttgatgtggtttgtcaaaaagctgcactgactaccttcagggaaatacattgcttgctatctgtatctatgccactagggtttagtgcttcctcgagatggggagcatccatattgttcttctgccatatcacctttgacccttttctgatacctgatcgactaactaccaaccattgactattatgttctcgaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatcctcaactactgtctcgttggctttttaacccaacacagtttaattgtttttcttttccatccacaggttggttattaactcgaggttagaatatagttcctctgacacgagaccctaggtctcctttgtcagtaaacaattatacacatgatcacatatccgcatctttcaaaagaatcctcttagaacttgtctgcattacacatttctcccttattacacgaatacaaggcactgccttaaacaaaaagagacggtgcttaacatcggtacattgtatcctcaacatgaatcatccataagcatagcaagctcactgtttatagacatgaatatatttatgtattacatgattgctgcaaactttcgattacgcaatgataggtagcgaactgaaaaccacaaacacggctgctcattttgattccggagagatatagctggcattgttctagtgactgcatccttgattggttctgtgatgatgtgataggactgcataatgctatcattcacaggagaagattccttctgattgctggttgaagcggatgacggtcttctgcttggtatcgccttccggaggttgattgcccttggctcggcctggagtaggtcggggagagacacaacttcttccatctacgacaattctttgctgaggctgtcgatgcagagagtggttgctatgatttattgccgagtcaggtgcagcaggaggagcattggtgcattgtttctgctataggttctgattatcacgaggccttacgggtacggcgtttgctccagtgaccacaatacgattggaatgtctgcttcgtgtaaattggcggtaatgtggaggtcgattttgccttggttggggacagttttcggagtaatgcccttcttcactgcagttgtaacaaacaataactttcttacactcgggttcttcatcttgtacttgatttctcagctgctgtattggaacctccaaaggtacaacgcagatactggcctctgtcttgtcagctggtggctggggctgaaattgagcattgacaccttgtggtagtgcattcattggaattggagctgttgcaacgcgggctataggactgcttcgggatgcatggatgacaattcgttgaggtgcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactgtaatcttggcgaggattggtgttgccttgatgcttctctccgttggaactggcgggttggttagccatcttcttcgtcagcagaaaactgaattgacaatcttttggtacatgatcagttccttcacaaaagaaacaagtgatcctgctcgttggacacctgtcgggtggatggtcttcctcgcaatgaacgcatatagtggcacatgagctggcgacatgaccgatttctccacaacgagagcatgccttacgttccatttcatcttcatcatctgaggagacttgatctgaatcttcactatcagacactctacctccattagctaaaagatgctctgtcaactgtggtgcacctcggaaggtatttcttctctgacgtctggtcattcctggtggaggccattctgtgctagtaatgatcatcttacggacttcatcttcggttcgcattggtgtttttcttttctgctgaggacgctcccttgcatagtgcccttgctcctcacacataaagcaaatgttacttgcttcttttgggtcaacatgtggcacgtcaccatgggtccttcgggatgctggcggcatgctgacttgtggtgtgagtgcttggactgcctccaactgcacttgaggtcgtatttgactcgggttcagaattggcgtctgatgctgctgtagtatctctataagcaatcggttctggttaatcaggtgttggaccagtgtcacacaactggtgtctggtgcttcattcactcgggagcttaaggtactaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaacccactgatgcaaaccacgcgctacacacacaagcaaggaaacacacgacaaacgaaacactagagggtggcttaggttctgcgacgggttctccaagatcttcgctcctgcttcacagctggcttcactgcttcctttgcttcgctagcggatcctgcagccttctggagcgtcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaatacttttatttataaaatatgtccttaggttttatccacttggcttatcctacagtcgagatggctctgataccagcttgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagtcacaccggcagatgcatggttaatgcaagggggtacaaggagtaataatataggggttaagttttgcagaaaagcggcatttataagtcacttagttgcccaaagctattttataaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccatcccatattttagttgttgagcaaattttaagaattaaaacactgacttgggtacattgctaggcttgcccatatccgagggctcggctattcgaatagatttactctgatcagaggtgtacatctttacccacaagacacatcttcctcacgtgttgccacgtgccacataccaccacggtatacggacggaagacgtgacatagtttccaacccatcctagccttagacaagagtaccgacccaatcctacctacggccgggatacccgggacaggcaggcagaactgagcccctagcattgggcaccaaccctctgccgtatgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctactttccacaactggcatgcacccaaaccccaccgaaaacaggttttaggggttttgaaagaggaagagaggtgtgtgtccaattccaacataagccaaccattccatagtgtccaaatgatatgagaattcccaaagtctaaaattataaaaccacctaatgttgcctaatgaatcagcgaagcatctacctaaattcatactagtggaaccataaatagagtgtccactagatggggttttgtttaatctagggtgaacaaggtattaatatcaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcgacttccacgaagaacggatcttccgaagctgcagcgtctacacgaccaacggaaaagaaaagggcttttactctaataaactccaaataacagcataaacaaagcacaaaaatgggttctttacatcttaaggaaaaattagagacttgaacggtccaattccgagttcaaatggccaagatatggccctttgaagtttatatgctctttaaatggatatttacgaatttcttcatttaaattttaattaaaaaatcggattattgcgtcagccgagggggcgggcgcgcggaccgggtccacgggagtggggcccacgcgtcagcctctcggtccacggtggaccgggcgcacgcggctggcggcggtcggcgccgtgggtcccgcgcgtcagccgcacccgcgggcgcgggcggctgacggccgggcccacttggcagccgcgagggcgcgcccgagggcggcctcgccggcgcggccgacgggagcggcgcgcccgcgccccgatggtcaccgccggcgaccaccggcgcggcggagcggcgcccgagagagaggagggaagggggaaggcgaacggcggtcctcggctcaccccgggacaacgacgacgatgagaacggcggccggagcggaagaagacggcggcgcggctcgggatgacgatggcgacggcgctccgacggtcggcgggcgaagcggagcggcggacggggtcggcggcaacacggcgaagcggacggaggggtcgccgagtcggaaggaggaccggagcgacggcggcggcggaacggagctcggcggcgacggcggggagagaggagcacggcgcgagcacgattccgacagcgagagcgagcggcgagcggcggaaacggaagagcggagctcggggagcaattatatagcaacgggagggagagagggcggccggagagagaggaaacgggcgcggagatctcggctccattgaatacgccggcgaggtttgcgggattgattccgagcgaatccgagggagagagagaggggaaagagggggaatcgggagaggggattgcggggaataattcccccctcattaaggcgcgcggggaaggcgggatgcggcggattccgcggcggcggcggcgctagggcacgggcgggcggcgggcgcggcgcgaggagggagatgacaggtgggacccacccgtcagcgagggcggcgggcgggcccgcctgtcagcggcgcgcgcgcgcgggggagaccgatgggccgcgggggaagagagagagggagggactgggccgagccggcccaagaaggaaggggggggaaaagaggacttcttttagggtttttctttttataaacctttttaactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacatgaactatagcgaaataattaagtgcagtataataatttattttatgagtcaaaataattttacgggtagtaaatgatttcaaatggaaaaaatgtcaacaacaaagttgtctaacttatcaatatttacaacttttagtttggtcatttttctatataatattttttgaacagtttgaatttgaatttgaaaatatgacaacttcaaacaacaatttcaaatactaaatgattccaattgaaaaagtcatcaacaacaaagttgaataactcatcaagatctaaaacttttatttttgttatttcttcatccaacaaaatgttagtaacattattcataaattttacatatatgtgttataatttataaaacagataagagatatgtcaattttgtgaacaatgttactatcactttgtcgtatgaagaaatgatcaaaataaaagttttagatcttgatgagttattcaactttattgttgatgactttttcagttcatat

SEQ ID NO: 59570 - DNA, 7817 bp, Oryza sativa
ccatgcccgacccgatgcccgacattgcccgctcaaaccctacccactagagttagcgggcaaaactccgtgcccgtacccatgtctggcgggtgcgggtatgtctgacgggtacccaatggatctcgcatgaataataacttgaaagatatgtaatttaacaaagagaaataaaattaataatttaccaaattattggttatcaacaataatttgaattacatcacaacttagtatcagttagcatcacaaatgaaccgagagaaatggtataagaattaagaaatgagtcaaaattagctaatacatatgtatcaggtcgggcatggattacccacgggtaaaaaaatgaaacccgcctattgcccataacgtcttcgggtctcggacggacgtgcccatggataaaaaatcattaccacgcccatgcttatcgggtacccgaacccatgggtaaaattgccatccctaatagagtctccaataaagggaacatgcacgaaccagatttcgtgaagaaaatactccctgtgtgaggctgagcgtgtctccagtcacacaacaagtttgggggtttttctcaacttatctattatatactaaaaatccattaaacttcctacaaacgctcttaagccgccacgtgggattcctacaaacgcttctaagctgccacttggcgttctaatacattagaaacatctaacccttgattttcatttaaagattttcatttaaatttgtaggtctattattttaattattttagaccattagattagattaaattaaaaacagaattaatccctccctgacgtgtacgtgtatctcgcacgtacgtacatacttgattcctctttttcctccccattcaaaacgctctcaaagccgtcacgtgggatccttcctacaaatgcttctatgcgcgttctaatacattagaaacatctaacccttaatttttatttaaatttataggtctattattttataccattagattagattagattaaaaacagaattaatccatcctgacgtgtacgtgtatctcgcacgtacgtacatacttgattctctttttcctccctccccccccaattcacctctttttttattttttttactagatataccgccaaaatatatttatatcacctccaatttctacactattgatttttgatcatatgttttatcctaagccgctacgtggcactcatacaaacactcataaaccgccacgtgtcactttctaatctagccgtcgattttcactgaaattggtggacccactattttagaccattaaattagatctatttaaaaaagtctcagcttcatagaaattatttactaaaaaaataacgtacatgttatctaaaaaaaccaaacagacatcctgacgtagcaagatgaaaaagccaaaaaaaaccatatgtacgctgtaagaacaatacggtctttaaaatagcatttcctatattctacataaaatttattactccacaaatatgtacggttaatataaaagtaccaaatcagctatctttaaatgctcatcttttaaattatttttcaaaaatatatctaacttataatcctttgtattttttaattaaataaaatactgatcacttataatagttatatggaactgctaaattcattacgacacatggtgccgacatataatagtccataaaacttcctacaaacgttcataagccgccacgtggcactttctaatctaaccgtcaattttcacttaaattggtgtacccgctattttaaaccattagattagatcagcttcatcaaaattatttaccagaatcaataacgtacatgttctcctaaaaaaaccaaacagacatccttacgtaaaaagataaaaaagccaaaaaaaaccatatgtacgctgtaagaacaatatggtctttaaaataggatttcccatattataaaataaaatttattactccacaaatatgcaccgttaaactagattattaatataaagtaccaaatcagctgtctttaagtgctcatcttttaaattatttttccaatatatatctaacttataatcctttatatttttttaattaaataaaatactaatcacttataatagttatatggaactgctaaattcatcacgacatatggtgccgacatataatatgtaatgtcataattatttttcaaataatttagctaacatataataattaatgtcatgatcatttttaaaataatttcacttggtgtcaaatttgcttgacaaatatataacactaattcatatctacatgaagaaaaagtgaaacaacattgtggtttacaattagatttgatttaattttaatttatgtgagattaagattatcttttcttaaaaaaatttagaactatttgattggaatttccaggcagagatcttgctataatacgaccccttaatccatcacgagaattatggtcatatatagtttttctttcgaaattggtttggtaacaaatgaacaatcatgtgcattaaactattcatcatatatgttttatcgtttagaaattctaatatatcgaacataattgatgatgtatgtcatacaccccactgaagtgactataagtgtactccaacaaattagttactttaaatgattttgggaaatatattcttagtaaagatgtcacatgtaactatgaacaatacatgatgaaaataaaccggacgctaaacaatatatcttagtcaaaatataaagaatgatatggtactcgaagattgtcacggtcatatgtcagtatagctatatttttttattaacctcgctcattttgaaagatagtattgtatctacacagtaaaaaaaataagcattaccgattaataccataaacaattttgtctacacaaaactttttaaaaaaatcattcgaaaaatattttcatcacctacattccctcttttttttccttaaagggcaccaagcatgctatgctagcacaagtatagcaagggtcatacatatggatgagttgaagccgccccagcagaagaccactattgacaataatgctttactttgtaattactgatgctattatctatgagggtgctgatagtgaactagaaattgaaattatgcttcatgctgatattgcagcgcatgactatgtcgacttagaacctatgtttaaaggtagtggagaaataaagcctcgacggatatggttggcttcacttattaaaggggacattcatatctgattttaactgtcgtcaaaattacaaaaaaaaaccttacaaattataagaaaaaaaacaaatgatcgtcggtttgcttaaattatttataaaaaataagaaaaataaagtccccaaacctcgtcctccccggcacatgcacacaacattgccggtccccttcaaccttggctcacgctctccgctctccattcctcccccttcctactttttagctatcaaaccacactatgaataatactgaaaagaccatatttttaagatatacctcgaatttccaatctaattgttgctatattaaataattaaaccaacaattccttatccataatgtcaatagggattgaattaaatcaattagagagaatctaataaatttgtaaaaaaaaattggaacgacaattgtatgttccattgccataaccatgtttagtattatgagtttctcatatattattgcatatataagacatactaaggcagcatgatgtagaagtacttagttggttaaaagagttatatatatgctactatcagctttaaatttaggactcacattgactaggtattgtttttaaaagaacactataaatgacatatataatagggaaacgaggcgtacaatatatatgtctcttatgtatttattgactcaaagaaaataacgaagatcattgataattgcttatagtaatgaattaaatattatatagttcaaatcttataaatatcttgtaaaaaattatctaagcaatatcgatgaagaaaatttataaagaaatagtactttaatttcaagcgtagcaggtgtcattcgattaatattctaccttacatgttactcaagcgtaatctactttacatgcccgcgcaaatgcgtgggctaccttcctagttaaattattaaatgtcgtgggctcctttaacctgttgttcgaatttcttttttatattccaatgtgcccttggatacaataaaccaatactagttcagtagaatgttgtccttcaattattgttttcaatgcaagttttagatacgaaaatgccagtcaagtttgtcgtaataaatgatttcataatcataaaattgtaaagattttcccctggtttatgcaacataattttgtgatggaagccgcagtaccgtatctttgttgattctgaaaggtaaacggcaactctctctttcttttggtgacaaaagattgtatgaatgaaatctctgatcagttaagcggatagtgtttcttcaaaaaaataaaagttaagcggatagtcttcgttgaaaaaaattttaaaaaaacatgaaacgaacgaactagtcaagcccatagcaatccgtagtgttaacttctccgaaagtcaattatgaaaaggctacgctcgtaggagccacgaagcctcctcctcttctcctggatttgcctttctttgggtccccgaatgtcgacgacctaaataattgaccaaaccatggcttcacctaaacacttttgaacaagcaagcgatcgatcgatttggaatggattgttcagccatccatctctcttggttttggtcctagtcgttgtactacagccgaaagtaacgagtagttctcttccctctcccttgcgtatgcacttacatatgtactctcttttactttctttttaggagaaaaaaaaagaagataaggcatttcgtcgttgaatctgtgcagtcatctcggattaaatttgacgaaatacatcgtcaatactatgtttggatatacacaaattgttgagtaaatctataagccaaagtttttctttaaataaatcaaacaataacatccggtcatgttgatgccaacgtttgtactccgtacacaaattggcatcaacatttagtcattatgctcggtacatttttacacatttgtactgtacggagtacaaatgtgtaaaaatgtgtcaaacatgctaatgttttagtgtacggagtataatgacgtcatattgatgccaatttgttatttatttttttaaaaaaatatataaaacaacatttttcaacacaaactcttgtctttttccttccgctccctccgtcctagaaaaacaagtattggatgtaacacattctaatactacaaatttagatatacttctgtacagatttattgtactaagatatgtcacatccagttctagaattttttttttatggaaggagtatatagtagtagagtttttttccccttgcaggctgtgtgcgtggtattgttctccatggacaaagtatttcaatttttaaaacgacttggcagagtgtgttttatttcatagtgtccacatggcaacttctgtgatacactacaaagcagtacgttgactgttttcagtcgactttccgtcaccgatcgcagctgtatattcgctcgatcggaataaaagggaactggaatcgaggttagttaggaccgggggtgttggccgacgaatctgcactactgatctccaatctccactgacttttgtcttaaactaatcctcttcgttctcctctcacggtcagcatcaaggctagctaagctaaaagctacagccatgttctgaggttgcaacatggcgatcaagctagctagctagctgcatctaaggagattattacgaccgatattagctagctaggcaaggcaaggaggaaagcaatgccggccggtgggtgggagctcaagggtcaatgtcaggaaataattggtgctcgagatcgagaggacgaacaaaatcgactaaacggggaggtttaacaggtgatgaagcaagatctcagtaggtgaaattagctgtttaagctatagtagctagctagctaggaacagcgtgggcgtgccgcgtgcatatgcgtgctgatccgatgaccaaagaaccaataatccgcgatgtgtgtgtggtagccatgcatatgcattgacatgtaagaatggtcaatagtcatctctaatagtcatccatgtctaactgaaaaaagggcggagctaagaaactatgacgccgagctgatgtgtttttgactttgtctatcaggggttgttcactttgtttctaaaattaacaatctaaacattgtcaaaatcttcactatcaaatctctcattcacgaaaactttataaaagtaacaaactaaatacaacctacacatctcaaccttggtaaggttgatttaggcatcaaagcataaacaaccccttattacattcgtcctaagatataagcatttttgattaaaaaaaatagactaggacatttctaactacgaatgtagacaatcacttgtttatatttttttttctatgcccacacataactacgaatgtagacaatcacttgtttttattttttttctatgcccacacatattaacaggaatttagtgagattagtaataaatttctgatttttgcctctcgaagcatgtattagggaacacatttctagggtaggggcgggtgtcgtgttacgtgtgtatttgtgtgtgtgcatatgatgtctcctgtataatgaagtactctttttttatatttcggaacggtggaagtaagatttttctcagtatgttgatcagattttatttttcagattaacttactggtttatatgtcgttaatcgagcatataaacatacactaattagtggcaagtgttacgttgtgatgtcaattagtaattaccaccttttttctatctcaatgagtccttttaggttgttgggttgatacttgtgttttttttaatcgaaattgaaaatgacttgtcagttgtaaccctcatagctgtgactacaccagcaattattccactcttttaaaagttggtagtttttctttattatgtatgttttataacccaatgtcatggcacatatacacacattacgtgtctggattgctggcttaatgcgtagtagatgttttctttgatttgtatatgacttttggttgcaacattcctgacaaaggactacactaacaagtaaaccacgcttttaggaaaaacaatttcatcttgtattttattcctttgtggactaatagacgacatgtctacattattgtcatttttctttgaaagtcaatatataatttgacaccttttccgcccaaagaataaatactactacaaaattttctcatttcggttgcgacctgaattaaattcccaatggatacaggccggaagcttcctgatctgcgataattaatcctcatcacgacatcgtagccagccgtctctgtacaaatattgatcagcaatgtcgtgagcaacttacgacctcgtcccttccgacaaactcttgtctttttccttccgctccctccgtcctagaaaaacaagtattggatgtaacacattctaatactacaaatttagatatacttctgtacagatttattgtactaagatatgtcacatccagttctagaattttttttttatggaaggagtatatagtagtagagtttttttccccttgcaggctgtgtgcgtggtattgttctccatggacaa

SEQ ID NO: 59571 - DNA, 15986 bp, Oryza sativa
actataaatctgtatcccactgctattctcttttcttttttatcttattcaaatgtagcctctgctattatactgctctgatacatactttctgcttggggttcagcgaatcgtaggcgagccggcgaaacgagcggcgactcgaccgacccgctgccttggcttgagttttcgctgtcccttttaccattttccctcggtggcaggctgcctgagaccatgccgtgcctgctgctccgacgactgggacgcgagagttggcacggatcaatgcattgacgtccagaaatgattccagtctagacgcagtacataggtgtggcgtgtagaacgagccgttggcgagtagtattagctgcagagaggtattagcgagtagtatgtacgattcgcttccaaatgaaacgaatcttacgaaaatacacggggtgtgtcctcagcgtttggtattggaataagttcattttagctctctggtttgcattgtcctggtttcagaagttgggagattagttgtatcttgtttttttttttacaagggtaggtgtgagtccttgtcggctttctggctggataattattgtaattttatctcacatctcgccggtgttgacactatggctgagtaatatacctccctttccccggaaaaaaaagaatgaaaatcagactaagtgaccaatgaagccacctaaagttgaaccgattttgctaaacatcacacgggtgattttttcgttgatatttgacagatttttgcccctacaattatgcgccgagatcagtacacgattctgcgtcgatgttgtcgtgaggtggagatgagacctcgtaggtcccacgtttgccgctgatcacgattcacaagaaatttacatcctagctacgtgtaaatatcctatatagctaaaataaaatataaaattacagtcctatttaactaaaattgtatatgtaaattcagttgatattaattacaatcctatttaactaaattcacatttgtaaattcagttgatttaacatgtaagtgcactgtaattttgataaaaatattgtgtaagtaaatatgtacttattattttctttaaaatataaaattacagtcctatataactaaaattacatttgtaaatttagttgatttgacatgtaagtgcactgtattttttataaaaataatgtgtaagtaaatatgtacttattattttctttaaaatataaaattacattcttatataactaaaattacatatgtaaatttagttgatatgacatgtaagtacactgtgattttgataaaaatgtcgtgtaagtaaatttgtattagatattttattttctagtatgttggacgtaaatccaagggaagaaaaaatctgggtgaacccgagtgatgcataggcggtccctgaacaaagtgaacttaattcttttgctatttcgcagggacaggctcatcttaattgggcctgcacattgttgagccggatgctaatggacggcccagcttataaacccaagaaacgggccaccaattttgctcgtgtgctgagctgaaaggcacacatgaattctcacatgaggcagcacagatgatcgcggtattgctgattgctaatccctccttgctttccggggagctgtctcggccatctccaatccaccggaattgagggggggaaaccaccaagggtcgccgcaaccgccacggcgcgtggcgagaggaacacgacgccgtccatcgtttagccccgcgggcacgcgcgtcctcgcgctcgactgcatgtatgaagccaaaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatcgacgtatatatatgttggtgtacttgtgcagggtggagaagcagggcacgtgagcggccatccagtgtagcttcgctgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcgggtaagtaaacgtacacgttgccatgtcgttcacgtttgcaaccaaggcaacaactcgctacatggatcagctcatcagcccacggaaaagcggtgctgccgcgtgggctgctcgtgtagtaggcccagcccatgagtccaggaatcacccagccgtctctctccaaagcctctcaactccatcagcgaggcatccaccagcgagccctttcctaatccgacccgcgccgccgccacctcttcctccgctgcccaagagcgatggccgcctcccccgccgccggggccgcggccgccaccgtctcgtcgttcgtctcgccgtcgtccttctcctccgtcaagtaatccagtcatctccgcgcgcgcgcgcgctcgcgcttcgttgattgattcgttgtgctgtggttctcactctgtttgggcgtgattgtttacagggcatcgaagcccgaccgcctccgtccggcgaggagggcggcggccgtcaacgtccgatgcgtcagcagccctccggccaccgaaacttgtaccgtcctctccctttccctctccctctccctcctagcaactcatttatggttgctcccaaactgctcactgccgcttagtaggtttttgctatagtagttatcgttggaggtgtgcaatcgaatgcaatgagctcgatattgcctccgctgatgctatcacacgcagtttaggaacaaccagaaagttactgatactatcactagcactgtggtagtaagtttactgaaagattcagctttcgttttgaagctttcaagacgaaagtaccacgaaatgccaatatggccaagctgcaagctggctatctgtttcctgaggtttgttttgttccaaccatttcctctctcttctttccctccctgtcttcgttgatgctgttttattgaaattgcatgttgatattggttctttgccaactgtggagcagattgccaggagaagggcagctcacctgctgaagtttcctgatgcgaagattataagccttgggatcggtgacactacagagcccattccagacgtcataactaatgccatggcaaaggtacatcgttgctcttaatataataaacaccggttgtgtagcttcagatgatttatgttgcagtttgtcaagatcgtagttaaatttcttattgaaaaaagaagttcggcattgcatggcacacagttcttatggttcaatgtaaatgattttgtcagacaggctgtgcatcttcctaggagtaaactaagaaatcatcatcttcttttcttttttcttttttttttgcattttttgtattatagttattttttttcaaataaacattgatctttgatgggtctatttgtaaatgcagagagcacatgctttatccacagttgatggttatagtggttatggagctgaacagggtgaaaaggtatgcttatcactttactagcattttctgccaatacatcagcattcagttgacaagattgtacataactattttgcttcatatatgattttaaagtttgtgtagaatattctagaataattggagcaggatagatctttgtgctaatccatgaggttcagtaacaccttatggcatctgctggtgtggttcatcgaattagttttttgaactattaacttcttgcactaatagctgtcacaaagatcaaacatctgccacattttcttgatgagtggattcttacttttcttttactgccccattcaaatatattagtcttgacattgcatacatttcatatagcttcactatcataagccgtttatgttcatcattctgaaattatacattaattttctgcacagaaactaagggcagctattgctgcaacctactatgcggatcttggtattgaagaaacagatatattcgtctctgatggtgcaaaatgtgacatttctcgtctgcaggttctgaaataatcctatcctccctttcagtttatcattcatgctataatgtcccttacatttcttccaattttcaggtcctttttggatctaatgtgaagattgcagttcaagatccatcatatcctgtatgaaaattcttcacttgatgttaacccttcctagtgcatgattccattcttaaactgatgtttatggtcatgtgctccttttttttcatttctatcatactgcttcttattactaactattactttcacacttgtctgatgtgtattccaacatgtgttccatttttataggcctatgttgattcaagtgttatcatggggcaaactggtttatatcaggaggatgttcagaagtatggaaatattgagtacatgaaatgcagtcctgaaaatgggtttttccctgatctgtcaagtgttccacgaacagatataatcttcttttgttcacccaacaatcctactggtgctgctgcatctcgggaccaattaaccaaattagtcaaatttgcaaaggacaatggatccattatagtttatgattctgcttatgccatgtacatatcagatgacagcccaaaatctatctttgaaattcctggagcaaaggaggtaggctttgggatttaagcccttcctaccacatatggaaatttatggattttctgcaaatacttaaatccacacctgtcatgtgttttcttgtgtgtaggttgccattgaaacagcatctttctccaaatatgctggattcactggtgtgcgtttgggttggactgtggttcctaaggagctccttttctcagatgggcatcctgttgctaaagatttcaaccgcatagtctgcacttgcttcaatggtgcatcaaacatttctcaagccggtggtttaggttgtctatctccagagggtctaaaggtagcgtttcagagtttctgaaaatcttcatgtggctcttttggcaatgcttcatttcatctctttgttcctatgcaggccatgagtgacgttgtcggcttctacaaggaaaatactaaaattattgttgacacatttacatcacttggattcaacgtctacggtgccaagaatgctccatatgtgtgggtgcacttccctggccgtaattcttgggatgtcttcgccgaaattcttgagaaggcacatgtggttactactcctggtagcggatttgggcccggtggtgaaggcttcgtaagggtcagtgcatttgggcacagagagaacattattgaagctgcgagaagactgaagcagctgtacaaatgagcagtgatccggcctttatattctcaacctcttggggagccatatcaaataaaaccaagcagagttcgaagacaaaatttactctgtcgggctatcagtagatgttagaattgaaacctaatactttataggcagttgttctgttccgctcggtatttatccattcagagccattttacattctgaacttctcttgttgtttagccctgatgcacctgagtgaatcgcaagcttatttatctccttttgctaagttcgtttctactactctgcttaatttgctgctgccgtataaggctcagtgatatctccctggatgcattgaaacgttaggcacacttgagtcactggttgcaacaaaattaagagtagagaacattgctcagaccaattcagttttctactctcgtacaggaagaaggtacagtaatactctattttaccagactaccagagtaccagtgtagaaagtactatcaaatatgaattgtactcagctacctagatgcgagagaactcattggagaatgaactctattaaccgaaatctatgagcatggagagaagcaaatcgttgacttcttcaggtcaagaacttacacgatcttaatttactgaccatgtgatatgattcccccgaaatatcacatttcccagatctacagctgcaatagtgttcatacggcacgcgccaaaatctaccgagtttcacagtatcagtatcaggatgcagaaattcacagtatcactatcagcatgcagaaattctgccgaagaaatcccacagtgcacttaagtacttaacaaagctccacaacgacatatcatttactcttcgtatgtactttgatagagaaatactcttcgtatctatcaaactgtaaaactcactagaaaatagctaaatcttcagggggacgcttctgtgcaaactgcaaagacaagtacttatatgacatcagaaaaggttgcttacaacaagaattagaggcaggttaacatgacacaattgtgaatattgtcaacaacagtcatttttcgtaatggtgggatgctgacttgaataacagttacaagaatacatcacaaacaagtttacatcaatccacgaataaagatgacagctgacgaattgatgtattgcatcaggccctcttcaatgatttaaacaaacaatggataacgatgaacgctaggacgaaacaggaatatagaaactgaaaagtaggttacagccaagcacactttggagagctccgagcctctcatatgtgacaaactggatatcttgctacctaactaccactaatagcgagcagagaggccgacaaccatatccttctgaaggtaccaataagcacatgaaaaattcttttgagtaagacataaccaaaacacttgtgacaaaagaaaaatctaaaccattcattgaatatcaccggaagaatactattcatcgaataagaaatatgaaattctatagaaatatatagtggtgatcaattaacagagttcccttcactaactcaatttctagaagtgtaagacataaattatgccagcaataaacataccattgttctcctaaaatttcacattacaacatagatatccatcctttgatgtttgatcccaacccaaactcccttgtcaacccaagtctacaaaaagaacacctttttaagattttagacccaaaaggatctacaatgaacgaaataacgcgtggcattgtactctaattatcacttatcacgtagaagtagtcttcatggccttgaatgctgggtggagcaaccctagttcatccttgacatcaagtgggttgctagtctcattcctgatcctcttcaccttcctgctgccaagcgacttgtgtgtaaacccatacatttgcaagatctgattatccccaaaattgaaagcacgctccatctgcttgaggcacctctccacagggtaatccccaaacttcccacacggcttgcatccgacaaagtgagtgaccagtggccaccggtgatcaccaagtcctggatggtaattctcaagcatttcctcatacctatcaaccaagataccccaatatccatggaggtaatacccattctcaaggtacaccttgtcaccccatttctcacgctctgtagcaaggatgtataccatggccgactgatcatcagcctcaaacaccggccgatccttcaagtacttggtcaaaaccttcccggcctcaatacggacagggccctttggtcccattggtgcccatgtatcaaggaaatcaagcgaccattggcagttgcgcagcaagaagctgcctgtgttgaggccaatccagttcttgtcgtcgtagaccatctcatcccagccgtgcatgatgaggttgtaggggccgtaccgctcccatggcagctcgaatgccatgtcggagaacatggcgtcggagtccatccaccagaggaactcgatctccgggtgcgcgaggagcagcgcgcggaggagcgggagcttggcccagaatccggccatctcggcgtcgagcagcgccatgttgtagaagatctcgaggccgtggacgcggcagtagtccatcttgttcttgatggacttgaggaggtagtggtcgccgacggggttctcgcacggcttgggcgaggagcccgtgacgagcagcacccgcggcttgacgtcgttgacgaagggcggcgtctccgggtggcggcggtgccacgcggcccgctgctcgtcccagtcggagatcttggggcccagcgtgtagggcgggtcccggagcgtcctcggcggcgggtccggctcgtcgtcccgctgggccgcgcgcccggaggaggacgacgagccgccgcccctcgacagcgcgtcgtggtgctccgccagcgcgcggtgcgggtgcgagatgaagcggtggcggagctcgatgaggtcctgctgcggcgtgccgaacttgcccgccccgacggtgccgcggagcacgacgacggtgagcagcaggcacactacggtgagcttcgcgttcctcgcgaaccgctggatctcccgcatccgccgctcccccaccacccgctccgccacccacattttgccccctccctctcctgccccttcctccgatccccccacaccgatcaaacaaacaaataaacaaacaaaccctcctcccccaacccaaaagcagcaaatcaaaaatgcaggcaaggaatcaccggtataccgcgtctacggcgacggcggcggcgtcggcggcgcggagtggtggtggtggtggtggtggtggaggaagaagccgaggaggttttgaaccgcggagttggaggcgaattaataagagaaagggcgaggcggagtggtgccgcgacccgcgagcgagcgaagcgcgcacgttggcctcggagagcggattgcggtggctgtctgagcgatcgggaggcggaatggaaggggaaatctggggagacgcgaaatcggaatcgaaatcgaatcaaccccctgacccggccgctgcaaggaggaggaaggaggaggagaaggagaaggccgaaggggaaggtggtggtggtaaaaggggaggggaatagccagccaacgcgttgcgagatgcgatgcttctactcctttccccgctgtcgcccggtaatttgacttgatcctctcgcgtgggcgtatgaccggtggggccacccgcgtggggccctacgggttttgtatggtaattttctctggcttttttttttgctcggttataaacggggggttaattaaccagtggcggccagttgtaaccagcccaggggcaagcgacgtcgcgaggcgattgcacatgacgcggtgacttttctccaacgtttaaacacgcgtccccatcaacggccgtgccaccacctcgctcaaacgaagcgggctgttcctccgcgtcgctgacgggtgggccattgcgtcgacactgacccacctgtcagtggcgtggtactagtttcggcgatgtagctgccggaggtggagttgtcggttgaggagctaatcactggtgtgtgatggcgatggccataacgatgttttttttaaagattaaagtggacatcagggtatgtaagccaaattactcctctagaagcccagttattatgccttttccttttgtttagtttgggttggtaagtagcgccaaacagtagtagttttatttttcaaccatgtaacatcacattggaccaggtttctctcaaatataatgtactacgcatgtttacggttccgagatggccttccgtttcgggctatgacggaataacgtttttcgtgaaatccgatgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttccttttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgtttccttttggctcgagcttcctcaggacgacggggaaaaggctgcacattagcatgttcttgatggttgtgagtactatagggaacatgggcagaaacaggggtcgtgcaggcaacgcacggcagcagaaggcagcggtcgaacgagagtgagacgtgcagccacgaccggaccaggcaccacccaatcaacgagcggcggcgacgagttcgcacatggacaagtagctcgccgggtgggtacatagggcggaaactctccatacacaagtcggacaggacgactagtactgtatcatggctataatactgcatcatggctaaagcgtatatataaaactacggaacatgttaaccatttttcaacggataaaaaattggagtatatatagtctactgtggatgtatgtgtatcagtgtatacaggacccataccgcactgaaaaagccacgaggaataatgaaaaaaagaaagtatgttgttcgccatcggaccatacaagcaaaacggcaaatcggactagtgactacagatctttgctgaaaacaaataaagattcttaacgaacactaaagatatactaaaccaagcacggtggtgaccacaaggaacacatatatttgttatcaaatgcgctaaatgggccctagtggtctagcagatcaaagccaatgtagcgagcacaaagcatttgggaccacggccctacgctgctcaacattgcacgaccaactgacctggaatcatcgaaaccacaccccactaaaaaatccccagtagaggaaaacaaatctatctcgtcttgatcagttgagctcccgacttcacgtcaaaaatgagtgcagatgatctcagccagctccctatcaacacaagagaatatgctgttaaatcactaggagttatcattagcatagtgcagactagcacagccacaaggtacacgccagctaaaacgaacctatccagcataataccaggcagagggaccaaccaactgggctatcagcttaaggaaaatgtcacatgagaaaatattcatggatttatttttggacgaattgttattgaaagcaacaaggccattcaatgcagatgtatatgacagagaagccgtgaattcagtgatcaccgcaaaatacacaagtctgaacccatactgctaatcagcaatagcgtccacacatgacaaatggaccaaaatgtaacaaaaatatacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttgttgtagggtataactgaacccatgcaaattcctccttgtagctgacattttgatcgcatgatcctttacatgtgtacacaacaattgttgcccaatcaagagagtctggctcatttttcacaccaaagtaataaagcagctgtggcattatctgcagtacaaattagtgtgatatgtaagcatgtctgtgtgaaaaagggggtgggtgcctgtttgccccttactgtcgtacaccttagggatggtaggtcttcactgactaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcatacagcaaagatataagggcaagatatttggcatgagggagtagggtttgcaaatttattacttgtgttgcaatgtgcaactggatataagtgtatacccactatatttcagtgacggaatttgccccagaaaaaaaaaagaccaacctgaaattcatagcatagtggacctctacagtagctacatgatgggatatcggcatttgatggacaaccagccgataacgcccatagaggtttggcattctcttctcgacagtatctgcataatgtaagcaagtttattcaaattcctgtaacataatattttgagaaaaaaatatgcaagggcactaaaaaaggctaattagaacattaactacacaatgctactattctgaccaggcaaaggctgatcagtataccaccaaatataaaaaagaatccaagcaactgatgcaatctcacctcaatacttgctttggtgctcttgagacccgctcttgaaaagacgcccagcatttgttgtcagcatcagcctacaaaaataatagtggttaacaaaaacaaagatgaacagataagaaaaaaaaaagaaaagagagagagagaggatgtagggttaaaacctcaaattgatccatccatgactgcatcatatcatctggtttaccaggtctttgcatcaccaaggactttgagttactctcatcacaactgtcagaattgaaagcaccctcatagtcgattgcaatctcatattctggccaagatttgctagcaggaactgcaaagagatgaaactataaaaaagagatatgattcaatgtttacaagcttatcaagcactcaaatacaatcaccttttcctacagcaggaaaaatagagcttgaagcttcagaagaactgattaactgtaggcaatcactcttatggccagagcgccagtgcagtgtctgacaaatagaaaaaaaatagttcaacaaagcatgctttagggcatatatagattaacgattagcgggaaaatgacttataaatacctgatgcttctcagagcagtagcgtgctttcttgcagctactacagagtttatcacctttccatgtaccgcaccaatggcagacaggagctgacagcatagttgaataattgaaagaaatctatattatttgactatcaattaaaacaaagagttcaaccatgaaaaatggccacctattaataaaagttaaaacagtttaacaaggctgaaaaagaaaaatgttgcctatgaaagcatgtcacacaagaaaattcagcaactagcataacacataaatcttacacagggtctctgcaaatgaacagaatgattatctagaccaaaaaaaagctgggaaaaacagaagaaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcaaaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgcctccggccttgctagggaacaggtggcggaggaggaggcccgggtgcttcggcttctccagaaaaccaagcgtcacctccggctcttcctcctcctcctcatcgtcgtcctcgtagcccgcgccgccgcctccgcctccgccgctgcgggtggggatcggtggggcagttcgggctcgtcgtcttcctcatccagcgaggtgatggtgagaccacgaagcttcacggcgttggactccatcctcggcggcggcgtgggggcaaaaatgcgtgcgtgttcggcgactcgcactt

SEQ ID NO: 59572 - DNA, 40844 bp, Oryza sativa
  unsure (1)..(40844): unsure at all n locations
gattgtagaggatcccctatcgatgccgcctcaagaactcgctttcctcgaccctgtccgcagatccgagggctgaaaacgcataaaatacatcccaatacaagaaacaaccggcaagaggcaacgagctcgtcccggcgtgtgtcggatgcggcgcgctagagggagggtggatggaggaacaaggaaaaggttgggaagggagggagggcgcgcaccgagcttggagaactccttggaggcgatggtgtcgtggtagtacttctcgttgtagcggacggggaagagcgccgtgttgagcttcttgagctgcatcacgttcttgtcccgcacgccgtccagcgacgtccggtccacgccgccgccgccgcccttctccttgttgcccgcggcggcatccccttccccggcgcccatctccctcgcctacccctcctcctcctcctcttaccctccctctctctctctctctctctctctctcttcttgcgcttctccggtgagcttgcgatgcgagggagatgtgcggcggcagcggcggcgggtgcgtctcgctctcgcaaccaaaaaccctttttcggttcgtttgccgcttcgcctctaccgcgtagcgtcactgacttgtggggcccgtcgtgcagtgaatcggaagggttggttgaatggttgcgttgcgtgccattgcagtttgatcaagcgggtgctctgctttctttattaagggcacctaaaatcgtgcttaataagggcatctctttactaccatgtaaataataaagtgagtaaatttcataaaactacatacacatactttgtataatatatcacaaaactacagatttaagaacttttttcacaaaactacagattcagtgtcttcgtttatcacaaaattatatatactttgcacaatatatcacaaaactacaggttttagcattgttaaaacatgtcagctaaacttcgtgggacccacatgtcagtctcacacataaatcaataaaagaatggtggggcccacatgtcagctaaagaaaataaagatggtgggggcccacgtgggcccacatgtccctctcggctctcctttctcttcctctcggctttcctcgtcctcgcggggagcggcggcaggccgggggtggcagaggttgctagaggagaaggaggctgaggaggaggtcgtcggcgagcgcgatagctacactccgtcggctgctccgcccgcgatgcccagccgaacggcgtcgcctctcctcgcccggccgctgtgcgccgcctccctcctcgccgagccgccgcacgccgcctccctcctctcccggccgccgcaagctaccctccctcgcccggccaccgcccgacgccttggggatgggagaagggagagagaggacgaagaagaggggctctagttaaagagagggagatgctgagaatgacatgtggggcccatgtgggccccaccattttttttattaatttatgtgtgatactaacaaggtcccatgaagtttattatttttccggatctaattgccacgtatgcgccacgtcaatgccacatcagataaagaccaagtcaaatttgccacgtagttgccatgtccgccaaaaccaccgtcaaaaccgccgagggacctcatgtgcactggttgtcaaaaccgtcgagggacctcatgtgcactggttttgatagttgagggacttgttgaatctggttttctggttgaagaacgaaaatcggattcgttgataagttaagggacctcagatgaacttattcctttcactttgggagaaaaggaaagcagggcatctcctgttagactttagcaggtaacacatgttggtccaagacaactcaaaagtgtacattgatttacttcaagaatgagtatgcatgtctcatgaagctagatctcaagaaccagcatatggttcaccaagagcatccaaaacgaagacatgatcatctttagctataccaacaatacctaccaggcgatcaccagaatttgcggtgtcaatttttaacctaccgaggccggtggctgcattcaggagctgttgttcatcatcacaaatggaacggagtcaagttgtaacttgtaactcaagacacataagcagtcacatgaatgaactaatagccaggtcatgaatttaaaaatatatacatacacatttcatgacggcacgcgttgatttgctatctaacatggagcaacagatctaactgatgtgtccatgtgagatcaaattgatgtgcggggtaacctaaaacagcctctggctttcctaacttgctgcaagggctacttctaccaatgttactttggtttcttaagctatggcacaattctttcctttctaaaaataatgctctacggaacatgagcagagtcagtgtggtgcagttagttgtccccctcaaatggtcgttgcatttcattcttgcgcagcagaaaaactcgcagataagtgttgcttcaggcaaaaagtgcataaagctccgaggaatgatagtcagtactcagtagaggactccaagataagcacggaacaggacagttcccatcgcttaaccaaatccatggaagccacttactttcccatcttactcgcaaaggtcttcctctcatctttatgcttctatagatataaattgagcattcaaaatttaaggtctgtatggataaaactgaaagctggtatacacagagatctccagtggaagtgcacataccttgtgaagtgtcctaaatttcgtttcttgctttgctcggacaagcatccaatccaaggccaaatcatactccattgtattgggttgagaacaatgcgaggttgaaactgccttcttctggagaaagaataatggttgtgcaaaaatattaagacagagaaaagaaatagagcaaacttcataggacaacatcagcacctgttcttctcgttgtcttatacccattctaatattgttgattgttaagtgcccgagaagagtttctgaaggttttggaaccttaagcaatcctttgctgcaataaaggggtctgcaaataattcaataagagaatataaagggtcaaccaaaaatattgaacaacatattgttatttaatccacggtagaaatttgaaaaataataacagtaagtaactagtgcaaatggcatcacatgcaattttgttgacaaattgcctaataagcaattgcagtgtggtaatgtgtccctgaggtggtatcaagatagaaccaaccaattgctaatagaagtttcccttaactttcctaaagaaaagatctcttaattctgcagttggggttgtaatgagatgacaatatgccatcatgtgaactataacagacagtgaccccacttaaaacagagcacaataaatgcaacatgaacacatatatagtagtaaatttcgtccagcaaatctgcaagcaacagagtgagataccttccaccgaccaccaagcctgaattaatttttgaaatagcagagtctgcggcactttttgttttgaatatagcatatgcttttcctacaaacaaggaagcagattgttttaaatcgcattcgagaacattgcctgaatgtggcaaacttgcaaggtattacaaacaaaactcactcaccattgtttggatcatcataagttgggtggttaataggcttagcgatacaatttagttgtaaagcatcacgtataagctcctgtaaacatggtaatcaagataaatattcattaagtatgttgatgatactggaaaaaagagcagataaggcacagaaagtagcaaacatggacacctaagagagtgggacatgcacgtatccattttagaagttattgtccaagtatggcagaacaaggaagcatcaaatagtatggtacacctactcaacctctcttaggtactgaaattaggggtagaaagtgatgttgtagaaccaatatttttaatctctttatagcaaaagtgttaactacaccagcccaagaaaattggcaaaaattaggaaacagaaagcacaaaaaagattaaaacagattctaaaatcaaatatgttcctgtaaacaaaacatttctcttttttactgctccctacattctttccaatttatacatctttcaaaattagtgggtagcggaaacgcgtacgtaaaggcgcactcaatagagaaacatgtaccattgtctcatcgagagaaaaatagtaaaagtggatctttttttttactttatagagcagagaaaacaaaaaaacaaataggttacataaaaatgacactttagactcgggataatccccactttgttgcatcttttgctcatccattcgcccacccgttcagaagtggtgcccaatatatatatatatatatatatatatatatatatatatatatatatatattagtattattagttagcgtcatgtttatcgcatgaagagggaaatctacagcactggggaaactcggacgggagttctttccgagccaatgaaatccttccctgtacaaattctcatatacaaggccttgtggaaattaagaggtgtaagacattgaaaacaaatcgcaaagtttgtgcaacagagaacatagcaaagctagtaaagaagtgataaattataagccaagaatataataaaaaaagcagtttgggctttatgtcaaccagatagacaagacaatacctctatgtcagcagctgcaaactgtatgtcaagattttgaatgtacacaagtgtcccttgctcatcagcatttcgtagtctggtatcccatggctgaaatttccatttaaaaggtaaacccacccacaaataaggtcaactgaaatatttttgtttttctaatagttttgaagcattgactcatgaagcatagatgtaaatcttctgtacaatcatagtatatacgcaagagagaagagacaatgtaggaaaaatgattactcacaatcttgaaccatttgcttctgtcctgttaaatagcagaaaagggtgtaagcacacaaaagtaaacacggctatcagtaggaaaattgtagaaccagaacattttgattatggcttgtttcttagaaattggttgaaccttaatagtaaaagcagatgatgttcagccgaataaaattcttgaacagaaataattgaaggaacatgtggcccttttactcattgctcttagacccagatcgtaaatcaacccattcaatgcattgggtaactgggcagtcggcaaaactgctcaattgacaatcagaatgcatgaggcacatatagtactttataccttagttaagaatgcatacaagtaggtttcacatgagagctttaagtaccacatcctggcctcctgggttcccaggccagcctttcatgtaatttttgctaactccaaatgccacataggggcaccgttggtcgatagaggatagaatgacttgcccaggtggggaaaaaaaactagcagttgcactgagattttcccaggtcaactgctcatatagtcccttgtgctggacaggtccaggggatcagcccaggagctcggtctggccttttttatgggaagattgcagggccagtccaggttaactgttttattttacttatatacaaacaacagattagatgcagatgagttgtggagataatattaactgagttacctgggggaatgtttaaagtttaacatgatatcataacatcaatggcataaagctattcattgataaggtggaaatgtatcctcagtgttggttcagatacttacagcttgtctacctgctagttccaaaggtccagtgcgacttggtctttcaggaacatctaatggcacattttgcactgtaacattttcagaaaatttgaccctctttggtggcctctccccagggagaactttctgtgcaggtttggtaatgttctctgtagatttggacacactctcctttttcagtgctacatggggagggggaatggcagcagccgcactttcctccttgaccactggctggggaaagggaatggctgaagccacattttcctccttgaatactgacgggggaagggaaactgcagcaactggactttcatcctccataaccgttgactggggaaggggaactgggacattaagcatcttctgatcaacaccatgcacttcctggtctgaacaggatgtcacttgctcaacttttggaataagcaaaaagattcctgtgccagaagaaaaataattaaataccaattttgatactganggtggagaaaatttttgccatattaaaaatgcaatttaatgcactgatgaaatctgatatattgctgaccttccacccctgcaattttctcaggtaattgttcagaaagtgtgcaactgttaacatcaaaaaacctgtagaagatataatcagccattgctagttccctgggggaaggttgacgattcctctcatcctttgaaatgcaaagcacagtgcatttcccaccaatagcttcctgggtgaccaataaacaaaagggtattataatattttagttctcagaaaaagtaaaaggatggaaaaggcaaatgacttaacattcacaggtaatacacaatagcaggaaagtttcaatcttgtatcatgactgttaatacctaaccatgctctactaaaatggtatgccaattagctcaaaaggatgtttaactgtaccagctagaaatgatctcaattttcaagttgattgtcgcaaccaagctggctcttctcaggtcatgcaaatgggtaacacgctaatgcctactctgtctaactcagttggactgcattttcacttccaaaaatgtgaatttaaatattgctctttgaaaattgtgatgcactttttatacatgagaattaaaactctaacttcgaattattcatgtcatgcgtgaataactaaatataccacaaatacaaggtggacgattcccaacaaaaaaaagtgggaaatgatctcctcacatcaactagtactagatacaacttgataaggtaacttgtagctctaggattctagctaccgatatggcttctcaacaacagatatttggaattaacaaaatgtcgacactattgcccatccaatgacttttcacaattagaaacaaatttgatatagtgttcacataatagtgattatctgtccattgagtgatcaaaatgaaaatatttaaatatattgcaagaaagcataaggtaaaatgatattcaagaaaaccaattcaaaaacgaaggggaaaatatatgaacttaccagtgggttgatatcagcaaggccaacgccttcaccacaagcaagaaatatctccttttccattacagggccacttaaatgttttcgaatctcatccgggagaaaaaaccaaagaatctttactttcttagcctgattttgctgccatatctttattatctttccaatgtaaggttcagactcaccactcttaaaaagatatacattgtcatacagtgagtacttcacattgtcaaatgtgaaggagtcataaaactgtgtatccatcttaataccaccttttgctctcttcttcccccatgagaattggatattctcattactaccatccattctgataatggtaacttgtagctcactgtgcactcaccataagcctagagtgataaaatcagcaggtcaaactttagatcaaattaggcaatatcaacacatcagacttgactattgataatgttagcacagaacatacgtagtttctgaagctcgaaagggtggtgtctgttaattgtgctgtttatgctaggtggtcaacaaacatacaaaccatgcttacaaactaatagtactattaccgtatcaagtgtgaatttagacattcgcttcataacgaaaatcgtaaatctagtttcttcacacatgttgaatttgagttgttaacattttagttaacctagcaaatctatgtcatttgcaagattagttaacctagctaatacgctgtatatacattagttagtttaatgaattgagaaagatgaaatattaactgcagcagatgttattttctcaacaaagaaagggacagcttctctcagacttcttgaaaagtcctatttcacagctgaaccctattttgcaactgaatgtagcaatgttttatctacagctgaatgcatgcgggaacatcaaagataacacataaaaaaatataaagatatgaaattgcaaccgattgctgcatggtgatgcattttaaaccaacctaattaattcttatttttctggataggctgtggttattctaaagttccaaaatattcgcggtaaataagcaaacataatggaagtacagatccatctgcttgataaataaatctgtcatgctgattagttacattttaggttatgctggaataaaatcccacaggaagtcgttcgattttttatcttttggacaaatcaatctgctacattttccggttggcatgaattctacatgctcactaaacaggagtaaagaaaatgtaataagtttcatgaatgctcatggtgaataagaaggccattagaggagtaactacatagtacatgcataaaacttgaggctcaacaatggcttggagtaccctgttttcaacctaaaaggcaacagttagcgcctttgatcaaacgtgtgttcttaaatagggtaggaaataaaaacatgaatgctttttcaactgacatgttcgtatccgctgtttcaccttactaataggctcaccattaaccataagcatatataaaacagtaccaccgcaacaaggatcgtcatgcatgccttagtttttagaacaagagcaaaggagggtgtccagcacgacgaagaacaaacccatgaggtgagctaacgggttccagggaactcatctagggttttgacatgaccaatccataatatgagaactaaaattaccaccaacagcagctagagccactaaatgcgatcacaccgacgacgaatccaccaaaccccaaaccctagacgggggaaacgcaaaccgaacgtgcgacgcccccacacgaaatcccccaaaacctcgcaaggacacctccattcgagcaccaaaatttagcgccctagccgttcgaccggggtcgttcggcccgcccgcccgcacgcgcgccggcattcctcgcccgcgccgcgcaaccggaggccgcgcgcgcgggggaccacgaccagcggccccggagcccgacggggcgacgcggagcgctctccagcgaccggagccccgcggtccccggtggggggttgggggcggaaccacgcgcggccgcgcagcgaaatccagcgcggaacagtgacgggggacggcggggaggaagaggggagaggactcacgcgtggcggccgccggcgaggagggcggcgaggtggaggccgggggcgcgtggctcccaggtagcaggaggaggccgcggtgggagagggaggaggaggaggaggtgagatttttgtggttgggtctcagtacggacgcggatggtgggcgtggcgcgtgcgttatttctgcctccgggacggagccacagcggcgtacgccgattctgcgagtgaataggaaaagtttggcatacatgacatgacaaatagtaatggtttttaagagagaaatttctagtgaggtggataaatcattttgacaactgcatcaagctcgagtatccatttcattcgccgccgaaaattgtacctcctcgccagcacgtcgagtattgccatgcagtcttgatcaatcaattttgatgtctcaccgcccacatcaactccaccagcaccaaccgcatcagtggcaacttcctcatcccggccatccttcatgtcgacactatcaacagcgtgatattgtctcctccgccgaagaggacgagcatcatcaccctacatctccagatcgttgcggatgagctccacggctctctgcacaccagcagtagcacgtcccatcggtgacgcctaaccccaccatgtttagcacgtcgcctagcactaaccgcaccaagccttcataagcgagcagctcaggaagcctcctccattggtgttcagcgaggggtagccagaataagaagagaagatggggaagaatgagctcaaaggcatttttgtcctagattatattatagtatatagccatatgttgagagtaatattttatcgaatccctttagtaaaatggcatttgggcaatacacacttttgacaaaatggcatgatctcaattttttcaatgggagagagacgatgaagagttgccgtatggggtttggattcaggctcgatgtagatggctcggccggggcaagcttggtggccccatatttaggtctacacacttttatttttcatagcatctaaaaaaccaagagcgttgttaaatttagttctcgacatggagaatattttcttttcaaaagattatctcttcatatccttgtgcactccaatagcatgggcaatacacaaaagtatcaactctcgactagtggtttcaacctctacttaggcaaaagcaattgaaaccactattaaagcaaccgtgtatttacaatgtacgtaggcatagcctaggcaagcctatgtaactttttttttaattttggcctcttttaattgtgcttcactcctataatttagaaaaacataaattatttacacatgtatcccaaattatacgaattgtacttcaatgggaagaaataaattataaataactccaagagtaattaccatgttcatttcctttccgtcttctccccaactccatccatacccaacatcactgaccatctgtggacccccgtttttataacaggaatcaatcgtgtaaacagtaccatttccctggatcaagtagtctggtacacacaaactcatagctgaaatatcaagtgcacatacacgagagtctagtacgaattattacatcataagcccgcaggcacagtcttaaatcatcggaccgagcggtccggaatacattccaaaaacagaagtaggtaaggcagcggcacgccattgccataggcaacgaccgtaactaagacctactgagcgccatcgttctcatcaccctcctggtaataggcatagggatcctccgaagcttcatctccggccactaattaagtttgaatattgcaagggtgagtaccaaccgtactcagcaagccaccacagcaataatgcacatgacagaggaattcaaaggatggctatggttcttttgcacaaagcaagttttgtaattcttttcacaagcctaagacctagcatagactgatcaagttttaatatcagtgttcccattaaacaatgacggttctgtccaccatccattgtgatcccaaggatagcttcccgccattgagtcgtcatggttttctgaggacgtccacattcccgcctctcaggaagtggctccatcagcataaaaatcatcatgtaatatcccatcccacacaagttaaagaatttagagtctagccaagtgtaatacatgtcccggtgctcaataaccgcgagcacggctattcgaatagatttggtttactcacactgcaatggatgtacactttacccgtactccgcgactgcccaacacatgagcctcgtcccaacacatgagacgcgtcatggcaaagcttttcgataacctcgcattgacagtacccgctccatgaacttaaatcctcatgcactctaggcgtctatgtttctagcagtgagaggagttctggcgctcccggaaaagagaagtctcacacacatattaaattatggttcaagttaagttctctctctcacacactcatggcagtcctaccaatggtgacaccgatgtagggcacgcctctcggtcctacctcaacggctgtcccaccgtagcgcacctgcctcactcaggggtgaaccatctatgcagggatactgcctccgctcggctatctactccgctaggtctatacccatacgagaagtgcggttgtacgggggtcgtttcatgcttaacttcatggctcggtccttaattgaccggggacggtactagccttttctagataccacccaaatcctccgtccgccccagtcgaaaacaattgttttcactttattttcctttcacaaatcatgtcatcaatttcatggcaatgtggcgctcatgtctccacatgccacatctcaattaccttcccaaaggtaattgcccaagcatttagtatttgataaatatgagtatgcatgattctagaatagcatttctaagcaattgtcataattgactagggactcatacgtaaacatggttacgaaggaataaggggtaaacaataatcaaggcatggtataaacacaagtaggatgttcatcattgcatgtaattttatttataaacgaaataatttcacaattaggatcaacatgttcaagggatagtgatgacttgccttgctcaaagtcttgcggttcttggtcctcgcttggatctgcaactccctcgggctctaaaattacgtgcgaagaaacgatttgaattcggttaaaattcaaataaagatccaaataaatccaaatggaagtcgaatgcgaaagttgattcttttatattaactttactattcgcgaactagggcaaatccaatttcgatttatacatcctaaactattttgcgggtataaatattttgttagcataagtttttaatttaatctacccgagcattatatccatataataggttagaaattttctatcgtgagctaaatatcggacgaaatccaaaaattatcttataatattatacgatttaatttagcctatgactaaccgattaaatataatatacgtctaaaattcctagtgattaaatccgaacttctaccgtgaatcgattacttatagagattatccaaaactaatctgtaatagtctataaaaattcatctaattgtttagtcgttatttacatctaaactactaccgcgaattgatttcttttagaaattaccaagaataatctataatttatattaaattttgcaattctatgaccataattaatctataattaaattctaattattttagattttcttaaactattaacctccttaatttcttcctaattttctatttatttttccttttatttttctccattctctcttctctttttctttctttttcttacttttctctctctctctctctttctttcttttctctctttctctctttttctctctgtcggcctctcttttcctctccctctctctctcggctctctcccacccgagcggcggcggcggtggacgcgaggggaaaggagggcggctcaccggcggcggcagcggcgacaacggcggcggcgacggtggcgcacggcggcacgggaacggcggcgcggcggcacgggagcggcggcgcggcggcacgggaacggcggcgtggtggcacgagagcggcggcgcagtggagagggaagaggggaggaagggtgagatggggtggggggaaaatggagagaggggggtatttgtagagaggggaaaaggagagggggaggggcggcggcgtaatggcgacgcgacggcggcgctcagggcgggacgacggcgacgcgcgggcggcgacgcgatggcggcgcggggctcggagcggcgatgcgacgggcggcggtgcggggctcgagacgggcgacgcgacgggtggagtggggctcgacgcggcgatggtgacggcgcgcggcgatgggacggcgacgcggcgggtggcgagcgagcggcgtgacaggcggggcgacgcgacgcgcgcggcggcacggggctcggcgcgatggaacgggcggcgcggcagcggcgcagggcgacggcgaggggacggccgtgcggcggggcgcaggcgcgaggggacgagcgcgaggccgacggcgacgcgacggtgatggcgcggcagcggcggcggcgcgcgcgatgggcaggcgacgcggcgcacgcggcaggggagggggcggggctaggaggaccacgatcgaacacctatgccgcaatgaacagtaacttttcctatttatcccgattttagcccattttctatttaaatatagccctataaattctaatttttgcataaatgaagtttactccatatttgtgttatcctaactaaaaattcaccctaatttaatatcactcatattttgtttatataatttatttgaatttttaattagggttaattctcattccatcgtactaaaatttaattattgctaatatggtcgcgataatattttatttatttccaatcccacctaatctttattttaatttatattttaattatttatttagccaacttgatttttagggtttattcctagttagttattcattattcgcgattaataaattctgagatcaaaatccaatgaaataggcgaataaaatcggcatgatgcaatttattacttaaaaagtttttgaaaatccgtatttttggtgctttgatttcgttggtcgaattttcagggtgttacaccatcctagccctttaccgccaagccaccgtgtcagccatacctctgggggtcccgttctatcctactccgccacactttggtgaacgctttcacctccctctttccccatcgttctggacttgaccttgctcaatgtactaggcatgtggtgggtggggacggtggcaggtgctggtgaggcggcttggttgcgagctccgtgcaatgtagagagggtaggctcagacaccgcctccttcccttccccatctccgatcgctgttagccgctagatttgggcacaaggttgccgacctcttcttccctagttgttggtttgctcgatggtagtgatggtggtggccggggtcctctcgacggtgagagaaaggtgcactcttcgtccctcctctatcgctttggatggtcgccgaccagatcagaccattttcaccttttccccctaagccactcgtaaattcattgggctactctgacacccatgaagccctctcgcacctccaccgtggcatctgagcctagctagaggttgagaccgtgggctgaggcacgacattaggcatgctctaacagactttccatatcctgtcgtttagttccatctctatatacatactccaacatattcccatacactccaatagactctccgtataaatcacaatagaaattaggaaaattggtacggagagctaggccccatcgattccatgatttggcatgccatatgggattgccatttatttagaaactctattggaaggccgtggcacggacgcagaagatggtgaggtccggccggaagtcggcggtgaccatctccaggaactgcgcttcagcaacttcatcttgaagttgatggcgaaagagaggaggtagaggttctagagcaggttgtcgccggtgttgcggtgacagaggcactgagaccgccggcttcttcttcttctgcggtggtggaggaggacccacctgcactcaccggcaaggaggtggcgggagcagcatgcaaggacgatggcactggtggatcgcgagggcgacggagaccttggcgaggagtgcgagggaggaggggagaggcctcggcgccggcagcaacagggagcgctggtagaagaagcggcgtcgcagcgagcggatgacggcgtcgaggaggcacgacgagatcaccctcgacaccgccccgacctcgccgacgccgtgccgtcgttgtccacctcggccgccgaagacgacgacccctttcttctagctggcttcatctccatgcctttggacttctcctgactcccgagagagagagagagagagagattgtggaggggaagggatcgaaggagataaggtagatgagaccttatcccgttgtgacgggatactgttgtgtagattttctctataaaaattaaagatgtttttgccggtatttgggtatgtcatccgtatttgagtcggtttttaagttcgttcgcttttggaaacacatatccgtgtttgagtcggatattaagtttgtttgcttttgaaaatacaaaaggagtcgtataagaaatctctttaaaataactcacatgctactttgagatgaaagtcggactcctaattgcagcttatgatttttcttaaaaaaatatttaagcgaatttccacagtaaatttcattctaactaaaccgtataactatcaaaataacattcacccgttgcaacacacgggttttttttctagtaaaataaaattttaaccatcaatgagttcttaatgcttacttaaaaataagttgtatacatatatttgcccccaaaagtaatactataatatgacattaacttattatagtattcaattaatgatcgtaaattatcttgtcctatatattgagtttttatgatcgaagagagtatatcatttcgcaacattttaatataaagattttgtatcccttcacatgttggcgatcatttggttccgtaagtcatatccattggtgaattcagatttagaactgcggggtctggaatgtaacgacaatctgcagacatctcttaataacttttcgtgaatatttgcaacataattgagcacaacgcacgcatctcgcattctgagttcaacaataccatcacctaaaataggctagcctgttcatctttctcgttcaataatgcaacagcacttggcactgagcaaaatgttgtttgaagtattttattcctgagttcaatggttttattcaatacgcagaccacactctgcaaaagcaatagcacctacaagatacgcagcagttatgtagtctttacagtaggaacagtatctctaccgtcagatgcatcaagcatcaatatacgtgatttgccaaaaatgcacaaacaaaaaaaaagaaataaaaacaactggaccagatattcttctgataggtctccccgaaataatttacagattgccatatgaatagaactaggcttttgcaggccatgttgcttgagatgacatgattatgcccacaatcactccaaacagacccaaggcgctgccgaagatctcaatcaccaagatctttacaaagagtgatgaattctgagcatcagacaatgcacagctgcttccaattattcccacacaaaccctgccgatcacaaatttaaccatctgagaacgtgaaccatgatacacaagaaataaggcacaaggattggtgcttacccgcaaacaagattagcaaagccaacaataagaccagacgcaaagattgcatagccagcccggagagactctggatgatgcactagagcagttggtacactttcaagcttagtttggaggatgattgccacgataacaccataaattgcaacagcctcacagaagatgacactgtaaagcacaattagatgcatagatgtcagtatcgcaagttaaaagtgaacacggctgtgattcaaaagggtctttcaagacatgttccagaatatgaactagcaaattaacaaaatagtatattttaatattaatggtggaaataaaggctatgcagatgaaatcctagaggccatgtatgtaactgttttgtacaactgatgcaaaaaactaaacttaatgcagttaacataactatacatcttataaaacattcagtggccacttctatgaattgtagcatccgatttattcacaataaaatgcaccatgtatccaccgaagcacgatggattgctttgagcagacaaacaaatgttaagtcccttagtcatgctgcattgtcatttactgtagagtgcacacactgtttgtagagtagataagcacacaatgtgtgcctcttttcttcagccattcagggtacttgaaatgactgaaaagattgtagttaagcaccatatctagttttcagaatgtgcaaaataaagcatgacagtcacactgctatcagtaaccatctgtcgggaacataatcagattcttgctagtactatcgctctcttgctgctggtttataaaatgagaaatgcggtggaccaaataaaattggagaactttaggtttgacttgtcaacagaaagcaccaaacacttcctcagtatctccatatttttcaagcgtgctataatgatcaggcaatgttacctaagttgtgaagtgaccattagacagaccaaaagttcagctcctaattgcacaccagactggtgttcatcgcataaatcgcacgtatgtgcatagttgtcctacatgatactatggatgtagaacctaatgttccactgcacatgttacattgcatgacgcagttgtcctagagcactacaatagcttaagtacatatgacagcattatcattagtacagtagcccacattctagttacaccagtacaccactacgattgcttataatcgagcaaacatgccccaaataacgtaaaggaaaatacaagtaaaacacagatgctaagcaatgggttaaaagatacaggctggctaaggaactggactgatcccacaagagcagttaaaagaacttgactaccctaaccagagcaaacgtggaaacagcagaggcaacatttgcctccagctttaattttgtagcaaaggtgaagcaaacgagatggcataatgctaaaaattggatattgctaacagataaattatgccatgtaacttaaatatacaaggcgtaataattgaaagccatgatgaaagggcactctacaaaaccaactgcctagaggaacagtgtggtaatcaatctccctagatacaaaatgcatggaattctatgtccagcagttttcgcgtattgttggcatttttacggatctcattactgtcaaaatcaatgggacacttgcaagatggcatccgattagtcctagaaagaaacctatctgataatctaagtcaattcatgttattaactagtactggcactcaagtaatccgcccgaggaagtacttatgatgtacatatcagcagctctgaacaatttcatgtgctcatatcaaaatatcccctatccgcactaacagaaaaaaacatcactcgagctattcagccaaaccctaaatcgcatcagcaagccgcccaatcacgaaatcgacagccaggcggtcgagaacgaaatcagatgagaaagaagcaagaatcgggcacctgatgaggttcttggaggtgatcctgggggccttgatggcggccccgatgaggctgctccccgtgatgaagatccccctgcaagcaaaaagagcaccaacgcgcgatgaggacggcgcgcgaaccgggggctttcgcagatccggcgacgcagatcgatcgagcgagcgaggggttgggggggaactcaccaggcggcgccgaggacggagacgccgatggagacggctatgccgatggcggagaaggtgtagggcgagatctgcacgagcgcgcgcgcccacgacgacgaatcagacgacatcctcgctacaccacctccggatcccacgccgcggcggcgaggcgatctccctccctctctccctctctctctctctctccttcgcgcgcgcggcgaggggcggggaggggcgggggctggatcgatcggaggaggaggaagggcgagattggggaagggaagaagactcgggtgtcgggtcgggagagggagacgagacgagacgtcgtcacacgatggcacgacgaggagatgtgtgtgtgtgtccgtttcttgttcgcacgagaccgggacggggcgtggggggtctgggggcaacgagaggctgtggttgtggtccgtccgatttattgatggacggttcagggcttcaggtggattgggcacacgggatcgggaacgagttggactcaaaacataggctcggtttttttaaaaaaaaacttttatacaatacaaaatagaaaagcatacgtcaatagcatgtactgaaaccatagtttggtagtataagattcgataaaaccatggtttcggatagggatagttggcacagccaatttgtttttctattaacaaccatggctgtgttcatttgcttgtgttgagaactaatttccttcacacagaaaatgagatacctaattaatatatgattaattaagtattagtttaaaaaaacttgaaaattgattaatatgattttttaaaaaaactttcatgtataaactttttgtaaaaaagtaccatttaatagtttaaaaagtgttagcgcgagagagtaaagttggaaaagttgtccaaagaacatagcctatgttaacgaggcttcccctcctcttccaccggcataaggggaaagccaatggaatgctgctcgctccggtcatggcgatgaacacgcgaacgatacatcgtcatccacctcccctccttttcttgagtggcaaagcatatttgagtggaggaggaactggtggttttgtcgacacgttgcaaggagaaagacatcgttgaataagcatgcaaggagttcgcctttagtgggcccgacgggtataggtcgttggccagttgggaatgcacgtatatagtgttgtagttcacctgacggttagcgtgacaagaagaaggcgtttagcaacaagtagggagaggagatttatttacaaaatagaccatgcccgtactccctccgtcccagaaagaggcgatttctggaggggaggatttgtcccacaaagaagcgattcctccacagaaaacaagaaaacttcaagtctatcatatcatttgtgggcctaggtggacagcgacttctcctcctctcgttcacacctcacattgcaaaaatcttatctcctgcccgtctctcactctttctctcgtgtttctctcccattcccaaatcgattgcatcgatgcagcggcggtaagatgcgagacctcaccaagcttccgaccccctccccacctccctcccactcctcccagcacatcccggcggtggaggtgatggggagacgcggctttgtcggcggcggtggaggcgatggggagacgcagcttcatcggcggtgggggcttgtatgcctaattgcttatcattcccggaagatttgatgcggttgcttgatgcacgagccgcgttggtgaaggcaaacaacactgcatttcttttttttctctaggttcttgctatgttcatgcactgcttttcttttttctctgggttcttgccatgtttatgctgttgccagtagtactagtattttctcaattggagagattttctttttaagtatttgctttcggcaatggaaacttttggcattttttattctgcgtcatatgcttctggcatgtgtaatcaatagatgcagagaaatgacatatgtaatcaacagatgcagagaaatgacagtaatatatggatgttgtcacggagggtattttcatcattttacattagtactaaatttgcatcagggatccaggaattgcttctttctagaacggagggagtactatctacatgaaacatcgatgatacaagatatcatcataatacttcgacgattccacctccagaaaccaatgtcacattcaaatattatgatactacgacttatcatgatgtcttgtcatggatatatcataatcagaccaccatgatacggcgaaagtatcacacctaaccatgcaggcggggcgagttgcagcagcccgcaacccattagagcaagtataatagtgagctataagcctactgtaagctcaggtatagaagagagatattgaaaaattaaggatactggctctcatgcaagagctagcttatcataaggtccaagacaaatgcattaaatatataagtgagagatagagagataaaaagaaaattgtagccaattttatagctaatctattatatatattggctttgagatgggctaatattaggaagtgggctctattattacccttgctgttagcagtgtttgttgcagcctgcaaacccacaaactatctgctgggctattcgcggccagtccgccaacccataaacaaacccaccaggccaccacacacacatcgctactttactgcctcactttcactgccacgcatcaatctacctgtgtaggtggaggagcagcggatggttcggcttcgggcactgtatgacgagcgaacgccgtgcacaacaatggaggaagatgggatcgacgaggagaggtttcggcggcggcggaggacgataggcatgcgacggccatcggcgaggatcagtaggggagccgcgtgcgggttcgtagacgtggttaatgggccgatgtatgtgacggcccacgttttttccgttgacagaaatacatggcggtgttttatcaccgccagcgtcacagacggaaacggagtacacgactccgaatccgatgcgaggagaagccttcgcctcttcatatggcaggcgaaggccgcggccgcgtcgtctctcgtctctcgtgcggcgcgcgcatggcttctcctcctcccggcgacgacgaggcggcgagggctctcgcgctggagcaatgcgagagggacttcaacgcggtgatcgaccgcatgctcaacctcaacctcgacggcgatgacgccgccgcctcctccgccgcttctcccgagcctccggcaccgcaagccgcgcccgcacccgaggtcgccgccgccgccgcagtcgacggtgcagcacggggcgaccgcgggtactgggtcgagaccatgatgcgcgagctgtgggccgccgcctccatggacgacgccagggagcgcggcgccagggtgctcgacgcgttcggggccgctgtcggcgctggcaccgccgcgaggctggacgccgcgtcgaggcagatcgggttcctcaagagggcggtgctgttccaccaccggctgcggaccgcgcaggagaaggcgcagcgggagctccggtggcagctcgacgactacagggagcaggtgcggcggctggaggcgtccaactacgcgctgtccctgcacctccggcaggccgacctgcgccgcggcggcggtggcggcggcgccatgccccacggccccggcaacccggagatcttctgacctaacctgaccggatcactgaccaatctgacataatcgacatggcgccatggccagcatttcaggaaccaattgaggataggtttcactgatctcttggcaatggttgctggctaactcgaccggctgaccaaacaatgaaacaaagattcaaacaagatatgcataatgaagtgagccaacgactaacaattcgcaaatgttcttgaaaaacggcttggtacaaggtgagcactgagcagtgatatacaagaggcaaatggttttgtaggaggttagagaggggagattagacatttagaagctgttgtctatttgttattaatccttaattaaggtcttcgttttcttaacaatatctaaatgtttctaccattatatttatatttttggtagtggtatactccatcccacccgagaagaaattgaatggactaggctaatgcgacgatcaatactgaatgtttttcgttttgaaatatgacgatcaaaagtaaatggaggaagtaccttttagagagtagtagtaaggctatgtttagttcacatcaaaattggaagtttggttgaaatttaaacgatttgacggaaaagttgaaagtctatgtgtgtaggaaagtttggatgtggtggaaaagttgaaagtttgaataaatattttggaactaaacaccgcgtaaagcattcaatacctgagcataaaaaagagaattgatctatcatttactcccttagtctcaaaataaatttattttccacttatcagcacatatcaataaaagaattagaataacctcactttatcaaatgctagtgcaaattatttctctctttatttttagataaataaaagagaaaaatgatcttattatgagacggaaagacggagggagtacttcgctgtcgctgatcgagtagtcggatgatgataacaaggtggagaaaccttggaaatgcagtacggagtacttccatgacgacctggttgtttgtgtatacacatcttctagttctacctttcttccttgtgtgcttgtattatctctctgttctttgccagttgaattctagtcaaaccatgagaaattccgagtctcaaaactttaatctgtttaggtggatccagataacagtctcgttcaaataacagaatccgtagtgagaacgcgcgccaaactgtccgaaaacaagaagatgcgaggtaggagtagctagcacataatgttaactactgtattttagaccagaaataattagctctcctcctcatcttctcctcactcttcttctacctaccggcctgaccactcctaattggtcaagtgtcaacactggagaggctaatttgcagcctgcgttgatctattcatgtcgatcgaacaaattaacaggagattttgaccatattagtcgcacctttatattgaaatccactgcaactatatgattggcgtccagatcaactgttgtggaaagaacatgaggtgttcagagttaatacagtcatcatatggatacaagatacattacattatacatattgtttgcttgctctgtgacagttgaatggtatatatgttctgtatgttcgcgtataaatcacaatcgaatttgtgaacagtgtcatgcatgggcttgcaaatagtaacaataataatataataataacaataacaacaacctgcctttttttatgttgctgatctcctctgagtgctgttctgaccgagatatcattggagaaactagaaggaattagctaggccgatgcaacatgcaagtgatgtgtcacttccggtcgagtctgtctgtgccgacaccccttttttttttatcctgttaatgaattcctgctcaagaaccataaccatatagcgacgccatggtgatcgagaaaatttgcgttgatttacttttgggacgaaaataaacttgcgttcgttgaaaaatttgctcaaaggaacgcaaattttcaaccatggacatacatacactcggttgttcactgtgtccagatcttgcaatatcaccaacctacctactgcaatctgcatgccatcacccacgcacgcgagactactcaggccttgtctacaccatgctgctactgaatgtttgatgcacgaatagagtattaaatatagacgaaaaaaataactaattatataaattacgtgtaaattacgagacaaatcttttaagcctaattataccatgatttgataatgttgtgctacagtaaacttgttaatgatagattaattatgtttaataaattcgtctcgtggtttacatgtggattttaatttattttgttattagactacgtttaatacttcaaatgtgtgtcggtatattctgtataacacgccaaaaatttatacccttagatctaaacacagcctactttacaatgagactttgcattgcggctgctactacttgcctagcgttgaccaggtcacgagctggctgcatcaccaaaccctcctcgtgtgaatcccaagaaaccttgaccaactctcttggcaatggtcaatgtatcatttttccttttcttttttggatgttaggtcaacatattctacttttgttggggtcaacagttgcagctttacgcgacactagcacgggtggaaaggccatcggatcagaaatcgacggcccggattaatcgacctcggtggagagacgggtgatgaggccagggtcgttttggtgacgttctctgcgtcgatctgagccgtcggtccggtgatcgatggggcagctgaaccaggtttttacgattccgatgaaatccggtcggatttcacgaaatttcgacgtttcgacaaggctcgaacgtagaaaccgtttaaaattttgaggagtttcatctaaattcaaatttgaattgataaaaaagaaaaaaaatcatgtaaatactatgatattcacagaatctattgggatataaattttcgaaaaaaatgatacattgtgtatttactgaaaattacatcatgaaagaaaagaatttcagcaaattacctctattacaaattactgatcgaaaattcaatgatttcgatcagaatttcgccaaaatcgaccagttttcgagaacttgtcggcaaactcagtaaatttgatttataaaatttgttcggaatttaccggttttctaccggatttcacgaaattccaaattccgcctgaccgaaacggaaggtaatgtcggaatcgtaaacgctgagctgaacacacgatatggagagtacctgcgggtgcatgtcattattagctaattaagtggattcttaagcgtaattaaccaggtcaacggaagccttgacctgtttgtccatacagggtgtatttgtatatacgtgagtttttggtttgggcatgcaggagcatttctggtaacacgtagtacgccgtgtgtacgtgtactcgcattatataaccagatcaaattagcgacaaatatgatgtgattatatgcaacatgatcaagtacgtgagatcacatgagaaatttgccgcgtttgcctgcatgcgtacgataacttcctcctttttttctcctcggacttgtttgcggctgcgcctttctgtttctggcgttgacgattaattcctctcttttattactgaaaaaaagtacaaccttcatttttaatggatgacgccgttaacttttaaatacacttttaatcattcgtcttatttaaaagatttatataattatcatttattttgctatgaattattttaccactacaaatattttaagcgtgatttatatctcattcatttgcacaaaaaatttttaaaaaatgagtggtcaaacatgtatctaaaaatcaatggtgttatctattaaaaaacagagtgagtacctgttttagtaaaaaaataaatctcggtgtctttcctaaaaaataaacctgtacgtagttcaattatttgtgtgtttcttacacctgtgtacacttcttttttcaacacagattttacaagaaaaaccaaatcaattaagaagaacgcaacgaacaatcgtgtgatgatctatggttgcgtgcattttcgttcacctctcactctctcttctcattcagcttgatccgtccctgcgttggaaaatatgtgtacacttgcaaagttcactgatgattccgtgtacatgtcaaagtgtactgcaattccggtcttcacccaaacaccgttacatatatatctgtccaaatttgatgatctgccgtggtggaaatgtattgtggccaacggaagaagttaattcgaggtcgtcgtcttgttctgaaaatgacacgtatatattacggatatttgtgctgaataattcaaagctcgcgatttcgagttgagagttgttcttttttttttctacggagctattactgttggcataagtaggttaaaacagaggatgagacagagatctatggaaacatccattctctaagaagaacaaaaaaaagtagaaaccgacaagtttaaattgaactttcaatagattatatcttcatcacatgcatggtatttactcatggttttctctctcatctgtgtcgttccatcttatctattccctctatcataaaatataaataataaaatataaataatagatcaacataatcttcaagacactactttaaccaacgatatatatatatatatatatatataaagtaagatgttttaaataaaaagagctgcataatattagtttgtttaacattaaatatagtaattcatcttttttatttttttctattaatagtcaaaatttaaaatgtttggcttaacattattaaaaaaatctatattttgagacggagagagtaactgttgactttcgcttactacactccggaggtgagactgcgactacctaattatccgattcatgaaaaagaaaaagatagctaaaataatagtccaattatacaccagctaagacttaaaaatacttataaattagctcctgcttcattgtaatattcatccgtttttaaatatataacgctcttgatttcaaacgtcttattgaaaaaaaatactatgtaaataaatttaaagttacttaagtatgactcttgctttggatagttacactaaatattttaatagataaatgattgatctttacatataaaagtcagcaactttgtatattaaaaacgaagaaaatattacctataataagttgttcctgcaaggaaaaacaacactatcactgtccaaaagaggacgatagaaactggctaacccaacagcgataataaataccctctctttgcatttataaatgtactaatcaacatataagtggaatgagggaatatatcactgcggttaatgttgatttttccaccatatgtcttcaagtctgaatattaaataaaatattaacatcagaacatagtgagttcctgccatgatcactaatgtttcctcccgtacatggagtaggtgcaccacatgccgccatgatctcaaactggactcaactataagtgcgttacagtgcataaaactaaaataactaaaccgagtcaacaaactaactgaattgaatcgatcaaatttaacaaattaaatgaatctcagaaagtaagcactttcgagtcattatgagtggcaaatatcaagcctcattgtttcgcttattcatatccttatccgaatcacttattagcatatacaaaattatttgtgagaaaaatttttataaatgtatccttagtgactcaaaagctaatactgaaaaaaaaaactacaatgagaaaaaaatcaaattcaaaattgagttctagaattcaaattttggcttataggtacaagcataagcgatacaattaggccggatacaacgaacataagagttagttaccggtggaaaatcatataactagaatgaatggatcaaactgataactaaatttgaaggaatcagagcagcttacattgaaacaggaggcacagaagataaaatctcttgtctctgtcattgatcagcctagcttgaaaaacaaacatttgactcatttttttttacacagggagagactttttaaactctatctaggcaattagaccaaactaaaaagcccctctcatcacaggggtacgacagtgtcaatacctactccattggaacaatcttaaactaagagaaaaaaggataaaacatctagctactacagttaaaacaatgtggaacccactcttgctaaccgaaaacccaccaaccgattaatcaaatcagacactaattgaggcttgagaaacatgcattattcgctggcaaaacatgtatagtacgtcttagtttatagaagtggcatagttaatttaattaagtgcaaatgtcccatatatggacactgtctgttagttgcaactttcaagaggctgaattgtctttttccctgacgaaggtgacacccagatctatgggtttagcaatcaataatgaataaaccttctaggcaagaacgaatcacaaattgccttgtaaaaacacatcttgaccgtaaccacacactgatactgcagctggtagcagaacacagtcaagatcagcttggatcggtagtgtgtgtgtatcatctcaaaagctacggattggaaaataacagaaaaatactgtccatggatactgcaagcgcaggcaaggttaatgaacaagaccgcaaccggcaaattaagacagattgtagcacagaatgatcaaatactgaaatgattgaacaaccaaatcacaaaaaaattcaatttgatgctcttgtcgtcgtcgcacgagctcttagcttgactaaatcacactgtgatctgtgggccgttcaatcggtgtcccgacggtcaagatgtgatcgcctgcatcatcgtcgtcgagtatatatcagcaacaacctcaaccaaacatccacatggccactctaacccagctggaaaacagtcgacaagtaaaaataaactttatttaaaaaagatcagataaaagccactggataaactaataaataattcatacatgcatgtactatatatatatatatattactgttcatttgttgattataaatttaaaaataactttatttcaaaaagatcagacaaaaggcacgggataaactaataaagaactcacacctgcatgtcctatatgctatactactccatctcttgattataaaataacctgggtttgtcccccaaacgtactcgatcctaataaattaggacaatgtcattctaattttgtaaagtttgagatatgtcatcggtatctcaatgacatgtaggacccacataagtcaatgacatgtgggtcaggatggcatatctcaaattttacaaaattataatggtatggttctaatttttccaataatcaaaggttaacataaaccaaatggccactatacacacgaatcgattcagtcacctaccgcagcaaacaacaagccgagcagcctccaataattcatcccatacgtacctctcccctaaaaaaaccccaaatattacttcgattctagcccatgaggtcgacgacaacttaaaaagaaaaaaaaatgctcctgtatttttgttccagcttcatgcatgcacacacacagtagctcgtgctgactaagcggctgaccggtctgccccctgctgatgctaggaagctcccaaactcctaatctttcggtataaacacgcgcgtgaaaaaacacaacggatcagcgagcggctctgcaacgaagctccctaccatcccatggctgcgacagattgttttattacgcaaatggctttattattattattacacggattaattacccccctcgtgcccagtccaagctcaccctctcagtcaagccgaagcttaatcctcaccaacttccccgggttggtatatataccccgtctcctctcctaatcactagtaaacttgtagcttagccttgcaaggccaagcaggcagaggcagaagagcacaactccccccaaaggaggagtttgctcgatcgatcaccaagaacatcgagaggaagaggaagaggaagcaggatggatcgggaggtgcacaggatggcgagcctgaggagggaagggtcgatgtggaggagcggcggcgacgtgttctcgcggtcgtcgtcgcggttccaggacgaggacgacgacgaggaggcgctgcggtgggcggcgctggagcggctgccgacgtacgaccgcgtgcggcgggggatcctggcggtgtcgtcggaggacggcggcgccggcggggagaaggtggaggtggacgtggggaggctgggggcgagggagagcagggcgctgatcgagcggctggtccgcgccgccgacgacgaccacgagcggttcctcctcaagctccgggagcggatggaccgcgtggggatcgactaccccaccatcgaggtgcggttcgagaacctcgaggtggaggccgacgtccacgtcggcaaccgcggcctccccaccctcctcaactccgtcaccaacaccgtcgaggtacgtgcgtacgtaactactaccgcgtgaattttcctcgtggtggtttgatggcgcggcgcgatgccgcgatgtaacgtgaggagaaggcaaacgctttttgtttttgagatgatgaaacgattcgagagagaggccgagtttagtttcaaattttttcttcaaatttttaatttttttcattatattaaaattttcttacatacaaacttttaactttttcgttatatcattccaattttaatcaaattttcaattttagcgtgggctaaacacaccagaggtaggtgagcgtggccacggtctccgcggcgtcgcgcgcggacgccgctagctttggctacatccggtcaaacggtgggacggacagagcgtgcactcggtggcgccggcgccggcgccacggcgccaccgaacgcagcacgcacgtgttgggttgggttactgttgctacgctcagctttagttttgtgccctgggctacccgacgagttggcccaattgccggggagacttggcacttgtgcaagtgcaggttaattacaagcaagcaacgtgtactcttgtcgtgtgaggtgtgtttgcgtacggcaccgttcgattctgggtgatgaagattaactagaggcacataaaataagaaaattattaacatatgatcaactaagttttaattattttaaaccgataaaatagatttatttgttattttaaaatattttttatataaaatgtttttatacgagacgtacccgttttgaaaatctatatcttaaattaataaaaaaaccattattgattatttttaaaggaatagttaaatcctgaaaaaaaagttgtggatgaacagatcaaatagtaaaattaagattttttttgggataggaaaaggtgaaggaaaaaaaaaacgttttcttgaaaagaagggaaacaaggagcagatatagtggagcccactaagctaaaagcccccatggcgggcccggcctgcagggagactctttctggttcgggttcaaccaaactagttgaccgtttccactatccaccaacctcccaccctctccccgccacctcccaccttaccgccgccgccgccgtcgctggcggcgccgcggcggcgagacggcgaccgcttttcctacctcgaatgagttctcacggggtttccaccgacgcggcggcgcagaacaacatgacgcgtggtcgtcgcggtcgcggcgcgggggcggggctcagcggcattccgtcgagcacgtggcgcgcgcgcgcgagtcgcggtacttgtggccgtcccctctctcgccgacgcgacggcgcgctgcctcgccgagagaagtaagttttctgcgtatcgctgtgtgctgacatggttggtggtgccgtgctgtgctctccaggcaatcgggaacgcgctccacatcctccccaacaagaagcagccgatgaccgtcctccatgacgtcagcgggatcatcaagccccggaggtaaaaacccataacacagccagccatgcatcatcttcttctgcgtgtaccagtgcatcatgattcatggcgctcgcgctaacgcatccatccatggtggtgctctctgtgtaggatgaccttgctgctgggacctcctggctcgggcaagaccacgttgctcctggcgttggcagggaagctcgacaaggacctcaaggtctcggggaaggtgacctacaatggacacgggatgcacgagttcgtcccggaaaggaccgcggcgtacatcagccagcatgatctccacatcggggagatgaccgtgagggagacattggccttctcggcgcggtgccaaggcgttggcactagatatggtatgaacctgaatgccaagattacatgatactcctaccatctaatgcttattgacgcctttgacatgagtactgaggtttgctgtttttgctttgtttagaaatgctgactgagttggcaagaagggaaaaggcagcaaacatcaagccagatcatgatattgatatctacatgaaggtgatgatgctatcacataagagtgttctagtttttttttctctctcttggaattgtatatgtaaccaggattgcattggcgaatcatttcaacaggacatgtgatatatactatacatgtctactagcaatgtaagtaacaccttttatatttcatacatgtaggcctcagctatgggaggacaagaatctagtgttgttacggactacatattgaaggtacagtctgctagctgtggattaaaccgtagtactacaaatatgatttcttgtggcatttgtgtatggataatatctcattcctgcttctctgctacataaatgcagatattaggattggatatttgtgctgatacggtagtaggaaatgagatgttaaggggtatatctggtggacaacggaagcgtgtcacaacaggtatgactaacagtctttagcaagatgggggttgttctttaaagaaaaactctaactgtcctatatgttcacaggtgaaatgcttgttggtccagcaagagctttgttcatggatgagatatccactggactggacagctcaaccacgtaccagatcgtgaattcccttaggcagactatccacatccttggcggaactgctgtcatctcattgctccagccagcacctgaaacatacaacttgtttgatgacattatactcctctctgacgggcaggttgtgtaccagggtccccgtgaacatgtgcttgagttctttgagttcatgggcttcagatgccctgccagaaagggtgttgctgatttcttgcaggaggtatgtgctgtttatcatctgtaaaaattcatgccatttactgcacaaggttttcaaaatagacagtactgatatctctgaatttgttgaaaaaggtgacatcaaggaaagatcaggggcagtactggtgtaggcgtgacagaccataccgttttgtgccagtgaagcaattcgcagatgcgttccgttccttccatgtgggccgatccatacagaatgagctttctgagccatttgataggaccaggagccaccctgctgctctggctacttcaaagtatggtgtcagcaggaaggagttgctcaaagccactatcgatagagagcttcttctcatgaagaggaatgcatttatgtacatttttaaagctgttaatgtaagttcatatctctggtgcactaattttgattcaagatatcgatcgatcgatctgatcatctgaaactttctttcattgcagctaactctaatggcattgatcgtgatgaccacatttttccgtaccagcatgcgacatgatagagattatggaatgatctatctgggggcattgtactttgctcttgacacagtcatgtttaatggtttcgcagagcttgccatgactgtcatgaaactacctgttttcttcaagcaaagggatcttctcttctttcctgcatgggcctacaccataccatcatggattcttcagattcctatcacatttctcgaagttggtgtttatgttttcataacatactatgtcattggatttgatcccagtgtaagcaggtaagatgcattgatgcagatatctacatgcctaaaagaatccaagaaataagcttattttgtatgcagatatctattattttgcaaggtgttgcctagtatattgatagaaatgttccacaataaatgagtctattctgtgaagtctgaaactctgaataactttttgtgcataggttcttcaagcagtatctgctgctacttgcactcaaccagatgtcatctgcactattccgcttcattgctggaatcggaagagacatggttgtgtctcacacatttggacccttatcactgttggcttttgcagcattgggtggctttatccttgcaagacgtaagttactggattccctttcaataattgcatgttcttatatgtacttgaaattgatggttttaaatgctaattgttcctgacatgtttctcttttatagctgacgtgaagaaatggtggatttggggttactggatatccccgctatcgtatgcacaaaatgctatttcgacaaatgaatttttgggtcacagttggagccaagttagtgccacatttcttcaccagcaattgaacttgcaatgttataaactgtaaaactgaacatgtattttgcatgtcacagatacttcctggagaaaatgtgaccttgggagttagtgtactaaaatctcgtggtatctttactgaagctaagtggtactggattggacttggtgctttgcttggatacactctcctctttaacctgctctacactgtagctctttcagttttgagtcgtaagtatatttgaaagacattttttagaactccaaaatatctaatcaacatttgcgagctaaaagataataactgtggctacttgaatttttttcgcagcattcactgactctcatgcatcaatgtctgaggacgcattgaaagagaagcatgccaacttaaccggtgaagttgtagagggacagaaggacactaaatctaggaagcaggaattggaattgtcccatattgctgaccaaaactctggaattaacagcgctgattctagcgcaagcaggaagggaatggtgctcccatttgcaccactatctattagttttaacgacgtaagatactcagtggacatgccagaggtaattttgctcagaacgactacaagtgcgtaaaaatcattatgttaacacaggtttttaacccaattatgttgttttatattaacaggcaatgaaagcacaaggcataacagaagaccgtttgttgcttctaaagggtgttagtggttctttcaggccaggtgtacttactgcattgatgggtgtaagtggtgccgggaagacaacactgatggatgttttagcagggagaaaaactggaggatacatagagggagatattagaatatctggctatccaaagaagcaagagacctttgcacgtatatcaggatattgtgagcaaaatgacatccattctccccatgtgacagtatatgaatcacttgtgttctctgcatggctgcggctaccctcggaggttgattcagaagcaagaaaggttagttagctagattatgggctaacatttgtttcttgtgtatgtttttcggttgttaactgactgtacatcttacgcgctgaaccatgattacagatgtttattgaggaggtcatggatcttgtagagctcacatctctgaggggagcacttgttgggcttcctggagtgagcggcctgtcaactgagcaacgcaagagacttactattgctgtggagcttgttgcaaacccttcaattatttttatggatgagccaacatctggtcttgatgctcgggcagctgcgattgtgatgaggaccgtaaggaacaccgttaacactggcaggactgttgtttgtaccattcaccagccaagtattgacatctttgaagcatttgatgaggtgactagttgtttctttgggaagttatcctttgattcattagatgaactctgtatattaactacgttgctgttcaccttatctacagcttttcctaatgaagagaggaggtgaagagatatatgttggtccagtgggccagaattcctcaaaactgattgagtactttgaggtaagaacggaaaatcaacataaataacaatcatctcttcatgcttcagcacgtaggctgactaagtcacatcaaacggaaattccgttgttcatttgttcagggaattgatggcgttagtaggataaaagatggatataatccagcaacatggatgttggaagtgacctcttcagcccaggaggagatgctcggtgttgattttagtgaaatctacaggcagtcagagctatatcagtaagcttcggcacatgccattctgattaatagaatgaatagtgtatttgaactgcaattctaattattattattattattttgcatatttgcaatttcagaaggaacaaggaacttattgaggagctaagcacaccacctcctggctctactgatctcaacttccctacgcagtactctagatcgttcattacacagtgcctagcttgcttgtggaagcagaattggtcatattggaggaatccatcctacactgcagtgagattactcttcactatcgtcattgccctaatgtttggaacaatgttctggaaccttggaacgagaacgtacgtctctaacatatgttcttattattttaatctgtttgacaaataacttctaaacctttactcatcatatcttgttgcagtaaaaaacaacaggatctattcaatgccatgggatcaatgtatgctgcagttctctacattggagtgcaaaactctggttctgttcaaccagtggtggtggtggagcgaacagtcttttaccgagaaagagcagctggcatgtattcagctttcccgtatgcatttggacaggtaatttgtcttttagactctcggttggcctagttctaatctcatgtatataatgtatgacttcaaagactctgatgcctgaattctgacttgcatttgggattgaactgaaatggctgtgcaataagctattcgttagcactgtcaagctcttttggtcccataacctaacaatgccacttttccctttttaggttgcaattgagttaccatacatcatggttcagactctgatatatggcgtgctggtatactcaatgattggatttgagtggactgttgccaagttcttgtggtacttgttcttcatgtacttcacactgctatatttcacattttacggaatgatggcggtagggttgacaccaaatgagagcatagcagcaatcatctcgtccgctttctacaatgtgtggaacctcttctcaggatatctgatccctcgaccggtaggttattctcccatctcaatttcgccccctttcttttctcatgaaatgtcgcttttattagtcctttagaaccgttttaaatttctctacagaaaatccctgtttggtggaggtggtactgttggatttgcccggttgcatggactttgtatggattagttgcttcccagtttggtgatatccaacatgtgctcgaaggcgacaccagaactgttgcacagtttgtcactgattactttggcttccatcataacttcctgtgggtggtggccgtggtgcacgtcgtcttcgccgtgaccttcgccttcctcttcagttttgcgatcatgaagttcaacttccagaggagatgagaaagtgatcattcttttttgcattcgttctattgtactactgaatagctattagctatcctgtaaatggtatagagatcatcttctagtatttcattatttcaagcatgtaaaaattcggacatctagtaggattctctaggaaaaagaacccttgttgagcttcctgcctcttgaccagctctagctgataaatgtcggatgcagatgaatgtaaagtatggccttcaatgttttcatttttgtcgaattaatgaaagcagaaaatttgttgattcaatccctttgcagcaactcttcagaataacttttgttccattgttctatagatttgactaatagcggagtaaatttttcacaatgcggttactgatcttgtagtaatttactaacaaaataacctctatttttaaatatatgatattgttttcttttgaacataatgtttcactatttttaagaattatttattttcttgcattttattatgaaaggtatttaaagcattaattttttttactaaatttttaaataaatcgaaatggttagaagtcaatagctgcgaaagtaaggcctggtgccctggtttagttcctaaattatttttcccaaaaacgttacatcgaatatttggacatatgcgtggagcattaaatatagataaaaacaaaaactaattgcacagtttgcatagaaatcgcgagaagaatcttttgagcctaattagtccatgattagccataagtgctacaataacccacatgtgctaatgacggcttaattaggctcaaaagattcgtctgtggtttccaggcgagttatgaaattagttttttcattcatgtccgaaagccccttccgacatctgatcaaacattcgatgtgacaccttttcgcgaactaaatagggcctaatacttctgtcatgatgtgcaccttctgtttgatggctggaagcatgcaactggcccccacataactttccttttgaatttggggatgctagttggcgcagctctgcgtcaactttcccaagtcacacccgctgcgaggctgcgaccctctgtccccatctctcccgatgctaatgttaatagtatttttcctaattaatttagagttgaaagcttttcaaatttggaattaaaagtttcagattctggagtaagttttgaattttgatttgaaagttttggattttgagttgaccggcgaccgcacgatatacggagaccatgagctctttcccttccttatctggaggtgttcgctggaatcggaagtagcgcgcgtgcgctaatatggcaatttcgttcgaattttgaccggcgttaggtttcgctttacccgccactcccattttttttcccgcgctttctcgttcccgccaatccgactccgagtctctttacaactgcgtacgggccaagcaaagcgtaagcctcccgagctccatctcgacttggtcggtgcgcccataaattgcaagctccgcttcttcatctcgtcgcttccatcgatccatccacccctcatggcgacggtggcggcggcagcatcccccttcgccgcgccgcacgagatgatggcgcgcccggccgccgccgcgccggaggcgacgatgatggatttggggcagctgctgcggctgacggacttcgacaagatcgccaacctcggcgacggcgcctcgggcgtggtcgccaaggtgctgctccgcggctgtggctccagcgccgtgttcgcgctcaagaccgcgcactactgcg

SEQ ID NO: 59573 - DNA, 8857 bp, Oryza sativa
ctctctctctctcctgagcgccaatcgatctcgtgatctagagctcgcttcctcgacttcgtgtcaaacaccgggaggagcggaggccgatcggagcctaagcggggctgcgccaggagctggctaaccacaggcagggaacggcggcggcggcgcgcgaggcgtcggcgtcggtgtctgagctggcagagctggacggcgcaagggatcagccggaggagcaggacgccaagttcctggtgctgcggctgtacgaggcgctcaactccggggagcgcgcagggcgcaggagctgctcgcgccggacctcgagtggtggttccatgggccgccggcgcaccagcacatgatgcgctcctcaccggcgccgacccggcgagtcaaggttcctcttctcccctcgctccgtcgacgccttcggctccaccgtcatcgccgagggcaccgacgacacccgccagctctactgggtgcacgcctggaccgtcggccccgatggggtaatcacccagctcagggagtacttcaacaccgacctcaccgtcacccgcctctccgcatcgccagccaagaccaccgccgccatttcttcctccaactccaaccacgcctcctcttcggggccgccgccgccgccgtccaagcccaagtgcctgtggcagagccgccgcgccgaccgcgcgcacaagtcgctgccgggcctcgtcctcgccatctaagaacgaactcaaaagacatcaagaactcaaggcgcaaaaagcttccctaaattaatcacatataaaaaaaatcaagcgatacttatcaatagtgattagctaaataaataaaaacggaagcgcacgcactgagtgaagtcactagctatagtttattgcttatgggctaaagccgctcagctcaactgagctgcttcaggtttgcgtgattaatcccactaccactactgcaactagccagccagttaagtagtgttgcttttgcttgcttgtctgaaagctgaatcagcagtgtgaccagtagcatcagtagctttggtccaagtcattatggattatgtaagtgtgtactccttccacggtaaagctaaaccgtggctgaatatgaatgatggtctgttgttgttgcataaaagtactcgtagcttgttttgttggacacttaaaatcaacatatgtgatgtacaggtacttcttttctcttctttccccccattttcattccttcttgggttccaaatgaaccgagcaatgaactctgcttattttaatctggccatgaactgaataattaactcctacgaagtttgagcaaggaacacatctgcttgcgtgaagaaaggggatggactaattcgccccacacttatggaagtcacgagctgaacggcacctccctgatcaatgaatgcatggttgatggtttggatttcggaaaaccacaacgaaatcaaagttttgtttggataagctgtgaggataagttgtccagctgctctggagaacccctaatccgaggagaaaaatctacaaaatccaagggggacaggttcaggatgttgctttccaacaaggctatgatagcctcctctttgatgtgaagttcctacggattcccggtagatccggaagaaaaattaaacagcgagttcggaatttctttgctctcaagcgatgtcatttccttttcttctttttttttttagagaagtaagcgatgtcatttctttgctctctagcctttgttctgttctctcttttcctcacgatctgtcgctgtcccaattatatttgtggcgtaaataaaaaggaattccactgatatgtcaaccgaaatccagccggccacatgtttgcattctcattttataagcttaaatctgacttagctgtaaaatggtattcctccgttagaaaaaaataaatttcacaaaactaagtattttgcacaatctattacttttagcatgaagtgatggaatactaagatcactggtaaaatttactaaaaaaaaacgttacacatctagcgtttggaatttgtctaacaagggtcccttagaacactaagatcaatttataagggtgctaatctacccacttcatggctagaagtacacaggttttggacgaatggagtacgtgtagccgtgtaggactctaaacttgtccggtttgcccttaataaccattatactccgtatttctggcaggcttaggcttcaccggtcaccacaagagccataaaaatcgtgaactccgtcagaaagtgcatgcggcttctagaatttcttagaaaaggcttaactgctttaagcatttcacaaggaaaaaaaaacggtgatgacatcctcttcagtagcttctctgattgctgcacccttttgcgtgcgtgccacgtgacatggagtatctgggacggagcagatcagcagaaactgacacgatggttaatttcctcgccacgagatagacgtgtttacagtgtactattcactactctcgattctcggcatgaaacatgtgcggtgaatttacggtttacggagccctccagctttgaacgttacaggtgccaataaaactttatcggctcgactaacagcatcagtctgtaatcgtgcacgtacgtattagactagagcaatgctccggtgctttctacttgtagtattatactacaagtaaaattaatcccgaccgttcattttaaagggtagattagtaatctcctaatatatattaggagtaattttggccggatcaattttctctgtctcggtcggtcttggcttgatcgcgtcaggtccgacgcaagcacaacatctcgcccgacgcacgttgcttatcactactcctcccagcacgcggcggcgcggcgcggcgcggcgcggcgaaaccctcaggcgtcccctcctcccacctctcacctgtctatccgttccccctcctctcctgtattccacgccggcatcctggttcgccgtcgtggccttctgtccgctgcgagtggccttccgcgcgcgtccgattccaccggagcccctgtgcaagacctgagattcttggcagtgcccactttggaggattcaatccattccgccggcgggtagtgatctccattccgtgttgccccgattgtgtgggctgcggccacttgggaggcaactgcgatacattccggctccccggttcccctccgtgcgtgcccgagtcttgtggcttgcatggcgagcacctcctcgaccgcgagcaaggcatgagattcagaatatgcaacagtgtcgctcgctgcgtgctgccgtggaaggcgtcgccggcgaacctgatagaccgcaatgctcagaggtttcagcacatccgtgctctcagcggcgtcaggacactggatcgggcgctgaacgatgcatgcggcatacccgatctgctagctcaggatggtggccggcgatgatgtccgcacgctctcctgcgggcatgacttccacgaggattgcaacactgcaaagtggttcagtgacaacaagaaggcctgcccagttcattctgcttgtaatattcagttgtatggtgttatgtgtcgaatacttcattgactaattgacgaggtttgagatattgatgtttattggatcttgtgactgtcccaatatattcattgttcagtaatggttcaagtaaaaaagaaaaggtgaatagtgagggactactagtaatgtcaatgtgttgaccatgtcagtgtgttgtgcatttttttgtgtgcaactgtgatggggtgagaagagtccaggcaatttgaactgaaatatgccatcctgctcctggatcagtaaacaagttgttttgctcctgaaaaagtgagactgaaaaaaatctgataaactgcttaaatgagatttttcactatcagagttttgcccatatgtaaattgcatttcagtcagagctgtaattcaggatttgttttatatttcataccattgaaacatctaattgcattctgtcatattctggtgctctgaatcatcgctacatgattcctttcttttgctcatatgggggtagctaagcgctcaattgccactagattgaatttttttttcaagtcataggacaatgtctactaatgggggcttagaacatattgattcactctttgctgcaaactccctggtctactgtcgtgtttatgcaaaagcatttgcattagctccgcggcagctagtgaagtcatgcacagtccctattcatgtagcatccaaacgcctcattcccaagtcccttagccgctcgtacggtcgccggcggcgaccaaatgccaccgcctcactcgagctccgccaccgcacatcgccggctgccgtagctcatttcttagacaatccgagccgtccaccacatccccatactacactcgttcattcacagttgcccattcctcctacctcgcagccgttcgccggaacccgtcgaacgtcgtccgctgtccaattgcccggctatctcctctgtcttggtcaaagctacatggcaggactagtcgtccgccgtgggcaaggaccttcagcggctcggcgaagaggagaagggccacccttggtcgctagagagggaggagatgtcgatcgcgctggagatgatggaggcggagagggagatgcacaggcgacgaagtcgacgatggatggggtcaggcgcttgagaagggcgaaggtgtagagttactgaataataatttacaataatacccttacgtgaattattatctatgaacaaatatacccctccatgtttctactaccactaagcgtggtggtagtagaactagatctcaacctgacgattatatacgatcaacggctcggattattttctactacaagtagaaagcaccggagtgaggctcattagactattagcaggcagaaaaatgttgttgcatatgcaagcattgagtacttactactccttttacctccgttttataatgtaagtcattctaacatttctcatatttaaattgacgttaacgaatctaaacatatatatctatatagattcattaatatcaatatcaatatggtaattgttagaatgacttatattataaaatggaggaagtattaaaaaacagtctctgaacagtggaaggcaaaatagtcattcaacactcatttaagagttactgagacgtactcaaatgttacttgtgctaagatacagtaccttctggtacgtactttgacactacaaggagtgcataagagaagggcctggggtctttacggctagcaacacaaactacgagctagctggtacgggttcaagcctcactcccttagtttaaaaatcaatatagtcctttctagattaatcccatttttcaaaaggagtgcataaacctatcgatttttattaaaaaaacactgtaaggaaatctatcacgaaaattgaaaagtattcatgtgcggcgaacgggaccctatcccccgaaaatgcaagcttagtgcatttggagtttcctctttttaaaggaaaagggcaggatttccctaagaaattctacaagttgcaacctcttacgatgagtgcaagattttggtggtttccccctagatctccctcaagcaaggatcgtttcccacatgagcggagctagataggaggagggttgcctaggaacccgatcaaaaaaatttttaactatagtttagctattttcacatatatacaccactcgatctaaattcagacactcatattagtctaaatttaatctaaaataaagtaaagcaagcgagtgacccccctctctagtatgttctagctgcaccctgatttcccaagtaacgatttaggcttcgttcgttcctgggcgatccaggggattgagagagaaaagtatctcattttccgcgcgcacgcttcctaaactaataaacggtgcgttttttttaaaaaaaaattctataggaaagttgctttaaaaaatcatattaatccatttttaaagtttaaaatagttaatactcaattgatcatgtgctaatggctcatctcgtttgcgtatcttcccaatctccacaatcctcttcttctcaaacacacccttagctgatgattgctaccatcattcgtcgtgagcgccaaaagcatgcaacctgttaggcgcatctggcaatctggcatggagcaaactgttgtggcagctggatttcctaatccacgagtttggcgggtgctctccaagattaacacgcctgaaacacgtgcagcttagtacgagcgtactgccgtactccagttaagagccgctttgaacactgcctgccatcgccaacagaagcccattgtgactgactgaactttcagcgtcccaatcaagcacctagcttttggtacactactgtactgctaccgctgttaatatacttgagaaggtacgtgtaggtattaaaaatttacactaaaaattttaatatctcgagatatatgatatctgaagatattaattattatatcagaaagtatggtatcttccgatgttttttttaaagaagataaaattacacaataaattttgtttttgcgggcatgaaaaaggcgactttctccaagccgacgacgatatgcatgaaccgatgaactctaccaaggcgcttcgtacctgggggtgtggctggaaagctcgctctcctatctgatcctgtggctgctagcgcttgattgaaccagtcccaccaccatggccaccgcctttattatcattgggttggtttgttttgtagtataaataggccttaccaaattttgtcaatgtcaaattctgataagttttggcatgactaattttggtaagggaaaccaaaatagcctaagttcactattgaaatggcctattttcttaggcataccaaaatctggcttcaaaccaatatacactaaacactactaaaattaccaaatattgataagcctaatttagttctcaaaccaaaccagcccatcgtgccgttgaaagctgacctttcatgtaggagtagtaaactgactgcagatatgagagcaacgagacaccgcgatgcagtcatgcatgatgctcgccataccaagccaaagctttggaacggcagttcagttcacttcgctggacacactgaggccacgcactctgcatgcagactgcacaaagtcagacgttcaggttccattcggcaggtgtgtattcagtattccaggggcgccgaatccgtttgagtcgtgagcagcagatgtgttcttgcttcttgttcagatgacatgttggtttcctcaattatttagccttgaaaataatccgtaccaacactttcaaaatgttaatggtttcctttaatcctgaagtatatccttatctattaacagtttcagcgtgaaaatgattttacctttgtgtggcacatcaacaggataagtcataagtgataccattccaaaacattcgcttatcagggagccatggttctctgatcaagttgactgttcagtgcagctcattttataggggagagaccgaatagcataaaaagatgcctcgattagggaccaagaatatgccatggtcagctcgtaatgcttgcatctgtgataaagaacaattcagatgaagtcttgcctgatcagttgctgatcaactggtgaagattctcgtgaaagcggcgacaggaaagggagaaaacgaactgtcctgtccaggagtggcgacagggtatcaaagatcgatccagcgagcatccgaaactattccctctccctgctgggtttggaagtgatggttgtagctgaaacattccaagtgtaactattaaccacaaaaggtaaatagcagcagcagcagcttaacccagtgatatatagaacctgatactgttagcttggacattcttctatacaatctgcagcctacactggacgatcacaatttgcaacatcagaaaagttggcatgtagcacattatcagaatgttcctcagaaacatacgatcagaatatatgcccgaggaccgtaatattcatatcaataataagttaccagtaatgctaggaggatataagcagaaaaaggttgatttgcaagtaatgtatgattaatccaaattggcatgcgattctctctatcaattatgattcagataaagtactttagtactaggctgaaatttttgagaattctgaacatgtactatttagtggccggcgtgctcgtttctgaacttcaagcttcgcatacggagccaccgatgctgtagccgtacacggtacaaacaattcgatttgctcgtaccggttattaaagagatggaaaaaattggggcagacgaaatcaagaaagggggctgctatataacggaatcccgtttttaaacgggatgatactggttaggtatcaggtccggtatcgggtgatacatatcaggtatcaggcgattctaccacgttttcaggtgatactcgcgacgtatcaagtgatacctatcaggtatcatgtgattcttgccacatataaggtgatacttgtgaggtatcgggtgatacctatcaggtatcacgcgatacctattagatgatacttgtgatgcatcaggtgatacctatcaggaatcatgcgataccagccaagtatcacgcgatacctaccaggtatcacgcgatacacacccgacattgacgccgccgaccactgccgccctagcgccccttcctccctagctccggccaccgctaccgctccctcctccggctccggcgacgcaccaccgccaccccctcccatcccctggatccggcttcggccaccgtcaccaccccctccctgccgg

SEQ ID NO: 59574 - DNA, 10214 bp, Oryza sativa
  unsure (1)..(10214): unsure at all n locations
catctctagtcatgctcgcatcaaattgggagataatgattctgatagttgtagcatgagcctcctatttgcagtgccctggtttggaaatgcggagttcgactgtaactgccaagacatgggaaatccagtcccctggaggaatggctgccggcggggaggcccatgccggcgcggtggagcagtaggaggttgactggaggtcggacgaggagttcaagaggttcatggggaacccgtccatcgaggccgccatggctccatcgagctggagaagaagcgcgccgaccggaagctccgcgagctcgatcgcgagcccgacgccaacccgctcgccggcctcctccgcggcctcgccagggactagcttgccgagaacaccgcggtcagcctccctgccattcccacctcacgcttgctctcggatctgcgcgtgcgggggtgacgtcgtctggtgtgcggttgtgctcgtcggcggcaggtgtggggggtgacgtcgtctggtgtgcagacgcaggagtgtaggtgggccttcacattgtggcgagggaactgaggatgacatgtgggtcccatcattttttattattatgtgtgcgaaactgacatgtgggtccaatgggttttattatttttctgaattaaattgccacgtaagcgccacgtcagatgaagaccgagtcaaattagctatgtaggcgccacgtcatccaaaaccgccatctaaaccgccgagggacctcatctgcaccggttttaataattaagggacccgttgtatctggtttttcggttgaaggacgaaaatcggattcgttgacaagttaaaggaccttagatgaacttattcctctacgttgtatacttgtacggaataagttcacctgccatccctcaattttacaccgactttgtatgatatcccttatcattaatatcagaaatcttcacccctaaactatataaaacaattcaatttaggtcccattacagtatagatacatgtttttgctgacgtggcatccatgtcatcaaaataaaaaagtatgtgggtcccacatgtaggtgaagcgagaaaaagatgtggggcccacctgttgggaccatcttcttagagagaggaaggccggctagagagagtgggggcgccagcggtagaaggggtagagggagggtgttgacaggagatggggagagaggcggacgacgcgacggcactggcggttggcacgacggcgctagcaggatagggagagagagaggcggatggcacgccagcggcttggagcgcctcatccagaagctccgctatcctccatcgacaagaccgccgccgtatgcgtcttcgtcgacttcatctaggtctcccccctccccgcctctgtcaaagctgccgaggaccaagccgcataactcgtcgccatgcgatagggtttcgccaaggcggtcgcccgtcgcctccactcctgagatgtgaagagttgcctccacctccacctccacccgccttagtcgcctcccgccgccgcgctttgcccaccgtcgcagtgaaggaaggtaggcctcctaacggcggtgaagggtgcgtttgcctatgagtccaactggaggacgtttgtggacgcaagccgccacttgggaagaggggggcgggcaccactggcacgcggatctagcagcccgctgctgcgcccgctttgcctgccgctgcacctgctcaagagaggagaagaaaaaaacaagaagaaaaatttctcacttacatgtgggacccacatattattttatttttattttgctgactaggctgccacgtcaataaatctatgcatctatattaccatgggacttaaattggacggtttgatatagtttaggggtgaagatttctggtattgagcataaggaatgtcaaacaaactcagtgtaaaagttgagggattgaaggtgaacttattcctacttgtacagaggcaaacgtgtacatgggctgtggacccaacgcgccaatacggcccatcgatattttcgcacgcgccgactacgaggcccgagggccgaagagagaagcgaagggggcagaggaagcaggagagccaaatccctcaccgcggccacaatatcgcggccctctctcctgctcgtctcgtctcccttcctcctcgtcttcggcggcggcgcggcggagatgttgtccggcgacatacccccgaaccagacggtctacctcaggaacctcaacgagaaggtcaagaaagaaggtacgcatcttctcccgggcggcgacccagcgcgcggccgcccgctggccaaaatccctcgtaaaaccctagccctcccgatctgggccgctgctcgctgtcgcctactcgcctcgttgtagggtttggtcatgtagcgtccggaggtttaggatgttggaggtgttttgattttttttttgttcccatagcagttgatgaaggggggcagtcggcgggcagatgttggagttgctccatgttttctcgctagaggctgatgggaatgcccatcttgattccgtttaccaggttaagctgtcgtttggggggaaatctctcttacattgtgtgtcatagaaattcgagtgtgtagtgcaaaaaatagtctcctgttctgtgtaccataagctaaccagataaccctagtttgtgtaaaccatcgctctgttgttcaactatggtataacagtacacctctttgctcgattcatgcagtaacttatgttgatctttcctgcagaattaaagagatcactctatgcgttgtgctcccaatatgggaggatactggatgtggtggccttaaaaacacctaaactgagggggcaggcatgggtggtcttcagcgaaattaccgccgccacaaatgctttccgtggactgcaggaattcgatttttatggcaaaagaatggtaatcatttgcactttagttgataactgatgttttaatttccaatttgatttttttatatggtgtgtatgttttgccttagagtaacattgcattgctattttttcacatgggatattaagtatttgcagagttcagtctggtgccatatgttgggctgtaaattttttacaacaaggttctaaattcaatgttaaattttcagtaatgaagctactcagatggttatcaatttaaattttcagtgatgcaagtaatgtacagttacacatggatccatttattaatagtatgataataccttgatctggctagcaagcatcatatcatttgcgttctacaatgttttgcgggatgcttaggttaatgaagtagcatagataaacatgcattcttcatagtgttggtcttacatacattataatttgattatgtagtaagcattcacctttttgttatttgtagaataacatgtcaggataatctctatctagatgctgaaaaacatatgccttaactactgtagagtcaattgctcctaatacaatctcttgtttgtatactgggcaagtgaaaataaacaatttatatggacggtctattacatcacaatcagaagaaaatagatcaggcttaatagtaccactctatttattaccaagggctagttacaacttaattcttttccttgccctgtgcagcgagtacaatatgcgaaaacaagatctgactgtcttgcaaccgaagatggttctactgctccaaaagagaaaagaaagaagcaagaggagaaaggtatttctaattgcattttcatttatggatgtttgatcgttctatgcacaaaactttctgatttgcaatcctagcagataccttcaggtagtacaggaatggggaaatactaagaattctacagtgcaagttaaaattgcattcttcaatatcttcaaaactagggcatcagcctttcaaacatctatgtagtgtatactccctacatcacataaacatgccatttcggacatacatcaacttgaactttcaaaatcttcggcattgatgtcttttaagtatttcaattatatatatcaatatcttaggtctgttataaaacacgtacttccaaagtattctcatcttcttggtgcctatgtccaaaacaaaaatgttctcatgaatggaagttgtgtagtggctagcaaaatggaaagattcctttctctatctctgctttttgtatcaattgtactcctgttcattcttgaaatttaaggaggtactcataagctccttttccaatagaagaatacattaattatctcaagaagtctatgtctattcgacacgcatgacacattggttgatccaccaattgtgagcaagctacggagacatttaatttctttgttcttgaagataggtaattacaccatagtttctcacacttccatgatgctccacctatgtctatgaacttgagagcccaacgtttttttttatactttgtgattttcttaaggtcctttcaccacatttgacttcatcctagacatcctcaaatgccttatgttacgttaggtacacaacactttctttggtgatgaagatgtatgttgttgtggggacttccgtctgaagttttttcaacaataaaataaaattttggaagtgcctaaagtgtccgctaagcttatcatgagcatcattacctctattttatttcagatgcgcaagctacttttctaggagtagtaagttttgtgttggtagttcagtcatcagtcataacttatgaaacttgatttatctgcttgttgagttccctttggtttggttctactctttagttattagggaattactgcttaggactacattttattttcatttttcactgttcgattattgaagaacatgtatttatatgttttgcatttggtttttgctctcttttagcagcggagaaaaaacgacgagctgaagaggcgcaacaatctggtcctaatgctgctgcccaaagcaatgggactgtaagttctttactggtttatataccatgatttcgttttttataccattattctatgccacctcttatcaccttgccactattatttcttgaagcctagtttttttaatgcattctgtcatatatatagtgtggattttgctgcttaggttcatctattctgataccagatatctaccacagtgtttctttgtgccagcattgtcttattttacacaaatgttgaaatggtatatacacttgactggattatgtcttttactagtttcaaggtgaatgtccatcttttggttgaaagatttgaggcatcatagggaattaatgaattatatgtgtgtgcgcttacattagggggctacttggtcatcttgacttgtatggaaaaattactgctgttcaattctttaaattgaactatttttagattattctggcagtaggaagatagtcttacggtagtacagtttttttgttagctcaccaatttatgtcctcggaaactctgctataactgttttttcttgtctatcccagaaggaaccaacttaggcttcctggtaataactaccttagtgttgtccatcttccatgacatgggttaagtgggtagtagttagtaagatataatatctctctattgttccattaatctatgctgaatgtatcgctatcgtcaattagattatgtggacaaaacaagcaccggtatacttactactttcatattatcatttgtaatgcaggaaatttcatatgctcaactactatgcaactttgagtttcttcaagtattttgagtttctttgttgacttctgtgcagggttatcaagcctcacgcctgggcaagacttcgcaagagccacctgcacctccaaacaatatccttttcatccagaacttaccagctgagactacaagcatgatgctccagatcctgttccagcagtaccctggtttcagggaagtccggatgatcgaagccaagccaggcattgcttttgtggaatacgaggacgacagccagtctatggttgcaatgcaagctctgcagggtttcaagatcaccccatacaacccaatggctatatcctacgcaaagaagtgaatgatccatgggatcccacaatctggcaagaaaacctctgtacttgtaagactttccgcccttagctttcaaactgctgtatcagttttctaacactgtatttttggaaagcaattgcttagtttagaagtctttgttgcttaaatcatatttggtcttcattctttttgttaaccctgcttttgatgctggcatgtctggtattgtggcctttgtaggctacattatcttttctcctacactggtggtagaagttagaagatgtatccctcccttaaaagccaagagaaaatcatgcccctatattcccctcgtccattttccttggtcagagatgaatgaggtgtatatgccatattatattgccaaaaatcataagtgtcacctcagtagttgcaggcatgatgattgttgaacacgtattttagtggtgggatggtaggtttcgtggccttgtgattttatacaataaagtgtgcggccttctactactatttggctattatgggattcttgttgcattcgtggccctcatattaggtgtatgcctatccattctcccatctatgagtaactttgaagtccatgaacgtatattgtgcatgctacccatgcattggcatgtttctagtggaaaagcgatcgcgcgaagatagccacagccactcagccagccaggctacagtgtagttgtgctcactcgtgcaacctatgtgctggtaggagtatctcttatcaggtcggtacaggtagccggtagcctggaatttgtaggggcgttgtcttgtcgctggacaccgttcgttccggcaaaaatcacacgagataaatcttgtagcgtactgaccttgtgaacagtatttttgtcgtgtaagagggggccgggaggaaaccatgtgacatgttaaaaggcgtttgcttgtttttgctgtgggttaattcgcctttttcacctgtgggccgggagtatgctggatgtagatggatttttttctggggttgcttagaatggtactaactatgatttgttttcaacaattcatacagaagtataggttttactgttgtctctggctgcagcccgtgatattccttgtgctaggaaacaaagcagcaaagacaatttcatggtcgttctcttatccctgacgaaagaaaggggagattatacgatcaagtgatgacggaatcggcgcattacaacaatgctgcggatatgatgaagtgacgacgacagcatttgaatgttctgttctgtccacacaaaaacgcaaatgtgcagatcatttcaacagaagaattttacctttcgattccaaatttctcagctatttcacgcatgccctagcagtaagtagagagtactacgtataatgggagttcacaagaatcgtcgcatacacgagcagcaacaaagccaacaaaattaacaagttcagatgcactccgccggcggtacggtggggcccacatgggtagtagagtcacctcccggtgggtcccgcttgacctgacctcacccctcccccgggagaacggacggagaattaattagcctcccacaactccttaattccatctcctctcccctgctgatgtgttgtgtcatcgtgtgcttacgagaaagaaatacaccttggagaagaaacaaaaggcccggcccgacccgacgaggcgacgaagaagacgaagcgccaaaaaaagcgtaaaaggcagcgcagagagctcttctcttagccatctgaattggaaagctgcactagcgcagtaggcaccagcggcgcgcatccggcagcttgcaaccgagaaaaaagctgccattgttagcttgcaaggaggagaggtggagggcaatgcccctgtcgaggcacgaggtcggcaacgagtactcgctcggcggccgcgagctctaccgccgggccaaccagcacgacccggaggccgtcctcgatggcgtcgccatggccggcctcgtcggcgtcctccgccagctcggcgacctcgcagagtacgacgaccctccctccccgtcctcacatgtcttactttgatttatttcgagagagagagagaaaaaaaacgccttcttcgattgctctcccggttgaattcctcatggatggtgagcttttctgattatatttcttgagagcatttttttctgagttattatttggcgaatttcctgggattgttgcgtcgcaatttgctgggggtcaatggtgatgggatgttgatcgcagtagatcacctaatgacctaatgcatttgttatgaacaaacaccggaggccttggtgatcctttttttcttcgaataggtaggtgattgatgtgttagccatttgacttccaggtagttaactctggtaatgtcctagtcctagctcagcaactccaacaaaaaatatcttttttttttctcccccgtcttctgattgtgatcgagcacgtactggtcatcatgtactagcactttatggcccaacttttttttaagaaaaaagtctcaggttcgcgttcatctattgaaggatgctctgattgatttcttagagcctggaggttgaagcaacggaaaacaaagaattgcataaaagcaaccatagtttgacctggattcatccctttagctgttgctgtgattgcgatgataatgatccttggcatttctgttgtttatcaacgttggaatcagttggcagaagtccaaaatgcgcatcaaaattcatcagacgttcttgaattccatttaagccttacaccagatggctgttaggacataggacacatgtgtcgagtactcttcttttcactttatgaacaataatgatttggctatttttggatacaccaactaattaaaagcctcaactgatatattttgctataatcagtaaagattccatgtcaccacacggcaacataactagaacttctggcaatcttagtatcatcatgtcataatgcaaatcatgatgccatcaaattgtcccattgcatgtgtgcagatttgctgcacaggtgttccatggtctgtacgatgaggtgatgacagcatctgcacgagggcatgggctcatgctccgggtgcagcagctggaggcagagttgccactcgtggagaaagactcttgtcatacagactacctgtatgttgcttctaacaggggtatgtgcaacagcacacaacacaagcttctctgcattctgaaagaaacaacttctgtcacctctacctgtttctgctaaggaaagcgtcttctactggtctcgttcataaaaaatcgattggttttttttgcaggaatcgagtggcattcgaatccgaggttggaaagtggggttgtgacaaaaggcgacacgcctcgcttcatcatggactccatcaagaagtgtcatgggcctcccaaattgttcatgcttgacaagtatgatggcctaacctttttctgttcatgtgtgtgttgagcttgcacctactgatgactgaagataatgctgatctttatggatatgatcatgcatttttgcaggtatgacattggtggtgagggagcttgcttgaagagatacacagacccgtccttcttcaagacagattctgcatgttctagcatgctagagcaaggaattcaaagagaaagaagacctcttagagctatggtaatgaaactgaaaacagtagatttcttcggtagaatgatcctatttgactgaacctaatagattgagtgcttgtcatttcttttccatttcttccaggagatcaggccgaccttgcaaaattctgagattttcagaccacctaatgcagccaacaatgactccaagtagcacccactataatcatctcataccacccagaattttctcttctgttttaatctcagacaaacggcaatttcttttttgtagattggagacagatttgtctggtgaagctttggatgaagtcccaacaaggcgccggcaactgaagtaccgacaactaaatggatctgtgttccgaagcttcaggccacagatgcagatctnnnnnnnnnnnnnnnnnnnnnnnngaagccctgctccatgaaccattcagaagtgcagatatctttcactgactcacctgacacaaacactgaagagagggaca

SEQ ID NO: 59575 - DNA, 41468 bp, Oryza sativa
taagataaacaaatcaagatacaaaacatcacattgtgtgcatatataatctgagctcagatattaagatagaacagttgatttactgacccaagaataaagggaccttgccatgcatgctgtgatgaggcagtggatggcaaagttaatcagtatatactctagaaatgtgatgttctgttctcatttcatactgcaaactttcaggcttttctccccacctattcttcacttgatattcaggaattgcagaacatttggtattcaggaaacacgaaagatttgagcattcaaacaaggggacctttccgctacctccgatctgaactcgagtttctttcatctgaagctgtcactttggtctaatctttcattgttcatcatgtttcatgataagagtaggacagaagatttcatccaaaaatagagtttcgacaagagaagtggtactctaaaaggacatgagcaattgagcatcaatactggctgcaattaagaataacaaagtgacaacaaaatgtgattttctttgaatgtcagcctgatcaaaagggttaatatatgcctaaacagaaagggcagagctttatgaatgcctcaccagaaaaggccatcattctcaacttcccaatagctcggaaaatcaggaccaaagatgagtaatgatgatgaagaaattaccctattcaattggcaactgcagaacaagttcatcgaataagcgtatcaaattgatttgctaccccaagttgagttctcttattaaatagcagagcatgttgccatgacaacagcataatctgaatatgcagcagttttaagataaacaaattaaaacaccaaacaccacattgtctgaatacataatctgagctcagatattcagatagcacagttgatttactaacccaagtataaagagacctactgtcttaggtggtgttcttttctcctaaagataaagatgaagatgaagattaagttttttatacaaaacgaggtggtattaacatatgattgattgagttttaattattataaacttggaaaatagattaatatgatattttagagaaactttcatatagaaagtttttgcacgaaacgcaccgtttagcagtttaaaaagcatgccacaaaaatcttaattttcatctagagaaaagaacatgaccttactctaaaccttaggcatgtataaagggacctactttcttactctgcaacttcccaacaaatttagattaaatcatgtctggttatatttgactgttaatctccttgcagtattctcgtgcaggagaaaggtaacaacattcttttattacctattaaattatgctaacaaaaataataaatttggctgtgaatattcatatactgaatatagtttaatttattacttttgttataacttatagaagtcgaatttagacataccggtagtaatataatatatattaatctatcttatcatttttttaaaaaaattgtaattatttaattaacatgcaataaacgagtatacatccacctatgtgattaaaaaagtttcccctgatggatgactaattgacccatactttttcagttgatttgagcaaaatttagaggtaattagagggaagatgaaaaagtctgtgtattatttactggtgaatctgtgtaattctgtgtgaaatgtgatgaggtaaattcgcatggctaagacagttttcagtctgggaattctcgttcgagttcatcaaacgaactatgactgagatcatcagattctgaaacaaatttggcagtcaaggttgtcgcctctcccaacgcagatcactgatgcggctggttaaaattcatattcaaattgatcacaaaataataattcagatgcaaatttgaagtaggttctctggagtagcatttgagatctggtgcttgcctctgcttggtgtgatgaggcatgtgatggcaaagttaatcagtatatacggaaatgatgttctgttctcatttcatactgcaacgttttcaggcttatagcctcagctagtcttcacttcatactcatgaattgcagaaggtttgagtaatcagaaattgcaaaagatttgaggattcaaacaaacctttgcggtttacgctcctttggtctgaactcgagttcctgtcgtctgaagctgtcacttctctttcagtgttgagcatgattcatgataagggtaggaagacaagatttcgtcgaaaataaagtttcgacaagaaaaaatagtaactaaaaacagtaccctgataagacatgagcgccaaagctgtccaattaagtgtaggacaaattgaagttagaacaaagtgacaactaaatgtgattttcttcgaatgtgcaacttgttcaaaagagttatatatgcctaaacaaaaatagcagagcttgacgaatgcctcaaaagaaaaggccatcattctcaatttcccagtagctcaggaaatcaggaccaaagatgagtaatgatgatgaagagattacccttcttaattggcaaaagcagaactaattcattaactaagcgtatcaaattgatttactaacccaagttgagttctcttattaaatagcagaactaattcattaactaaggccctgtttagttccaaagtttttttccaaacttccaactttccatcacatcaaacctttcatacacacaacttttctatcacatcgtaccaatttcaaccaaacttccaaacttcagtgtgaactaaacacagcctaagcatatcaaattgatttactaacccaagttgagttctcttattaaatagcagtccatgttgccatgacaataacataatctgaatatgcagcagttttaagataaacaaatcaaaatacaacacatcacattgaatacataatctgagctcaggtattcagatatcacaattgatttaccaacccaagtagagtcgagaatttcgagttccacctgaaccataggcaagtataaaggtatctattgtcttacttcacaacttcccaacaaattttgattaaatcatgtcagattatatttgactgtaaatctccacgcggtattcttgtgcaggagaaagatacaaacattcttttagtacctataaaattacgcacattagcacacatggttcaagaacaaatacccacaggccatatgttattcacagaaagaaacgggagcaagaacaatttacacttcacggcaaggcaagaacaggcagacttaagattaaaacttgtggatgactgatatttacaaagacataaagaaccagaacacactgataaccttggaacagtgaatgtttcatcctctaaagaaagtttggagtgcctaatcttttggattctaccagttctctttgacgatttttgacttctcaaatatgaacttcccttccttgtacttctgtgtttcctcataggctctctcgtacttccagcccaacacctcccggcaatcattgcaatagatatcagcaacagtgtgaagccccgtcataagttgcctgtcctccttcgcgcccacaacaacattcatggcatgagagaacagaaaggcacggccattcctcccctaaaataaccaaaataacggtaagtagaaggcatcagccttcaagcatttgtctaaaggcccaatgatgcagtatttcttcagaaagctactgtgcttgtgttcagttattttgagttgttcttttaggaaagcaaaggtataaattttaacaaatataagactgcatttttttgttaacttttaggctttagtgtcaagttgtttcattgtaagcatgaattaaactgaggaataaaatgcagcacaccgaattgaggtgctggttctttagcataacatacacacaaccccggtagtaaggtaagcaaaaggcgtgctaaatactacctcaaatctttactgaaatcatgccaatttacacaaagggtatatcatctacagttattcttatacagtatgcatgactagaaaaaaaaaaaagagtttgcaaccatcgacagctaatcacataatgactcataaaccgcacaggcaatcagaaaccaatgccacatccaggttttttgttagtccaattaccgttaccgcaatgatatggactacttgatcactgcatatccaaccatatcccactaaaacatacgtagtgcggagtagtaacaagcatgtatctcatctgaacaactactgatcatttcttcgatcaagcaggagccctaaattaggcaggcaggtaattagctcctaggaacaaaaaaaaaaaaaaagaattcaaggagaaggaaaagctccccggctgccgagggccgacctgaaaagccttggagatgatgtcgtcgtggaggcagacgtggttccggcagttgcagcagctgtacacccgcggacccaccagctccgccatgaacaccatacctcgagagcaaaaatccctcgaggcaactcaaccaatcctgcaaagaatcgagacgcgaattacatacaccatctcgtggctagtaataataaaaaaagaggaatcgaactagggaccccaaatttcaccaagaactttgggttccaagaacccttggaacccccgaattgcgggaagaggggagaagcagaaatcgggaggtttggactgaattgaacacggaggtgaaagggagggttccgagtaagtactaaccgatcgggcgtgaccggaggtggggggcgcggggagcggagaggaggcggcgccggaggggattagcggaggagtcgccggagtttgggagaagaaataggtgagatgatgacggtaaaggcgcggttttgttgagggttagttgagatatcataggaggcaaagcaagattttgtgagaaatctaggaagtaaattgcacccatggtgcatcaccttagcaggtgagcgttctagtacaacaatttggtagacaaatataatttaatataaaatctttataagtaatcatataaatgtaacaacttgcaagatatgtacgattttcatacaataaactaagaagttatagcgacaacttaattatttggagcattttttatatagattcaatttttaagtaattatttttacaatatactagcgtggatttgtataagcatatttatatttttattctaataactaataactaaaagtcaattaaactggatgtaaattatatttcggttgatatttgagaaggtgaagaaaaaaatcttaaggtaattggatgtaaactctgtgtgcagtataattcttcaagattaaattcaatgtctaaggtaatatctgtaggattactatgtaattgcatattgacatcgtgaaaaaaaactcgcctagcatatgcttagccaagttgatacaccaaaatactaaattgtcaagttattgtattagaacgcacccacttatcaagttgttgcactcggacattcaattctcaagttcttgtaatatatcgcacccacctgctaagttgttgtaccgttgatgcaatttgtgtgataattaaaaatttaccactgaactcacatgtcatagacacataagcgtccacatatcatgtatcatatcattgattgtgagtgacaaatccttaattaccgcatcttgagagcatcaccaaactgtgtataatctcccaaaaaaattattattggtttgctaaactgaagataggaaagaaaataactgatctcttcaggagaaaacctaaattgtatccccaaaagctaaaaatgggctattctattaaactaccaacagaatttccattagcacgctacctcttgcgctccctctgaagccacgccaatctcccaagcacggtgcgggagcaaggtggtagaggcgagattgggagtggacgagggcgccgctttctcccacatcaacagagcgaatatttcgggagaacttcaaaaatcatgcaatagagtaggagatctgttggattgttttttttctactaaatccctcagaattggttttgggatgaaatatgaggactgttggtgattctttaaaagtggcaaattgttaaatgccccaaaatctaggtgcagttgtcaggtttacttcatggtgtctcgctttttatcgtgggatatatgtaaaatattatagaaatgatgaaattacttgaatttgtaaaatattgtgaaaatgattagggaatgatgatttagcatatgtatgttgagttttagaatgaaataaaattataaacataattaatatatttgtatatgagctttgagtacttactgagttgatgttgcatgcttgcatgttgatctttaggagtattaataaataccataattacgtgttgagctttaggtgtagtgggttgaaactttatagaaggtatagataaactaatcaatgagatgataagtctaagtctaaacaaatatactacatccgtcctaaaatataacaacttttagctctgattaagaacatatttttttcagctttttttaaaaaaaaactcataagtttctgcactattaagagctaagttggaataatcttttttctaagcacaatgaatacaggacttcacaactaaacataatgcttgaaagccatcaaattataaattcatataagccgaaaatttggcttaaacagctaaatggtggatggagcgttggatagggcgacattaatgatttaagcatgtgtggtcttgttgagtatatatatggaatggaaggggtgaaaacggagcggatagtttccgtccgctccggtcaaaaacggatacggatagtgttcagagcggattttttttcagatatttcgaatacggatacgaatacggatatttttctccagatacggatacgaatatggtaacacagtttccggcgaatacgaatatggagccgaatatccggagattaagatgcgcggatatccgcgtaacgcttgatgtctctccagcctccagcccatcccttcaatttcagcccatagttttctctcggctatctaaaccctagctgctagacaggcgacggcggcggcggcggcggcgacgacggcagcggcaagccggcgacggtggcggcggctgtcttagatcaccttggctccttgctggagttgctgggcattggccttcaatccccctagtgtttgtttgtgcttcctatctccctaaatcgtgggacagtgggaggctaggagccgtcaccaccgccggcggcaaggcctcttgcatgcactaatctcttaggtaatccattgatttgttcttctcctgtaccctttgttttgtgcctttcatgagatcgataaactgatgtagatcttggatgtgcttttttttactttgtgtctagattggtgatggagtctggtagtgcaagtagtgcaagtgcagctgcaagtaccactgcatcatctccagttttgcaactcccagcacctccaagccatgctacggcagctacgcaggacacttctcctgctgctggtgctttggtaatgaagttttgttccatcaagctttctattgctgattggtgtaacagtacagatggaacaataaaaaccatggcaaacgccatgcaaactaaatatgataagtactgggagaagtcgaatatggctcttgttgttgcatgcttccttgatccacgttacaaaacaagttcaatagagtactatagtatgaagatttatggtttagaagctgcagaaaaatttgatgagttcaatggggttatcaaaaaattgtttgatgtttatgctactagtgcgtgtgcaacatcaaagaagaaaggtgctgaaatgcatgtgcatcaacttcaaattcaatctgatcctgttcataatactgatgagtttgatgatatctttaatgagaatgacagtagccatgatcatgagcaacatcttcaaagatttttgcttgagagaagtcagccaatttgtagtgataaaaccgagttacaaatttacatggaacaaccactgttactatggacttccaaagatccatttgatattttgtcttggtggaagctcaaacaagcagaatttcctatcctctgcaaacttgctcgtgatttcttatgtattcaagtgtcaactgttgcttctgagtcggcatttagtgctggtggccgtgttgttgatccatttcgcacccgtcttgatccagaggctgtgcaagctttagtttgcaccaaagattggattaaagcagctaacaatggtacactttgtgtctgtgttcattgcttatttggccattccttcttgtatatatcaatatatgtatagctgatccatgatctgatctggcatcattcttaggttataagactcaggctattatcaatgagttggacattgaaagcgtagagaggcatctggcaaacttattgatagtggtgagctattttcttattttacctctatgaatatttttcttaatataacaacaatattattcgactcctgtaggaaaaagaggagaataatgatgacatggaacaggatgatgttctgatggatgaaatggatgaataatgatgttgcagctttcatgcatcggactgcaagtgtactgaaaattgcttttgggctaattactattttgatcttatctgtgttacctatagaactcgaactcaatatatgttgaacttttcaacgtgtttcgatttgaacacgatacactttgtttaatctgtgatgcgtcctacaacgatgatatttatattaaattagataaatatatgtggtgcatttgtatctacgagcagtttgagtggtctttgtattccgagaaatattcgttttcgtattcgtgtccgatcatattcgatccttattcgtatccgcgataattcgtattcgtttccgtatccgagttattcgtattcgtttccgtatccgcctaacaatatgaaaacggatacggtaagagcattatccgtccgtattcgctccgttttcatccctggataggtagttgaaatcatttttttaacccatatggtaaatatttatgctagaattaaatgttggaggtcaagcggggtatatcgtgtgaatggacggtagaggtattgtgatttgtgaacaaagaactgagatgatttgaaatgacaaaaagtattagaggaatcccaatataattcagcataccgtattgctatttctcacatgtacgattgcgtgaacaaaaaagtattaattaatttatattgaggtatccatattgatgtaaacctaagttttacgatggaccaaacttacacgcacatttcgctaacaaaggcccgttagttttcaatgatgaaaatgtagttagggcacggagtacaacaaaaccattagtactgattaattaagtttttagtattataaacttgaaaaagaatcaatttaatattttaaggcaactttaatataagaaaggtttagcacgaaacatactgattagcagtttaaaaagtgtgctaacaaaaatcaaggtggaatatcttactctgtatttcaaatcatctcagttctttgttcacaatacctctaccgtccattaacacgatataccccgcttgacctccaacatttaattctagcataaacatttaacatatgtatctttatgctcagttataaactagattagtgcttcaccatatgagcttgggatgggagatgaggtttgatggtgattggtaaagaatgtagcacatgggagtttctgcacgtacgatgagaccaaactgcgtggcaaaccaatgtcatatggatagggtgcagtgcaagtgatcggctgagtctgaagccaatgtggtggaccaaacggggagccctagataatcgggttttgaattttgagatatcaatattgagaaaacaccattttaacttaattttggccaaatacgccacaccaaatgtttagacagggcattaaatggaaaaaaaaatccaattgcacagtttgcatgtaaattgcgaggcgaatcttttaagtctaattgcgccatgatttgacaagcaatgctacagtaaatatttgctaatgacggattaattaggtttaataaattcatctcgcagtttataagtggaatctgtaatttattttgttattagtctacatttaatacttcaaatgtgtatccgtatacttcgaaaaatttacacccaagaaactaaacacacccttaacataaaaactaaacaccaactgaaaaacttttagaaagataaatagctaggtaacttggttttcaaggataaatatccatctttatatactatagtccgaaggaaatcatcctttattgccactgtgtcccgcttaatgtttcttttagaagagctttagttggtcagaatattgtatactggcatgaattgtgtgtttccattgtacatatttatttgaatcttttttctgactgttttagatggaattatcatcagaatggtatgttctcagtaagatcaatgtatctagctttaattaacaatgcttatgatgagagaaacaagtatatttggaaacttaagatgccgcttaagattaagatttttatgtggtacttgcttaagggggttatgttatccaaggataatttggcaagacggaattggaatggtagcttaaggtgttgcttttgtatgaaaaataagtctattcaaaatctcttcatggattgtcattatgcaaagtttatatagagagcagttcagttttcttttagttttaaccttccaactagtatatctcatattttttatgggtggcttttgggggttgacaaaaaaaaaaggagtaaactgatacttgttagagcttctgtcatttgttgggttctatggttgagtagaaatgatttggtttttgacaaatcaccatctattttatatatgcaggtaattttcagggcaacacactggctcctgttatgggcacagctacaaagatgtgaggatgatggggagttcctaaatgttgcatgccgtaagttggagtcgatggttatgtaactatttgccaattatggatagagattcacaaatagacttcaataataaatgtgttcttcttattttggcctggtttccaatgttttttattggtgtgttctttttatttgaattacactcttttttggagtactactttataataattagctgtaactcattttagcatagggtgggatgttaaattccattatctaacaaaaaaaaactgaaaaacttttgaggccaaaaaaaatatcagttgcccttttatcgatgtttttgcaccatttgcactttaaaaagagtgagcatagctgcattgctatggccatcttctcacctaaaactttggctcccatgtccaagattggggagtgcattgacttggctgctgcctccttcctccccctcccccgcaaacaccaacctaccatgtcccttctcccctctcctctctgagctcagctgcatccatccatccaaactactcacagatgccactcttcctcaaccaccctcccatttaatgccctccacctcctcctcaagcccaggattcgggaacctgctagccatttttgctccaggacagtacagccagatgctgctgctgcagctgctgggttgctgcggtggtcaggtcaccccggttcttgattcttgacgaaggatggcaatggcgacccctacgaccaacggcagcttccttcttggatcaggtggctatcccggtgcccagattctaagcttctcctcctcaggtcacagcggcaatggtagagaaatcaatccatgttcttcagcattgctcatatattttttcttcttcttatcgttcaaaatgatgttctttttttttatgttatggattttttttcatgctgttgggtggtgaggggactgttgcatctgttgggggggggggggggggggtgttgcattggtggtgtggtggtcaccttgatggcagattcagttagtttattggttgcttgaccctcccaatggcatcgtggcaagaaaaaaaaggataactggttttaaggtcttgtcaagtgcaaaaggaggagctgtttgcttccccaacttttgcttttctgcatttggcactgcagagatgtgccccttgtcaccaaagatgcagagtcttttaaatcctttggagatggctctcactctttttacacttccatcttcaagtgagagaggtcaggaaagaggagagagctagttcagtagcaaccatgagtgaagctaggagcactagagtagtgtccctgaactcaggaacctagatgctgtttcttcctcaaatcttgcatgctacacagccttacaggcaatgctgttttgcacttttcatcactcatatcatctcatttttcatttgctttgtggtcttgacattgcatttttttgttgtcatcgatccattttttgcagggttggattgtggaagctcagatgtggcaagaatgcagggggttttagcaagggttagggggccattcacaccaacacaatggatggagctggagcaccaggctctgatctacaagcacattgtggcgaatgcgccggtaccggccggcttgctcctccccatcaggagaagcctccatccaccagtgttcccacacttctcctctggtggcattcttggctccagctcctgtaagctattgtgccattagttttggtttgtcccaatgtgatacctatttttaaaatcctggataaagcaatgatacattgggattctgttatggttagtattttggttttgtcttttgagggaaaggtgtgggtttgttaactatgattagcttattggggattgctattagtttattcagggatcctttttgtatcctgcaaaggctttggagtttggatcttaaaaacgacactcacattattagagatttaaatatttagtagagaacatgtgacacttgagcatactttgctaaacactgatggattagtgttagagatatactccctccgtttcgaaatgtttgacaccgttgactttttagcacatgtttgaccgttcgtcttattcaaaaacttttgtgagatatgtaaaattatatgcctacataaaaatatatttaacaatgaatcaaatgataagaaaataattaataattacttaaattttttgaataagacgaatggtcaaacatgtttaaaaaagttaacagcgtcaaacatttcgaaacggagggagtatatctttataggtctgcacatccaaatattaaatcatggttctttcattttacagtgggatgggggtcatttcagctgggctattctgggagtgctgactccgagcccgggagatgccgtcgaaccgatggcaagaaatggcggtgctcgagagacgcagttgtcgaccaaaagtactgcgagcggcacataaaccggggtcgccaccgttcaagaaagcatgtggaaggccaatctagccatgccgcaaaagcaacggttcccgccatagcacaaccacccattggtgcatctaatggcaaattgtcaggcagccatggtgtgtcaaatgagctcacgaaaaccttggctactaacaggtgaggttatctgatcttacatggtttaatcattatgtcctatttggtaatgagataatttcttatgtcttgatacccaatactagctggtgctgctgcagtattgtgactgctgcccaatagactcttacctaatttgatttcattgcactacagtactacacaacagttatttgactcaaaactcttaacctgaaggacagtttttcatcatgtctctagtcttttgtatccagtgagtgagtgaatgcattagggtgggagggagggacttttacttcacaaatttgctcaaacgattttcatttacaagaaatacatatctgagagaacatttttagttaaattaccgtaatttgattgcagacattccagggtgacatgttatattcacaggagggaatacaatgtatcttaggaagtgcgacattatagtgataccagtaatctttttagtggatgtctcataagtatgtttttacttgacactgtttttaccttgtttactggaaattatctaattatttgagtggaacaatgtaggctttgtttttgctacatcgtattatatcatagtagtgtcaaaatgcatctgacaagaaaaaacattctgcaagttttgacataatttgactggttaccttttttttttttacaaaatatgagttagttattttttatgctggtagttgccttaacttttgttgattatctagatttattaatgtaatctgtcttctaacacagatattttttttatttttgtaggatgatgttggataaagcaaatcttattgaacgctcccaggactacactaatcagcaacacaacatcctacagaacaacacaaaaggtgataattggtctgaagagatgtcctcacaagcagactatgcagtaatccctgctggctctctcatgaacacaccgcaatcggcgaatttaaatccaattccccagcaacaacgctgtaagcagtcactctttggcaaagggatacagcatgatgacattcagctgtcgatatccattcccgtggataactccgacttacccactaactacaacaaggctcaaatggaccatgtagtaggcggttcatcgaatggcggaaacaacacgcgagcaagttggataccgggctcctgggaagcgtccataggtggacctctgggtgagttcttcaccaacaccagcagcgcatcagacgacaaaggcaaaagccgccacccgccatctttgaacctcttagctgatggacatactacaagtccacagctgcaatcgcccaccggagtcctgcagatgactagcttcagttcagtgcccagcagcactgttagtagtcctgcaggcagcctctgcaatggcttgctcacttcaggcctggtgaatgcccagactgtccaaacactgtgaaaccgccggtctgatcatcagggaacagccatgaggctatctactgatgtttttgtccccagagcacaccctgtatgatttcctagctcatgtattatttttctttaatctttatcacttcatgctttgagttccctccgtttttaagcgagcggtaatgtggtattgtactatctcagtttcttgtggaatttgttctatgttgctgactgaattgtcataatttttgtcatggctgcttaacctggtctcattctgttgtctgaaacaagatctgaaattccgaatctaccagtgacttttctgaaatcccggatctaggtaaaagatgattatacatatttgcccttaactgcacaaataaatcatcaaagtaaattacaattttaaccttccaccttcccagtgcattggattataggcgatcaacggccataatcaatttcaaccagagaacaagcaatcttgaaacagactaaggccgtgtttagatttaaacttttttcttcaaactttcaacttttccgtcacatcaaatgtttggacacatgcatagagcattaaatgtagatgaaaaaaaaaacaatttcatagtttgcatgtaaatcgcgaaacgaatcttttgagcctaattataccatgatttgataatgtagtgctacagtaaacatttactaatgataaattaattaggcttaatagattcgtctcgcagtttacagacggaatctgtaatttgttttacaggcggaatttgtaatttgttttattagtctacgtttaatacttcaaatgtgtgtccgtatacttcaaaaaaaaaatttggcacacgaactaaacacagcctaacctattggatttacagcaacatggtaactttgctcatagttcttgatttgttttctccctttagacttcactactactgctcagctttagttcactgcagatcaacagttaacctgacgagagcgtatgagcgaaagcttatgccttgctcatcgtcgctcctcagaactggcactgaaatcatgctactctggtgacaactcctgcaatttctgttgaatgaatgaattgaatgaaacaaacctttcctgaagttctgagcaagggaataggaactaaaagcatctttccagttatctgcaggcaccagtgtgtgagtactagtgttctttccaagcattttccagctgtgtgctcattgagatactccatgcaagacttgaccctctccagaattcagagaaagctacaactacaagtgagtactctgtctactatcatcatttctctctttagctagcactgttctcaaagcaatggttttttccttcctcttgctaatcatctacttcctccgtcataatatataacaacttaagattggatttgacatatcctagtactacgaatctagacatgtatctgtccagattcgtagtcctagaatatgtaaaattcggtcatcggttactatataatgggatggagggagtacttcctgatagtgtgatattaccatggcatgcaacacaagcttgggagaaatggataatgattggtttttgccaatgtgccatagcccagaggacaggagctagtggacttcactgtggcagttgctgcaagctgctactgctgctgctgctagcttgcaggcagtgaggaggagcctttgaacagctgtggccatgatgttctgcagtccacagggtaatagagaagcaaaagatatatactgcatgatgcaggagtatgaaatagtataaatgaagtattccgtccggtttttaatatataataatatcgttggcttttgaatatacgatgaaatccttcattttttttaatgattttgaacatgagattaaacctcattgtttcaatttcctttgaaactccaatgcactatctctttcggctccaccatttaggcttcagcttataagcataagaaaaaaataatttaaaacttaattttagagttgcttcttggggaattttttatcatggtttatttttcattatttgcttttaaataactatgaacacatatatataaagtttcactcataaattattttttaattgttaataagatatttcacatataataagtataagcgaaacgatggcatttttctctctctcaactatagtctaatagagtacctttacggcggtggttatgctattggtattatcactgctacaactaatcttaatcattgttaatttgatgagttctactaccagtagaaataaatcgtctctcctctcaactatatcctaatagagcgtctttacaatggtttctgatggtaatattctgcaatcggtattatcactagtagaactaaccttaatcattgattgatcagttctactaccagtataaataattattttactacaaatagttaagatagtactccctccatctacttttgatagtcatatttcaaaatctgaaaattttatttttgaacctattaatgattttctcgaatttaatgcgtgagtctccattcttccatacataattggctgcatgggcattgagaaatgtaaaatattaattaatcgcttatttacgaggaatgactagtggcatgtttaaatggatgataagtagaattacttatccttggtctgtatgttaagatgaaatatgactatcaaaagtagatggagagagtagtataaatagatacggtgcattattagattagaaaagatgaatagtctagactgatttctactaccagcagatactattgtaaaacatctcattctaataatattttttcctctaaaattcatgtgcgttttctatggaaatggttgattggactaattcctgttttttagttatgcatatgtcatgacatcccattcctgcatttttccctcgttcaaaagtagcccaaaaatgttattcttttattacataaaaaactcaagggtgtatgcgctagtccactgttttataactgtaacatagtttatttgtactcctaattatgaaaacaatttagggttacttcaaaacacatgattgaaaagataaaggaatatgaattaaaatcacatgattttaagaaatgtaaatacaaaacaaagaatttcaaaacacaaaaaaatgtaggaatggcaatttcaattaaatagactgtcggaaaacatacgaattgtacgagagagataggctgaaaggaaattttccaagagtttagagctattactaacttatatctaaaatccgtccattaaaaattcaatggaattttaaagaaaaggatatgattaaatcattttgtttaaaaggctttcctcggaaggcctcattcatccatctcactgggaagttggggtaaaaaaaattattcctaaatataacactgtaataactaatagagtaaattttacttaattttactttaggacatcttttattgtcaaatttttgctttggaacactttttaactaatatttcactttgaatcggatagtcttgcttttatttcactttagaccactcgactcttctcaagtatatgaagttgtaacttataagtagaccattcattcatttaacattgttaaataataaattcggtggagatgagtaaaaaagttgatgctacaaaggtaaaattatccggtccaaagtgaaagtaaagggtgatccaaatcaaaacaccgacaataaaaaaggcccaaagtaaaattcacactaactaataatacccatcagtaagggaggaaacacttgcgaaattccgttcaatgcatttggctggttgcagccttacagctgggttgccacaatttctttgttttttttttaacttcttgcaacaattctggtggattcaaattagggatttcaaccgtacggataccatttctaaaaaaatatattgtttccaattgttattactgtaaaatttagtttttctaatttctaatttctgtctgtgttatgttgaagttgtcactaattcataaatatagaaaatttctgaccgcaccaataccctttctgaaaaataataaaaaagatatcatatctaaccgttttcacccctaattcaaatgtaagggttggaaacttctccaacacgcatgaaaatcgaaggtacttagtacatgattagttggcacggacggaaggtgacggtagtggtatcccgaagcggcagtggcagtggccacgaaactcgaagatggcgtggcggaggcgagacacgagcttggggacaaactgaggtacgacaagggtgctaccgagatcgaagtcggcttcgcgcggacggacggtgtggacgggcggacggagtggcacggaacgaagaaattcgcaataaatatgaaaggcttgctaatgaagtggcaatctaccattgatggcaaatactgaaatttctcgcccaagttccaaagggagcaggacgtctgtagctagctaggaggctcgagcgggccatccaagcacggtctgaggctagcaagcagactttgggcctaattgtggtgggctttcggccgaaaaagcccaggcgatcgatctctctccgtgtccaaaaaaaaaaaaaagacggttattttagaaaatcaaacacacatcaagcaacagactaaaacactaccacaccctttattaatatagagagatcagaaaacaaggagaggagagaaaatctttacctatggacgtgactacgatgaccatagctggattgtcataactagttacctcacccttagtaccggttgctattggaaccactcccatggttgacgtcgcgcaataaagcaatatcgagatgcctcgccgattagtttttgcgctaccggtataggtatgcgtgtgctcgcgctctttgatgcaaggacatgcaactctgcccaaaggagatgcaacaccgcacacattatcactttggtctaatttcgtccttgtattctattgggcaccgatcctagacacaaaagaaaggtatcttcaatagtgcctcaagcttctgaaaactgaaatggctatgggaagcaagcacggtcgtactttcctaatcactggtttccatgcctatccaatgatcaaggactggataaggatgactcgaaagaaaacaaaattagggattctggccctatttatatttcaattttttttcttcaaactttcaacttttccatcacatcgaactttcctacacacacaaactttcaatttttccatcacatcgtttcaatttcttcaaacttttaattttggtgtagaactaaacacagcctctgtttgaagtatacaaagcattttgaatttcaggcattaagcactaacatcagttgcacaagcccaaagccccaaaaccatcatcgaagtttcacacaaattgtactgctcacaggccccatggttttcaactaaactgcgactgaaaattgcgagttattcactcgaaacaagccgcgcctcagtaatcactaaaactgaaactgataaaccacatggcacatgaaagcactagcttcaatgggcaaatgctcctgcaatttccactaaactactaatgaacagaaccctgtatcatcgatgtgagtgatggatggactcgagcagttttcattgaccgagaagcacttcttccttctgaatattcctcaccaagaggccaccttggacgcaggtcatactgtgttaagacaattatcaggcatgataatagccagtcagtcttataaaacatagaacttacactgtattaacgtcaggagtagagtaaaattaccaagtacaagattccttccataacataaatacacaacaggtcgatctgaagtgtgttctattttaatgtaagaaaattagacggcctgattctgagttctgacaatgtgcgaattccatcttccatgatattaattataggaaaacatttggataaaaaataactcataaactgatcttcgtggtggatctgccaccatcacatggctactgatatcataaatattgactagctttgctcacaggccaagcttatttgatcaatccccccagagtgtcaaactgaaggagacatgaggaatataaaggcagctataggaatggggaagatggtgaaaatgtggattgtttgactggcttggatgcaattttgacataacacaagctcacctgttcgatgaccatatggctctaagcttataatatggtaggccgcaagatgaaaataccaccaaaaccaaatttggcaggtaatttgctagttttgagatttgagtattgaggtttgggagtcgtgggtgaaaaaaaagactctggatgacttgatgtaaacgaaattatcgaacttcaactatagtgccaaatgcagttacttgggattaaaaggacatatatgccaaatttacccaaattaaggtcaagaacacgatataatctatccaagtctcacatttcaatgttcgttgaaatgccatcggtttagctttacactcttcctccttatcagtagcaacaccaactgccttttaacaagacctttttttattgtagcagcaaagagttgatcatgtatcaatgcatttttaaactaccaagttataagaagcaaaaaaagctttctgtgcttgatggtgcactttgttttgttcaactcatcaactgagcatattaatttgtcatgttacctgcatatcatcaggctcatcaacagcaggaggatcatcaaatctgcctgcaatgaaatgctcaataccagtccaagcaatcatgacacctgcaaaagaagatgccagaattatgtgcaaactgcttaagaataactaagggaattaggaggaatctgtaccctgtatggaagaaacagtcaaaaataagttctcaacaagtcaaaaggacagaaaataaacagtataacaacaacatagaaccaagacacaaaaataaataaataatgtagagtctagattgagataaaaaatgaagatatgaaatgagtggcatgaaaaatggcattaaatcataaatacttctgttaataatatgattgaatattactgatttactattcaattgatcatgcaaataaactttttaccattgtcagtgcaaagctttgggggagggcatacgagctgtaggccattcttctcagcgatctgattcaaatgagttctgacatactggtttgatgcaacacctcctgaaacaacctttaataactgagtcaataacacactggatgaactaatgtaaaaatgtaaatattctaaaatgaatcaacatcaagatatctgaattacaaagtatttaatagaaggctccatcttcaatgcccattcaactgctcgctggcatctttcttccaaatgtaaaacagcaactcgctgcagaggtcaacatcagaaaactaccaaaatcttcatgaataatgaaaatacattgcctatgatgtaaaaacctgaaaagaggcagcaatgttcgcccttatttgtctgtcatcttttgtcgcggatgaaataggaatatcatctgttgatctaccatagcacaaaaacaacagaagagttacgagaccaaatgtcactaccgatgagactgccatgtctgtttcatgtaataattaaaaatgttccttcgccaataaagaaacagaaacattctataccttttctaacaaccagttttctagcaacttgcaacctcttgctatttgttaaacattatcgttcccactttgtcgttcttgttatttgatctagcgcatttcaagcacaggttattgtatatacgctatagcataatgcctgggtgggtgttctttaattaataaaaagaacaacgaccttgcatggttgcaatagtttcatgttaatttcctagtgcttgacataaaaaaaatttcagtaaaattaaaaaacaagtattgtagattattgagagttaaagtcaagtctctgcttgttaatctagaatattatagtcaaggagagcaaacagcatgccaaaatacactatttatttgacacaccagcaggcatattaatcttacaatgaagacaatggcacaaggactaaaacagccatacatgtttctggattcaatagccaatcgaacttgagtcttcagaccagcataagagaaattgcaatctttgtgttgtcgcattggaacctggaagttcacaaaaagagaaggcaagcaaacatcatgttgacctaacagtcatgataggtggataacacaacatatctacccagtggatgcaaaatatctacgtcggcaaacttacactaaacttaacagcatttggatcaccttctagggcaagctgttcaagagcaggaccgccacctttccgcatatcaagacctaaccatctcgctgacttgtcataagcctcaccaattgcatcatctattgtagttcccagttgaacatattgaccaagtccatgagcaagaacaagaagattgtgtcctcctgaacatattaactggttaggtagctgcccgaacgtcataaaagaaaattcaccaaacacgtaatgtttcaacataagtatatctgttgtattagcacatactccctctgtcccaaaaagaatcaaaatctagggtttgcgatggaatcgatttactgcgagtggccttgtggttggtttgcaccggacccagtcgagttaaaataagttcgaccaagggcaaacttgtctttaatgagtatttctctctccaattcctccaaaaataataaaataagaccgcgagtgtccaacagctaattacaagttttttatggtgcccgatagaatattcgtgttcttgcggtgtctaccagctaattgcacgttttttggatgccctgtagcaaatttttctgttatgtttgggtattactccctccatcccaaaatataaaaagttttaaggttggacatggttattaagaaagtaggtagaagtgaatgttgaagggttgtgattggatgagtagtggaggtaggtgagaaaagtgaatggcggagggttgtgattggttgggaagagaatgttggtggagaagttgttatattttgggacaaattctgagggctaaaagttgttatattttgggagttaggacggagggagtatttgttatcccattttctatttgattgagcttattccatactcgcatattgtatcaatgattgcaatgggccatcataagattgattttgcattctgaaaggaggaaataaatgaaataaaagtagtttttcaaaactggatataataaagtatcgagatgtagcaaatggagttgcctgccaactagcactgcttaaaaatgtttatttccctatattgtagtttgactatagagacataaattaaccatgaagattgttcattacacacctcgtatatttgtacatagaacataaaaaactacatagtccttcgaaaagaagggtatggtggtggagcttgtgaatatctactccacctcctttatgttataggttttatgaatttcccctagtagttcttcaatatcatatgaaagttattctacatattgttatcttattatttggccttctaaaatacaaatttaacatggaagggtccaagattcacatgtacatgtacacaagctaatgttacaattataactgtgtgaacatgcgaagggtgcctttatgaagaaaatcacattcatttatttcacaatactagggaatgtatgattagtgtttatccatataaagcacgggtgtttagatagtacttccaaactgtggcagggacggaacaaataccccatcaggtcaaaagctgactgactaggtgtaaggacaagcctaatagggttcaatcctagactaggcactgttgtccatcaattttatgagtacagctacgtctagtggtaaagcgaatggtcatgcttagcggactttgggcaactccataattttgaagcgtgtagaggacatgcacacaatcatggggtcaattgcttgacatttgaagtttttatgtattttagtgaaaatattagcaaaattagcactacatttcaaaagaactgcacaacatggtggcactacttccaaaaccatgtgattgatgatgtattcaaactggaaatataaataaatttatgcaagttccaatggaatctatgttatacattcaaagtctaccaaacatcaaatatttttcaaaagagccttattgttactgtagagatgtaactcaacaaaaaattgatagtgccacagaatatagggataaagtcataaaacactttgattagtatatacctgaaattaggagggccaaaaatgggaaatcaagatccttgttcactaacctgacatcaatagaactacattaatacaaatgcatcgattatagcaataacaataggttaggtggctatgatagcatttttaggattatataattactttaagtataggcatgattacaatagtcttagggcttagggtcttagcatttctggtaaaaaaagctcttctgtaataataatttaaatttcataccttgcatttcatcacaatacattcattttgcaaaacatgtagcactgaaaaataatttatagttgcaaatttgttcctgctcaaatatcgttatgtggtttttacatagcaagatgttggtcaaatgttcggaagtaataccagtagaaaaagaaatcattcacttttcggttcaaaaattgctaatttaccaacctaatggacattacaaatatacaatagaaaaaaagtggaagtgcaaaagtacataacagaaaccagtcgtgctctagaactaaatccacaaaaataaagagaaaaacataaaatcccttacaaatggacagtaaaaaaatcatcgtttcagctaaaaaaatctactattgcttggcagtgaactgataaaggaacttatgtttcatcagttgagaatgtcatcttcataactcagaaataaaaaccaaggttggatacctggaaactaatgcatgtgcctccatatgatgaactccaacaataggcaggcgaaatgatttcgctatttttcgagctttgtgaacaccaactgcaatttatatggttcattaaatagccttcaaagaaatgtaagagagactcagcgaggttaaaaagtaaaatcaataaagttcactctgactgtgtaaatagtagtatatgcaatgtatcatttcaacaatcgattactttacaggttgacattgcgagtgactgcacaagataaagaactactaacaagtaacaccatctaaagggcaaacaagttaatgatgagaaatgccctgcatctaaaatactcagcgaactaatagtgagaacacagggtttggggtggggagaatgattgaaagatgcaaacaagattctgtaacaaactgaaaattcagaactatgccagcatataagatataataacagtaaataccagctaatcctattgatcaggagtaaacatacaaaagctgatacctctgaggcataaactaagtcctggtcctacggtgacagccactgctgaaagatcattttctgacacatttgcatcatcaagtgctttctgaacaacctgcaaggaaaatacaaaatctataacataaatgtcaaaaacagcaagattgaacagaaactctgaaactgaaagccaaacctgatcaatcgcaagagaatgagcttcctcggccatcttcggagcgacgcctccccacctcacgagtaaatcttccttccaaatgttgtaagcacaaaacaatacaatcagcagcgcacagagcatagcatgaccaataatacagaaacaaagtgtaagtgggctgaacagggaagcagggggcatagtatagtatctcacttgggaagataccacctggcttaggatctcgccatcgcctctaacctgcaaccaaccaaccaacaaaaacaacaaagagccaggcactaagcacaaacaaatcctacacaccgactccaccactgctacaagcggtctgaaataggggagtgagccgcgcgtaccacggcggcggcggtgtcgtcgcagctggtctcgatgccgagcatgaggaggtctgcggcggcggcggcggagggcattgtggcgagggagcggaaggtaggagaggaccgtagcggaggggagggggcgggggcgaggaggagtcggaggaggggagcgggaaggggtgaggggaacggtggggctcgccggaggaggagggcggcggcggcgcgggaggccggcggcgataaggtggggagaagagtggccgccattccactctagctcgggttacactggggtctctcaacaaacaccgatctttttgcatccgacgcacatgtgtgcctcctttttccaaaagtctaaagaaaaaaaattactgacgaaaatgcatgatggcatttggttgtattattactatagtagggtacacaaattctttgtgatgttaagctcataataaaagtataaaagtgcatactcctttgtcctttaaagggttaattggatccataccattgcaaatttatctattcagaaaaataacactacaatttgtctatttgtagccttgccactgaaatttcacaaaattagaaccgtgtcactaccgtcacgttttccatctattctcttcattttccgtttcttccttccttccttcctgtcttccaatttgtgcggtgcggcagcgacactggttcgtagggggtaggggtgaaaacggtacggaaacggacggaaaccatctttatcgttttcgttttcatattttttttcggaatcggaaaccccggatacgaaaacggaatcgaatattatcgaaaccgaaaacggagcgaaaacgaaccggcgcgaatacggtaacgaaaatttatcggaataaaaaacctctcaaactgataaatccaattgaataaattatctatgtttaaaagagtaatgttgttgataaatcccaatgtaggacaaaaaaatattcttatgtaattttagatttgcataacaaatattttttaaaaaattaacagccaaacattcactatttagtgcttaaaaaaagaatccagagtatttcagtcacgaaatttctactaattccaagaaaatttccagaaattccgagaaaattttcggaaagtttccgaccgatttcgagttccgacggaaactgcccttatcatttccgattccgttcccaagaaaatatttccgaattcgtttccgtttccgaaaaattccgaccgacagattccgttttcgaaaataggtctggaatccggaaagatttcgtaccgttttcaggcctagtagggggcgatggggtgcacggcgtccaaggtggagtagtgtcacgcccagaaatttagcccaaatttcgagactattttgtgtattaaatccctgtctaggaccagccagggtacacaaaacgacaagtaatatacagttccaaacgtaaataaagcgtaaaatacttacaaaagaggcacctagtcctcacaccgaaacagaacgacagcagcggaaaaaggcgatcctagcggagcttcagctccactccacaggcaaaactcaactggggtctgagcattggtcctctaactccatcttcagctcagaagcactacacttctaaaaagggggaataatagcaagactgagtacaaccaccgtactcagcaagccacaccaacgatgcagatgtgcaaggggatacaaggatggtttgtggctatttgcataaagacggttgtaaaacattttattgagcaaaacagtaaaactgttgagtaattaaagtaacattaaatctccactgatcaacgctacaccacgttgaacaggcccaaccaacccacctgaactacagtgtattgggtcgatttattaagatgggactaatcacggtgaatctggtcgaccgcccataaccgcgggcacggctattcgaatagctttactctgatcagaggtgtacaactgtacccacaagacacagccccacgacacgttaccgtgcgccgacatgtcaccacgacataccgaaaagaggccgtgacaggacccttcgcataaccccctctaaccaagcacaccacatctcaggtttcacccccgtccccagcgggcaacgggcagtcccctctcgtgcctaggtgaatccggaagcgacagaggccgtcgcagggcccgccccgctccatcacgcccacccttgcctggatgcgtcagctagaggaaagctacactacaagcccagccgttgcccacgctggcttgtggtaagtacgataagttcttccagggcatcccgcgaaccggtccttaattgccatgggtgcgactagcaaaaccatgcacccacagcccaccattcagtcgcattttagttggataattacgaccacgaagcatggccagatgtctcgagcacgcagctcactctgatactaaaaaggtctaatactgtaattatcccatcaactgagctagtggtaattaagcatagctaagcatatagttctagctaggtcacataagtaacatgagctagtcgattcattacccaaggttgacaaagaacagatatcaagtaaacatggcacaagcgagcagataggtaatacccggatcccatgtaattagcaaaacatgcatatttatttgtaaacggtaaaacatttataaattgggatcaacatgctcaaggggaatgtgtgacttgccttgcttcttcacttggatcttctgaactcttatccttgcgaatgcgatcttccgaaacgacgggaactacacgctggcacgcaaaacgaggaaaaactctaataaagaccaagaaaacagtacataaaaagtaaacaaacatgtagagctcaattttagatgaattttgcaagttgaacggctcaattcggagttcgaatgaattagatatgaattttagaagttttgagccatttaaatgaatttctataattattcacgaattattgcgcaattattatttattttctcaaaggaaaaggctgtgctgacgtcagcaaaggagatgggcggcgccggcaagcgggccccaccggtcagcggcacaagggcgccggtccaccgtggaccgggaccaccgaggcggtccaccaccggtccacgggaaccgacggtccggatcggcccaagccgatcgggcggccaggggcggcgcggctggggcacagcacggcacaaagccggctggccaaacgacggcgcgcggcggcgcggccacccgcggcgacggccggcgacagctcccgcgggcgaaagcggcgcacgcgcgagcagcggcgcggcgcggcaagggggaggcggcaaccggctgcccggcaccaccggcaacggcgcgggcacggagcgcggagcgcggcggcggcagcgcgtcgcgaggacgcccgggaggcggccgacgaaggggaggaaaagggagagggaggggagtgctcaccgagatgcacgacggcgaaggggcggccgacggcaaggaacggtggcggcggggctcctcaggaagacgatgtgacagagctccggcgacgggcgtcgctcaggatggggcggatgggctcggcctcgatctgaggaagataaaggaggggttagagaggagaggactggtgcgtggtgaccggtaacgacggccgaccgcgacaatatgagaaggatctcaccggcgaccgaggaaggaggagctccgacggatttccggcgaagaggggcggcggccgaggtcctcctcgtccttgcggagctgagggaggcaacggcgcgggtcggcgtcgaccgaagcggcggcgcgacgcggctggagtcggcggcggtggcggagagaggtggttcgcgtggctacggcgctacggaggtggagaggggaaatggagcggtggccgagcttgcccgggcggcggcaaagctggcggtggcggcggagcagtgcggcggcgaccctagcgacgggaaacggcggccggagttcgccggagtgtggcggcgcgcgggagcggcgtggggagctcgagagagcgcgcgggagggggcaatgagttgggggaaacggatgaggggaggtcggggtgcatttttataggccccggagggggagatcgtggccgtggcgggcggcaacggccggcggatggagcttcgacgacgtgggcgagtggggctcgaacggcgccgattttttggggggggaaatgggggagaaagtggaggaaggggaggacgtggggtggaccacgtctgcacgcgcgcgggagcgtggaggcgcgcggaggaagcagcgtcgtggggtggctcaggcggccatggcggcagttggagctggaggaaagggatgacaggtggggtccacgggtcccacctgtcggagagagagggagggagaggccggctggggaggcagaacggacttgagggagagagagagccgagcgggccgagggaggaggccggcccgagagggagagaaagggggcgcgcgggtcgcaggagagaaaggagggattgggccgaaaggggcccaaagagaggaaggaggattttatttgttttctttttattttaattgatgcaatgatctttgtgctattaaaactatttctcgagctccgaaaattcacggaaaattccggagagtacattagggcacaaagaatattacaaaatattcccggccaataatttttaaaggaaatttttaattccctcaataattcacttgattaagttgatttaacttttatttaatttccagaaaatgtattattaattgatttttattcccgaacgaaaatcggggcgttacaagtaggaggacatggtgtggtggtgcgaggagcggcggtgacacatgaaggacacggtggcgtcgcggtagcagctcgcctcggcccacgccgactaactccgtgtcccaccacactgcgccagtgctcctcaccacaaccacctagcctcctctgttttcctcgctcccgtcaccgacgccgctgctctccaagcaccacccggcgctgccgccgccaccgccccatagtcacaatagcagcagcagcagcagcctcgtcacatagcggtgagggctccccgcggcgggccgtgttgcctcaaggtgcctcacatcctgtccgactccagcattgctcgcccaacacggttgtcgttccggaagctagtggtctagacaccgtcggcagcggcatcgtggaactgggagaaaaggggaaataagaaggaagaagaaaatgacaagtggggttagggcatttttgacttttcacgctatttatctctcatattcacctgaaaattaataatttaatgggcgtaatgtctactagcaaataaccacgtttagatagtgtttttccccaaaagtgaattcgtgcggtgtccgactggtaaaatcacaaagtcttgatgtcctgtagcaaagtttgcctaatttttatgtttttagtttcatcatgagaaatactttcataacatatataatctacacgttgttaaactatacgaacttttatatcgatgattaaagataaaaatgttttaacttataataaaactaaaatgacaattaatttaaaactgagggagtaaaggtagaagtagctcggacgtccttgtcgagcccaacgtaccccaatagtaaccggacaacggcgctgtgcgtccgtgagggttgattggccacgagccaaggacggaacggaacggaatggaagaaatatgttccctttgcttgaacccaaagtgtcacagcgctatacaattcatcccatccgtacacattttgctgccctgccacacgtgtgcgtcgtaggattacgtacttgtaccaccaaaaagttggttggccagaagaaaaaatttttgcacatgaatcctctcaaaagaatacaaatatattaatggccgatcgatggcccggcgtccttggtagtcgtcgaatacgcgatgaaattttggtattattgtaggtgttactaataagacacatttcctctatgatgcaggcctggtttagtttccaaatttttttctcaaaaacatcacatcaaatacttggacacatgaatagagcattaaatataaattaaaaaactaattgcacagttaagggggaaatcgcgagacgaatcttttgagcctaattagtccatgattagccataagtgctacagtaacccatatgtgctaatgattgattaattaggctcaaaagattcatcctgcggtttccaggcgagttatgaaattagttttttcattcgtgtccgaaaaacccttcagacatccggtcaaacatccaatgtgatagccaaaaaatttcttttcgcgaactaaacaggcccataatatgatttgtctggtctctaaaatgtttttaaaatgtcactaaatataagactaagtacaatagcaaactataagctagctataaatatatgtggaggggataaaacaaagagagaagagaaatgaactatggatcttagcacgttatgtgtataagaggtgggactagttattaatgatgtaacatatatttataagtaactactgtaaaaatagattattagattactataaatgatttgacttttgaaaaaaaagtagttgattataatattaaacttgctctatagctctgtagttagtgggactgtttctaaaatagaaatggttgaccgggggacaagcgctactgatgtagtgatgtgcccctgacttatagggaattgttaatgatctcaagtcttaaaacctctatctcctctatttacagcctcatcgctaggcttagtgagaaataaaaaaaaaagcatacttgtaaacgataatttatgaataaaacttttatatacgtgttcttatgatttaaaagtaaatgatttaaaagtaaatgatagaaaataaactacgatgaaaattctcaaaatcaactctaaatttaaggtaaaaaatttaaattttggctgataaggataaatataaatgaaaaaaaagacgttaaatatgtgttagatattgtgcttgtgaatgtgtaagtgtagtgtgtgtatactgtatagatggtgcatgtaccaatggatcatccacgtaatcgaaagaaatggcttcatggatcttataaactggagtacatagcaggagagaggatagcacggatcaactatgcttgtgttgatgtcgccatatgaacttccagatcaaaccaccatgcatgctggtttaaatagttgaaacttgtctttcaaagaaatgaatgaaactgagagatggcccactcttcaaaattatttagcaggttaattaggcaaaataatgcatatttttctagagaggaaataatgcatgttctcacctaatatttttcttttctgtgtgtttagtgggaaagctacagaatcaaatgcctttggtttcggaaacatatgttatactcaaatatatttggctgataccaaatcatgtaaaatacatccacatcaatccaattatatgttacatagtttgttttttttttcataatggaacattgcagcaatttttcacttgtgttaaatatagtaccatatatacaactctcctaacttgataattttggcataagagaactcatgccaagaaacagaggtagctacccagtcctaatagcagcaactactactaaacatattttatactataattaatacacatcaactacataatcatcatcaccaccaaaagaattaagattaatttaagttaaaattaatgtaaacacatatcaacatcatcaccagcaactctgttcagcaacaaccacacacctcgcatcgtcgtcgatggcgtcgtcgtcgtcgtcatcatcgcatcgcggccgtccgttgctccacgtcagcatcagcgccgccgcggcctcctccgtcagggactccagcacggcggcggcgagctcggcgccgacgcgccgccgcgcgtcgccgacggggcacacgctccacccggccgccatctcggcggcgatgaggccgtgcaccttggcgatctccgcctcgagcttctcctcctcctcccagtagcgtgaggcggcggcggaggaggaggaggaggaggaggagctcgtcgacggcgagcttgctgtgtggttgttgacggggtggtcgggtaatgccggcgtgtaggccgccgccaggagctccctgaagatgactatggcctctgcgatggacgaagtacgtggagcgagtgagctctgagctatccacgtggcggcagcaatggcgccgccgcgccggagacgaaggagacgcgaggtgagtgtacacgtttgcttacttttcgagtaggcaggcgacgctggcggctggaacgggctctgctccagcacggagacggggctcagctgcttctcctcctcctcctcctcctcgtcttccatgtcgtcctcgccgatggccgccgccgcagccggctgctgctgctgctgccgcttcccgccaaccttcttggccgccgcggcgccacgcggtagaaacttggagaggatgacgctgagaagcgcgctcgccggtcgccgtcgccgccgcctcatcgcccgcgcggcggccggccagcaggcggcgtcgaggagggcgggggagcagcccttgtcgaggagaaagaggtggagggaaaagggctcctgctgctcctccagcagctctgaaaggcggcgggcgccgccgccatcactgctgctgctgcttcccgacgccggcgacggcgagaggagggtcgccatggggggtcggaccgtcggagagaggaggtaggtggacggcgccggatggatgaatggaggcttataaaggtgggggaaagaagattgaaaatctgagactctgaaatgtctactttggttaccaaactatatatctccttttgtcatgaaaatatactttaagctactgaacttttttaaaaatatgactatatttataaccctataaaattatgaaaaaaagttcaaattaccaacccaaactaatgtgacagtacgaattacctcatcaattcaaaattagacattcttcaccctcaatttttcataccggacaaattgtccccttagctaattccgaagcggttttggttttacgtggcataagtcaacataagaaaataagtagtgtggcccacttatcaattctgcctcttctctcggtcaccacatttgggcccttaacttttttttatatattttcttatgttgtatgaattgccacatgtgcatcacttaggattaaaaccgctctggagtctatcaaatgagtaatttgtctggtataaaaagttaagagtgaaaaatatctggtttttgaattaaggagggtaattcatattgccacaatagttcagtgggtatttcggacgttttctcaaattattataaaaatgatttatagatacatcatcctttcacaacttagatcactaatacatttagaaaagaaaagttaagatttcatttgtaaaaattatattagtagatttatcatggatatgtggctagtaataataaaatgggtattgctatgtttcagaggtgcaattttagccacctaaaaattacactttcctacgcctaaaattgcagaagtatgcaatgtgcaattttacttctttttagctttatttttcctgttctatatggttttgctttacttttagctaagtttgaatattgtgtgcatgtacttgtgtaatatgaattgtaatttcttttttttagttatgtgttttttgaaaaattttgcaggttagaataatttattgctaaactttctatgtaagaaaaagggaggagtgatggaaaccagtggactgttaccacagggataagaaaaccgactaaaatttttgaaaatcacagtcacgacacttcttagtaaaatatatatattaatgtactaagactatggcaatatcctaaacgataagtaaatctctactacttaaaaaataaaaaataagatgcttccttcgtccgtcaaaaacaaaaaaaatagcagaaaaataaaaaaaaggtctctactacttaaaaaataagatatgcttccttcgtccgtcaaaaacaaaaaaaatagcgaaaaaataataaaaaaaaaaggtccgactcctattcctctggtccgactcctattcctatcagaaaccaaaaaaaaaaatccggctctatccgattcccccttataaaaaggaaaaataaaagtcaccactcctctcggtttgagtctgagatcacaggcaccctcctttctataccatgatatctcatacatcttggtgaaaaaaattgatgtgccgaattaaagatctgtttgcaaaaatagaacctacaggtcgagagcattccatttttatatgattttaatttttggatttgtacttttgcattcgagtccctgtaatttttatatttacatttgagttcctataatcttgcaaaaaaatgaaaagggcgaaataaagtccgatttctaatcagtatatatctcttctctatctctaatctaatctaacaatttaaaaatagaaaatgcacgagaaaataaaaattgttcaaataaaacgcgtgagaaaaaagttagaaaaaagcgcaaaaaacacgctaaaaaggttttacatcttccataaaacaaaaaaaaagcgcgagaaaaattatttccatcgctggtaaaaaaattttaaaaaaacatgcgaggaaaaaactgtaaaaaaatgcgctatttctaaaaaaaatggtttgaaaaaaccacgcaaggaaaaaaacaccatctattaaaaaacaaatcgctctgacaaaactgtcagaaaaaacactaaattgatggacgcttgagtcggatagaatccatcgattttttgccatctactacacggcttttatttcatcacatattctcctgtattggaaaaaagcaaaaaaagaacatttgaaaaaaaaggaaaaaatgcgcgagaaaattattgttagaaaaaacatgcaaaaaacacacgagaaaataaaagcaaaaaagggagaaaaatatggttttcatcgtcagtaaaaaaagcaaaaaaaaaacatgctaggaaaaaactattagaaagaaatgcgccatttctgaaaaatagtttgagaaaatcgcgcaagaaaaaaagcaccgtttataaaaaaacaagccactcatcaaaatacaaacacatattattattagaacttttttacccgttacaacgcacgggtatttttgctagtaaagtataaagtcaatctatactataaaaggttgaattttttggttttgcccttctattttgggaggacggggaccaatcgaaccgaaattttggaatattttggaccgaaataatttaacattttatcatattttgatcaaattttaataaattgtgctaacataaaaaaagtggagtgggttgaaactttggaaatttcattccagaattttggactatggttactagtagtataaatattaaaaagatactaatggtaatggttttaaaaagtttaattaattacaaataccccataggcccagacaacctgcttttcgtgatcggacaaatgagcatcatatccgatccacaccctagctttgcttctgtttcacgtatgtatttatggtggtcatacccatatatacgatcatacgtacatagaggtgagaaagtgacactggggagatcaactatcacttttaagatcggtacaaggtactggtactgtgtgctgtttgcaaaaatctttaggctgtctgcagatggaatttcacatcactcctatacatgattacatgaatgtgtactccttttatttgcaggtgaataggcagctttgtttggtccatcggttttcgaaagtagtgtgggtactatgtgccgtcgtcgttacccgtcacacatacaatgccgtcctttcttttttgccaatggcatcagaacaaaaggaggaggaagaggtggttgcttttggttgccattggcatctatctagaggttggtaggagctgagctgatgattctggttcccacccctggaaagagataggacgattacttgctaaagctggagttatatatcgagctttggattgtatccgaacacgtatctggagaaaaaaatagtattatatataactttcatatgtttactcttagtatgcatagaaccggcttataatacgagagacttattcaatacagcggaaaataattctagcatatgaattttatatttttttactatcagtctcagcagtctaaactcgatactaacaaaagatttaacaagaatgcttaaaaggccgtaagaattcgaagtgttatgttttcttttctagcgggctgattaaattaatgaaaaattaacacatttgaggtctaaaggcatagcaaatcgtacatcatctatcggtagcaaatatggtacacccctcaaatagttaggtcctctttgtaatgtaggattgggaaacacataaatacaaaacagatatcccctaaaaaaagaaatgaaaaatatagaatttgttgtatgtttctctaatcttacaagaatgaaaaatatgaaacaaagcagttatgttcatatgaaattgagccatatgaatgcaatcatatcgaaaattttctatcaatttctatgaatactagaatcccaatgaaaatcctcctcatgtttgcaatgtaatttttgggaaaagtaagatgtaactgtgttgtttgttttttttttaaaaaaaaagatgtaactgtgatgcaacagcttaactgcgtactttcatttgcttcctcccaacgtacgaataaatcatgttctacaaaggtgagcacactcaaaaaaacagagttctttcatgattcacatgttctttattaaaagacaatcaatagctagcataccgctcaaactagcaattaacaatatttttatatataattttggtcaatttgaattgtaaactgtgaaatatacatcactaaaatcattaaggacatttgttaagaactgaagttcctaacaaccagtacgtatgatgagagatatttctcagatatctatatatagtccaaaacataaaatatacagtaaaatatacaccataatttaataaaattgagatatactttatacccagttaattatatatgcctatataattagtgtagttaatactccctccgtcccaaaataagtgcagttttagcactgttcacgtccaacgtacgaccgttcgtcttatttgaaaaaaaattatgatttatatttttattgttactagataataaaatatgaatattattttacgtgtgactaatttttttaatatttttcataaatttttcaaataagacggatagtcaacacgctaaacacggatatctatggctgcacttattttgggacggaggtagtatttttttctcttctctcattaaaccacaacacttcaatatttataaccctaaataattaaactatggtgaaaattgcctcttttttcttctcccgtataaccacaccaccatagttgtctttggatgatccatatatattagttccttcattttcttctatcgtgaagtggcatcactttaattttgcaatctatatatgatttaaattgtcataaactaataccttctaaatggtttatcattttttaacatgatcgatcaaatatgcatattatatcgtcgagtaacaaaacaaatctgtcgtacaccttatttctatatatcactatcatacaaacttttccccacggcaacgcacatgattttatctagttactatgtgagagcataatatatatttttccactatatatctatctatctatctattattatatactaaaagtccattaaacttcctacaaacgctcctaagccgccacgtgacaattctataaatgctcctaagtcgccatgtgacgttttaatatattagaaacatctgaccctcgattttcatttaaattggtgggtccataattttgcactattagattagattaaaaatagacccttatacgtatgcctccctcaccacctgcaagtacgtacgtacaagtacgaacgtaacataccccctagacttttttccttttcttatacaccttcttttattattttgctttacctaatatacatccataatattattggtgtttgaacatatgtttatttactaaagaaatatgtaattatcatttattttgttatactctgtcca

SEQ ID NO: 59576 - DNA, 29925 bp, Oryza sativa
ccctcctcaatcccagtgttaggttgaaggtgactgaaattcctagcaatttttttagggaattcctagcaattttaagtcacctaaaaactagtaattccctttcctatgtaaaaggatccgctatatatttaatcaaatgttttgctatataaggattgagtatatgcattcgtggatcttttgttgagccatatttggatctgtaaaagttagagccctaaatgcaccccttaaatacatttttcttttgaaaagaattggtacagaaaatatttctgcaattaataggcgtttacccttttaagaccctcggaaattggctacttacacagatataaaaatttgaacattttccgctgtgcttggtttgttgctgacttgtgcgtgtcatcactagctagtacagagcaaaataaacgttgaggcatgtgacaaccaaatttgacacaaggacaaagtcatagtaagtttggccagatttggaataaaccggagttttcacatggggaccggtcagaccaccactgtatggtcggttggaccaaatggtgaactgcggtcaaaccgccattgcggggctggttggaccgacagcctcgagtccgagtccaattaaggttattctcgtggttccttgcttggttccaaggtttcttatatcctaagtctaataggcatggagaaggtctatggaggcaagaaaaactcatttataaggacgatggcagattcaattctagaccaacccctatataattaaatcgttcttttacctttactttttagccatgttttctactttaccctttatcatctatctttatcaatttgcatcgtaaatcatccatcttcactgtgagaatgtgatatcctttgtaggtttgtcctgtaaaacttccgattcatccatgagacgggtggttatctccttattgatctaaatcggcctagagaatggttttgatccctcaattggctctgctaaccaatttaatatctgaaacccatcttggtttagagttttctaatcaaggtggttggcgactccgttaacactaaatgtatgttcctattcttgaatgatgaaattttagccgatataatgtcaaagtaatattattatctaatgatatatcttgtcatgcactcacactagatgacaaccactcttttatatttttaatttttaaaaattttgagctggctccagttgaaaaactagtaaactactagtcaaattcaaaaaaaatagaaaaggtaaaccaatctgttaacaatgaaatttggtaagcccctaagagaataatcatgtcgccaatagtcagattccttctatattcggttaaggaaattaatctattaaaggaaactaatccagatgtgaccgagttcaaggagaatgcggcatggcagtttatctattaattaggtagtatttgttagtttccttttatctttaggaaagtgtgtttagtgtcccataagtactttatgttttccttttatcttttaggaaagtttttttcttgtcttacaagatctagtatctacccatggatataaatatgtacacccggggtcattgtaagagctttccacgatcaacacaattcggcacatcgccacctttttatcttttctactttttatcatccggcggaacttggcacctaacgcggggctgcatcggctttcgatctccggcgaaggggtaagccctacgttccgtcggcgcaggcaattgtattggctatattggcgtcgttcaatgctgcatcagtacattcgacctcttggatttctctggtttggttgatatatttacctacctatttatcatatatcttagttaatctagtttagaatcttaatttacttgtatcagctgagatttgttttagggtttatgctggtgtcggctaaattatcttgctagattagattagctaaggtatccaccaccatgaaaattagtcaaaggcttgattgtttagactttatgcttctttgcatacttagtgctatatcagttgagtttgatctattaagtcgtgcttagaatcataaagtctagcatgtctttggttataataagggtttcatcggggtttcagccgatgaggtatctggacgttacatcggcttataaggattgcacatataagttggattcagccgatgataacaaatgtttcactgtttatctaaatcgatttgatcttatgacatcggacctccagctgatgtatactttaaccatcggatcagtgcttgttttaccatctcattgttagccaattggtttctattggatttatattgttattatattatattatattatcatcagccgattgtctttatatcattatctacattagacatatagccgattgctcaaaaccctatcgctatcgactggtatcagcatcggctggaatcactccatcggcttgtcagccgatcggctatttgatctactgtttacatatcttgtcagttgcaggttcaaactaactagcacggccgcatctcattaacttttggacctgcactagagctaagcagatctcccaggccagtgtgtgtttttcgcatcaacacaatcaaattaaaaaagtaaactaattttttaataacatttatctgaattttatccatttccaaaagtttttcaatgtttttcttttcgaaaaccgctagtaatggctttgtgaaccctgttcatacttcatatgttttctagccgagccctaaagcttcactctagggttagtttagtcactagcatttggctcaaagtagttcttcgatccatggaaaaggccatgtgagtgtgccatgccatcctcgtatgtaagtgtaatgatcaaataaccattctattattatatatatagtattaaaaaagaaagaaaaaacaaaaataagaacctataactcatgatagaaacaattttgagctgtcccgttatttctgttttgtttttctttatttttctttaatatggtgtgtgtgtgtgtaagggtagaatggtcattttgttgctataattatatatgagtatgatatgtcacacccacgtggccttttctatgggtccaatgactacatttgtcggagcgaggatcttctttagtgggaaggcatgataccccttttagagtttgaccagggtgcacattccgagctcgtgcactgggcacgtatgggagtgagtacacatggtttatacaggttcaggccgctcgggaatgtaacaccctactcctgtgttcttactctatgagatagtgtcaatgttacagtggaggatgatgatatgttctaagtggaagaggatgaaccctattgtaacaaggagataatgaaccttcttcactgagtttgatatatgaatctaacttatagcctatttcagtctgtccaattccaactcccctctctgtggcatggatcctccttttatacatcaagggggtccaggtgcctatgtatgcatacaaaagtggggcccaacccaaaggggttggtatgctagcttggtcttgtagttgtccatccaagcaggctgaccagatgtgatgaactcacctaccggccaatatatggagcggggcaaccgacgtctttgtcccaaatgtcaatggacccgcccgtcagcctccgatgctagtgaaaggggggcccgtggggtagatgttgagcatgtgccgcgtcacacgacctcttttcgaggcaacatgggcaagcaagaggagaaatgcacagtctcgttacccccacaccacccgtgatatgtccataagatgcgtatcactacgcaattaatgcagaatgacatggtaaggtagcgcataagaccaggtcaaatctccttaatatggtagattctcttgaagagtcctcctggcatagtcatcggggccttgatccacctgtagtggttctcaggcccccaaggtaatagatgcttgtcccaggcaacggttgtcccctagtcgtcttcaacagctcaagacgacacttgttacttcacttcatcttctactttgtacacggtgggtcctatggtgccccgagcattcaatggatcatcgttcccatatctccaacaaagttgaaccaaataatagattttagacaaattttgctacagaacaccgcaattgtgtgtatttagctcagggacaccgcgaaagtgaacttttgggggaagacatcccataatcgtggatatttgctgatggacactgcgccgtctcctctccacttgacgtgctgacgtggcaaacgggaggctatttttttgacgcggtcggacgtaagtacccctgtgccttatctcctcacatgcactcggtagacagagcagcggcagagccgatggcactcggcgacgttgtcgccgacgccggcggcgatcggtggcggttctgacgatgcggctaaaagagaaagtggagagggcatccttgcgaatctataggtggtggttttgtgcaatatggtggccggaatagttgtcggcggcgacgcgagcggcagtgactctcggcatgccgagctccggctcgtttccatgtgagtgagtacatgcgtgcgtggctacaaggctcctggagattcactgaaggtcgtctgaggttcggcgatggatgggcggtgatggcgacctttgaaatgctccagcagcggcagagaacggcaggtcgacagcgtcggctccttctggccttcgggctgtcaaagggaggaaggaaacgattcaaagaccatatgaggatgctacatgtgtgaggaattgcgccaaagctcacccgggagcgaggaatcgaaggaaagagccggcggccggacttgaggaagaaaggttcgatctccttaacggcagtgcctcggatcgattcctccggcagacctccttctaggatgccggcgatgcttttggcgtagtggctcggtcaacgatggcttgagtcgacgggaatggcgaagcgacgcacggcggcgccctggacaccgagaacgccgacgagcgcatcttcatatgcttgatctgcggttaattaggatgcaaggacatggctagatcaggtagaggaagtagttcacgttcccatggataaaatgcgacgaagctcaccagaggtctctaagattggatcaaacaccttcgagcagagaaatgaggagggtgttcttggagataaggcgcaggggtatttacgtccgaccgtgtcaaaaaaaagcctctcgtctgccacgtcagcacgtcaagtggagaggagacggcgcggtgtccatcagcaaatatccacgtttatgggatctcttccccccaaaagttcactttcacggtgtccctgagctaaatacacacaattgcgatgtcctatagcaaaatttgcctagattttaagtacttgtttggaaaaactgaattatcaaggaccaaattgatcccgcagaaaaaaaaattatttaccttgttggctatttaccattccatttacatggacaccattgaccggtaccactcaatttttatcaccaataattttcaagtcaacaaatttgaataaacgaaaatcaaatggttatatttaacatacaccaaacttcgctaaaatagtagtagtcatagttcggaaataatagtgcagggtgttgagtagcagtatttaggaacagaggaagcaactgtctatttttttttagagaaggctttttttaacccagcctctatatccaaccagatatatatagccatatattgggaagcaactgtctatactttacagtgaaaacataagcaatttttttcactattattattttattttcctattatctgtgcagcatgagtgattttaaaaggagaaaaatctgagctttcttgcccctggatttttcaactttttgaaaacttattttacaaatatacccctagaaaaatttattccaacgatggatccttttcacagcgccttgttccaatatgtaacggcccgtcctctagaaccatgcagtccaacccatccgacaagcaagcccatatacacatatcatcccacttacactttcatcatcgcttcgggtaaaaggttgaacccggaacaagaagtgatatggctggaggtataaccccttataagttagttccaccattgctaaactagcattgtgatattaaacatgcgtacacaactttcatgggtcacacatgccaaatcataattggccagaatttcacacaacatgacgtcgccaatgatattggcgttgtctccctcgcactcccgtggaagctaagtcactgatgtgaaagggatcaacgttatgtacctatttataaaaagagtaaattgcatccacggtgcatcaatttggtaggtaggtgcaatttggtacaacaatttgagaaataaacgttctagtgcaacaacttggtaggtaggtgtaatttagtataagaactttataaatgattgtataaatgcaaataggtacgattttgatacagtaaactaagaagttatacgacaacttaattatttgaagcaatttttttatatagattcatttttaagtaattattttgacaatatactagcgtggatttgtataagcatatttatatttttatcgtaataatccatagctgaaagtcaattaaactggatgtaaaaattattatatttcggttaatatttgagaagataaagaaaacaaaaaaatcttaaagataattggatgtaaactatatgtgcaatataattcttaaagattaaattcaatatttaaggtaatattcgtaggattactatgtaatggcatattgacatcgtgaaaaaattcatctagcatatgcttagccaaattgatgcaccaaaatatcgaattatcaagttcttataccagaacgcacccacttgtcaagctattgtactcgaacgttcaattcttaagttcttgcactatatcacacccacctaccaagttgttgtactatgggtacaatttactcttataaaaatttcaaaaaagatatatttgtaataaaaaaatatgtataaatatgtcctcgatgctaataacgatgtcattaaaaacctattgtatatattttttttaatttcaaatagatcattggtgtcaatgtcatttgtaaaataagtttttaaaaatgaccaaaaggtaaaaaagattcaattctcgacaaactaagaagtattaggctgtgtttgatagtagagactcattagcgtatgattaattaagtaaaatacttaaaaatatatattaatatgattttttgaaaataacctttttataaaaaaaatttaaaaaaaattacaccaatttgaaaaatatgtgcgcgtggaaaatgagagtaagttggaaggatgggaaatgaacagagcctttagtatatgggtcgatcggatcggatccgacggctctgattgcatccagtcccagcaccgcccggactcaggaggagagtgacctacctacctatacatctcctaccaacttggaagagagaaatcgtgtcaaaaaaaacaaccaaaaaacagccaaaaaagaaaaaaaaaactcggagagcggaatagaggccaattccaaatccgccatcgcatccttctctccatccaccgaggcggcgccaccacctctcgtccggcggcggcgcggcgcgacgctccatccccggcgaaaaggccgccggattccctgtgggggcggcggagaggcgtcggaggaggctggcgccggcgcggcgacaaggttagctgataaacttttttttttttggggggggggggggggggggatggcctgtggggtggggaaggcggcgaggtgtgtgtggcgcgcatacccgcatcaccgacctagaagttagccatctttcgtgcaattcctctcgttggggaagaataggcaaccgggtcgtttctttgacagcaaatcagacgttcttgttcttggtcaaaagaataatctaatcgatgcccctgtttatcagactaatcatttcaggtgattcaggtgaggattatttggtcctttggttggttactagatgcgtagtaaacgccaagagaaatcctcacagatgtcaaacaatttcatcttatgtctttctgaaattacctttttcagctagtacatgtaaactggagttgtatatatatgtatactcgttggcgttgattgctttctccatccattatgattttgcagcttaattaagcaaattggattcggatcacaaaggaggcggtgcctgtagaaaagccatggcttcttcggtgttcaaggcgatggcagagaaggcagggccgtctgtccgaaagcaggcccttacgctgaccgatgcagcggcgtcgagggtgcgccagctgcttggcgtacggcagcgtgcttatctccgtcttggcgtcaaggcccgtggttgcaatgggttgtcgtacacaatgaattatgctggtattcggtttccccgacgttttagatcttgtttatcatcttgatatgcgaataagctctgggtctcttgttctactgttgcgaggaaaaatttagattccattgtcactcttcctgaaattcctatttgggtgctccctgataatgtccattgcaaattccttttagagccttgtgacaagataggtcaaaaccataaaagaggtattagcttgagtatgcgaataagctatttgtctcttgttaaactgtggtcaagacagatgtaaattccattgttaccctttcttaaattccttggatgcttcctgatatttgagcttgatgcaaaattgtcatatctgatcatattcctttcaaattccttttaatgccatgcccagcatcacagttgtcttgcaagcagtagcaagagagagtgttctttggtgtatgtctggagccagggctctcaatgagttattgtgtgatcgcttcctttggatggttagctgctcctaggaggtctttttgttgcacatcgctttttgtgatgctttttttttcctctagagggttccttctttatggatcacctctgttgtacatatttctgcttcttgatgaaatgaagcgcaagcctcttgcgttttcgagtaaaaaaaatgtgttaaaaccgtcaaatttgtttgtcactatccacaaaagagttattagcttgagttcataataccagtggacatttgttgtgtctacaaaggtcatgcttccctaataatatcaggtggaacttaagcgtctagaaaatgaaattagttctcaactggattgagcgatttggctttgtttgttcacatccttgtcttttcagctctctagcattagcacatataagttagccttttaggatgttggttgattccatatatgaactttatattccaaaaggtacctttgagccaaattaacaatggtttacctgcacatgttttagggtgtctctcttttgtgactgggcactgaaggaatatgtatgcatgtttatttggaatgacacctattcttcttcacagcttctgagattataccatcttgctaaaatgtgtagttatttcaatcccatagtcacttgtttgtgccataattaacagatgggcttatttctgtgcttaattgtttggctacaaacgatccagttaatctgactaatttatgaaacttatactagtattgtaatttatgctcattatttctcagatgagaagggaaaattcgatgaacttgtggaagataaaggagttaagatactaattgatccgaaagctcttatgcacgtgattggaaccaaaatggatttcattgatgatccacttaggtatggttattttaacgtcttttttctttttcttcttttgcaaattgccattagtgattctttgtcttgtaggtctgagtttgtgtttatgaaccctaattccaagggagaatgtggttgcggcgaatcatttatgacatcaaccaaaaacaaaggcccggcatagtccaccaagttttggcagcgatttgttgattatttgatgtatagaagtatgttgctaatttgctatacacttcagtgacccattgtagaggaaaatttcatttcagctccattgagctgattatccttcgtcactcagcatggttggcacttgttacctttcacctctggattggatcatctgcagcaaaggaggatactgccattcccctctagcacgaaacatccaattgcaagatgcctcctgattgcatactctggtgagaacaatggaggtcagcgttccagcaactcgcctgagggatcatataacaggattttcggcattccatccactcgctaagggatcatataacagaggtcttgtttacatcttgtaagatggcatccaaggatagatgtggcattgttttttttcctcttttgcaccatgatctgataatcaccttgctgcatgttcatactgagattttgatctctcatgtaacgggattttatgccatttatgcttttcctggttggaagttgatgttaaatttaaccatgattattaacctacgagctgtcctgagtaatcatcatatcataggattaggttgtgaatcatattgttccatgttgatgagataaaaatcactaaagatagatgggtagatcaatgtcctaaacatgacacttaagctgtcgtcataagctaccatagtttgtattagtaatggtttagtagtagtttaatggacaaatgcaaagttggctgatgcctcctggatgacctaagacaacctgtttccaacgatagggtttctcctcgtagatcctcgggtctacatgtcagtgagggtctattttcacatgtagagagcagtactgcatctcaattggtttcgaacatgaacccagttatccagccatcatcatccaacagaagcatgtaatctgatagaacatataaaacgaggaaaatagaacccatttcattaactgcaccccatgcacatagttcgatagaacatttgaacgccattccattcgagaatccaggttcaatgttgggaagaaaccgccacctgaacaagctaaaatatttcaaagttatgaaccaatgccaacttctcgagctagttaaggggcagacagcctgcaaaagcatattcaattcatctagtggacaaagttgaaccctagctaatctacggaacgtcgctgaaaattcgcctaaaaacaaaaaaagaaagaaagaactcaacgcaaatggaactagaggctttctccagtgtatttactccaatacttgttgaaacacagattttatcatcatgagtttcttcccaaactgtcccccagtacaaatcgagggcaaaacacccgttgcagtcagttgcgaggttgtatacagctgggtaaaaacatgagcatccttatgcctgtcactccacagcatatgcccactttgatgtcacatggcagcgatctcaggcagaaaatgcatatgttcgagtaacatatgctgatcttaatatgttaagttccaagccaagtgctcactttccagcacatcgctcaaaatcacaaatgatctctcaatgtcatcaaaactaaccttcaggccgaggccttttatagtctctttcacctcgctcatgagcagtatcatgactgtcatggtgctttgagccatgggaattgcgctgttctttaatgtcgtccattggggcatcttgagcagtctctggtgtattctgcttgccaaggtgcccattgcctgtaacttgatcagcatttctatgatccccccgatgcataacatgaggggaactctgcttcctctcctgctttatcttattatcctcaacagccaattcaatgtcatgttctagttgcctctcaagatcatcatcatcatctattacctctaccttcctagcaacatcacctttcagtttcctttgcttttccatttgtgctttcaccttatccttgtcaattttatttaccatcaaggatgtcacattcgtaccatcattgccattgcggttgacatctctgatttcactggagttgccatgtgatggaagattcttattttctgtcatggactgtttgtcatgatgtaaaccatcgttggcaccaaaatcaactctacttccactctgattgcttcttgttttgttgctcccatggtcaccattgtcattttgaagcattttctggtccacagtttgcttttctagatttgagtgctcgacaccatgatgacttggagcacctgttgaatgctgtgaacttgactgtttcgactggtgaggaagaggtgtttcctcggattttacagagactcgctgattaggaacactagcagagctcccttcagcttcatttccatgggacggttgtgcctgtgctgcacagttttgctcatacagctccaacatttgattgctaacttctgcaatcaagggagacatgcattattatctgatttaacaagaacccagaaaggaatgtgtcatgatcaaattgtattatcaaaaagttaaataagtataactagtgcaacaagaataaaaagacttaaaatatacagcacctagtcaatgtaaatttggattgctcatagcaacttagcaagcacaaatcaggttgcgcaagatgacacgaccaaaagaaaccggtttctggaccctatcaaattttcgaaaactggccacaattaggcttttccagaatttctgtgtatcctggtcagctttcattgtaatgtttatacttaatatatagtttggcaggtccccactaagaaaaataagtgcattcagccagttcagttaaccattgcacatcagcaggccaaggtatgaagataaacccttgtgaactctaaaattgacccctaatgcagtgcttatgccaactgaccccaaaaattctagccatcagatcgaacacaattagcacataaaccctcagatcctaaccaaccagatgctttgattagacagattgcaattgaaagcgtgtgcttatgaaaccacgtgaactatttatgaaatcacacatacccatggagagatttttaatagctccctttagaaggtagaacatacaaatagtaataacaaagatctgagaatctgtatgctagtaattcattagaaagactactacataagctccacattatgacccaaatttcaatcaatacagcagaaaataagaaaacaagaacatgctaatgaaaggcacaattactattccaccaacacccactacgaattaatccactacgtaaatcaagcctttcgcaagcaaccaattatctgttcaaagcagggcatagcagatcagtaaagaggcgaggatctgagcatggcatcacacagagagcaatgccaagatggtcgtgccagaggtcaggatggaaaccagcacctcagtgctgcaggccacagtgtagacctcagacagcatcagcctcagcaggccacatgctttgctccaggtacatcattcccagaatcagtgaggggatgaagaggggagaagaaagaagggcaaaaatgatgaaatggtataggtaagaagttttagcccaagttgtggtattactacttggtacccagaaaaaattaatattttttggtacctggccaaattcttgtgaacttttttgtccttgcctttctttgaaaaaccttgtgtatgacggtatgtcagtcttaacccatccccccagaatgttgcagaaagttaatgtagaaaacaacggggtgtaaaccttttagaaaaaggacagctgacgatgtgaaatttaaaatcgaaaatctgcacaagttgaatacaaatatgtacttttctgaaacagaggattatcaaaaaggaagccgcgtagtgtgaaaagtatttctacaaaccatgaccaaacatagcatctgatgattgcaagatgatgctgaatactttagacttatattccctgctcttctgatgattaatttctatttcctagtactactatggaggcatggactaataaaatagaccattctaaatccataacaaacctaaggaacaatgtgttcttttctagatgtatattaatttttgtgcaaaatccaggaatgaaatctgttgatgaatagagtaataaactaatgcatcagaacagattctccattgcttcaactagtatacaaaatttaaataagctgcagcgcaacattaactgcttcagcagccagcagtaaggtaccaaagcaacctagtcaacatgctcgttaaaaaaaatatgcggtttaaaactcaggagattgttgtaaaccgtcatatggaccagatagaagtatagaacacaacattatctaggcaccaaccttccagctgtcttggagtcacatcaaactcctgccaccaaaccttctcaccatcagatggaagcttcactttgagaaatttagcagccaaaaagatagcacctgctgcaatatgatgaggcttgaactgcaggcaaagcgaagtacgcagcctgtacaatatacgccctttttaacgtgttatatacatgattgagtgatatctctaaagataataagggtatcaatagcatacccatcattgacaaaattccatgcaacctgagcaagcgcattttgagcaactttaaattttcttattgcttcaaccaaaggcttgtatggatgatgcacattcaaatcaaacccaagagttgcaagtacaactcgctccgcaagtaaaataagttctttttgttgatcatatacttcctgcagagacaattacagaccattcattaaagcatcccagtggaaatcattgcctggtgcaggaagaaaaataactccgtccagacaatctcccaaagcaggaaatatcacgtgcagggaaaaagcctatactactatcaggagtcataaacgctataaccctatatgctagccttggattgttttcaagaagcattagctgagaatagaagcatacaatggtgactatttacttccatttttttttacatatgcacgcagtaaaaccaggacggaagtaattatcacaggcagatgccttgatggttaacttaatcacaaccaacatgatataatacaatgaataactgtcagatgttgaaatttgtttacatgtaatttaacctcacattcttgattcttccattagataaattctaggattcaaaaatgccgcaaaaaaatcaaaaaggcgatgggtaatagttgccaatatagccagtaatgtttaccaggaaattgaacagtcaaaatacttagaacatcaaagaaaactaaatatcaggcaaaacggatggtcctgctgccaaatgcagatcagagggatttttttttgcaagaaagaaaacaaattcataaaattaaagtatatagcaaaagaagcatctagtttattgttaccttctgcttgattctctgaccagcagcaggatcctttttatgaataatctcataagaaaccagaataacatctttcaaaggcctaggcgtctcttcaacttttccagccaagaacatgcaaactgtggcaattgtctgtaagaacggtcagtacaaattataagttctctcttcaaacaggtacagatctataggacaacacttaacataggagtaaaattaagatcatgcaatcaaaagtttgcgacacgagaatgcaaggaaaatgagaatagaaaattatttcgtttgatacatggtacaaaatactaaacaatctcaggacaagtaaaacaaactcacatgcactacaatactgtctctttccattggcagtaagaatttgtattcatttctctttctggttatagctctgagcttttgacactacaatactatagacatagcaagttctacattatatttgttccagttaattccaacatttaaggcattatccggaagcatctcccactttttcatgtgattttcaatgctttcatgtgtattagcttaaatcaaatatgaaagtgttgtattatacatgtgatggctaaaagcattcaagattcgccagctggtctgcacacagatagcgcagaagattgaggtgttccgtttgagaatcccgtggtagctttataaatgctttaccgccttagcggtatcatatccttgcttggtttccattcacattggttctctcgttcattttatagcaaaaccttgggaaatgtaaaaattttccaatgttacagtagggacaactttttcacaccactcaccaatgctcccctaactcctaactacatagaagattgataatggggcaaccactggtcaactttaatctggatcattaatccgtaacctccaccaacaactatcaaatatatgtggtacttttatctcataacaaacagtgcagtcaaaagcacaaaaggcgctcgcctagatgcaaaagcaagcgaagcgcagggtcgcaactaaagcacctagagtagcttaaagcacaatgccgttggtgagccaactttaggcttaagaacaaggcgctcagacgcctgctgccttctttttttctgccagcttgattcaggactcatattttgggcatcttttgttgaaggattaggttattaacttcttagcagaactttattaatgtggcacgctatgtatattatagcagccaaaaactacttgaattgcagtttgctagtctcggaccttatccgttatatatttcttaactattagtttgtttttggtcagctgccagaatcaggcatggagcttcctacttaggggtagacatttatgtttttatattgtgctccatgtgtctaaggcacacactttttaatgctttgtacctgaggcaatataatactattgcgtcttagtgtacttttcgctttaactgcactaataacaacaacttcagtccctataaattaagtaatgaagtccccatagctcttgtgatcgtaaaatgcaaatgtcaaagtatgtacttccccgcgacacaacttctatatctataaaatattgcagttttcatcgctcctacattactatccatacagaaggaaaccattttcttgttaaacatgttttagaactagataaaaaatgcaaatatgtcgttgtaatataaaggctactaactaaaagagaaatagccatccataaaaccacaaaaggaggaacgaaccaagcattgaaagtacttactcgtctatcattttttgcatgggactgacgaaggtaaaaacggtgacagaacacaatagctgtagcaatagtgacttgtggcctaccacagaacaaaaggcagtcattgattggaagtagacagaatgatattatactccataaataagaaaaactaaacaatatgtagtattcacatgaccagaacaatttgcatggcaatcaagggctaaaatcaatgatataaagcacacattctgcttccatattttgataatatacacattcaacaagtcgaaaccaaacaattaccaggtcctcataaatttgaaagagataaaaaaacatcttctgcttctatgttgattatatacacataaatggatctcacatggatgtccaaacaaaggggtaaatagattgatcaagcttattagaacaaatcagaccaaaaataagctaacggcttacaaattacaaccacaatagatatacttcagttaagtttagcatcctttgaaaataataaagtagaaatgcatgcatcatggtaattgaagatcataataatgattgaaaggaacaagttaacatcaacaatgaaaaatataagttaaatcaactatgatcttacactttaagcctcatgcccaaatcttgtagaaaagtacaatatgattttcggaggtaagactctttcttcaaatcaatgccatccctcctggatggagaattctcttctatttcctttctactgaaataccatgaagcaccaagttcaccagtctcctcattcctgccctgggtagttctgtatgggctattttctacaattccatgatgtgatgaatcacttggcatcatagccatgtaaactcgctctcaactatattgagaaaggactgatgaagatattacttctttatctattgaaagtggcctgagcagcactgaacgaaaaagatacagtaagtgtttataaatttactaaggacaaaggacaggataataagatacagtacaagtaatgattaattctaaagtactaacatatggctttatgctcattccaatctgtaagttcgaaatagaaagagcaataggatgataatcatgctttacaagtcactagacccattaataccccactaccagagaaaatggcaaaaagccaagaatacgtctagtagtacacgttgtcgaactatgaatgcagggaactaatacagattatggtttataacattatcgggattatgctgtctaaagtttctaaagcatagaactagacaagtaaaatttaatcagcaaccctcgttacttccctaagatgcaaacctcattcaaaagcataaatcactttagatcaattccaatgtctatgtacgtattggtcctgatacaccaatcaagggtggtcgcctggttaaacagaaagatttaaatcgattattgatttatattatgtttgcaggctaacgaagccctatccccagtgatactcatcacccacaaaatgcatcatacatctcctaaaattgcccatccagtcaggctctttacacgaaacctaattacagtcttacacatacacaaagtggggattcaagatcttgcaaaaacatgacccccaataaacctattcgagcatggcaaacaatcatcgattcattctgacccgcagcctggctagctgcgaaccccccatagcctggctgacgtcgtccacccgtctagctgacgttctttcctattcacgcagatccgcgattcgaccctactcttctcctaaaaaggcgatcttgagcccaatacatcccgcaagatcacaccttgaatcccccatacccccgcacgaagaccatatatcgagccgaaatggcaccaatcgcgacacctagggtttcggaattcattgaaccgcacagctatcgaaaaatggcaagaacgccgcacctagggtttcgattcccctccccgctccgcgaatgagacccgccatcacgagacgcgagaatcgaaacagagaggcatcgacgcgtacctcgtctccccccgcgctagggtttcgcctcctcctcctcctcctccgcctgagcccgcccgcggcggggcggatggcgccgaggcgccgggggcgcgacgcggctccgccccccccccccccaccaccaccaccgagctttgcttgcccctctcgcgcggcgtgcgtgcggccgccgccttctcctcctcgtcgtcggcgagggctgagagggcggaagggggaagagaggaggaggggcggcggcggcggttcgggtgcttctcgcggataaaagcccccgcgttgcaaaaaccctagtctttcatgtgatttttttttggttcccctttggtttcagagtttgtttttctttgttttttttttcctataggttggggttttgattgagaatgataatttattttatgtgttttatatgaccgtagtgatattatatcgattgatggtttggtgttggtgttccgtataaattattattatgcgattggaagttttgtttatctgtttatgggccatggcccatcagcagtgacgcggtgcatgttctatttggcgttacgcttttcttactttcctgataaacttcttctgttttttctacatggcatgtttcggtacatgttctatttggtgttacgcttactttcttgataaacttcttctgtttttctacatggcatgtttctaaagagagtgaactttttttctctagcgctgcatcaacaaagaatggaagacgtcactaccatatggcttcagctctagccactctcttgtgtaatatactttattaagtgttttggtgagcaaatattttgttgcatcaaagattattattcatttaacagaagctttatttcaattgtaacacgttttttccttgttacacaaatattttgttccaacgagattttcgtttgttacattaagtatttttttaaatagatacttttattttctacatatgtagttaaaaagaagtgttcaacaaggaatttaatttcttatagaggagtgctgctcattttgtgtcatagatattttttggctattgctttattgtattgtgtgatatatgaagatcactgatgtaattttttgaaagaaagaaattgataaatggatgtattattctagggataatttagttgttgattattgtttaatagaggtggaaaaaccatagcttggtactggttgatgcatgggcctatcgatcaatttgacaaaatatttgtgctatagatgaaaatatgttatatgctgcatatggcgtcattcctaccccgcgtcatatttttgttgttcctattcttttcatacctcatggtcttctttccatcatatcattattcctatttttaccataaagctttgcgctacctttggaatctttcatgcatgataactgcccctcctagacaaacagtcacatagatggaagtgaatgtgcaaaatccattcatcatatcgttattcctattcttaccataaagagggccacatttgtaatctttcatacgtgctaactgcccctcctagacaaatactagtcacatggatggaagtgaatgtgcaaaatccattggaagcaacattggtaagttatggggtttgtaggcaagtgaatccacctaattgggttcatgtcctcaatttggataggacaaagtataaattttgtgagacgtcctctagttgttaggcaagtgtcacagagacacatcacacactgggatgtattttgatgtgtactatatctctcttcccaagaaaataatttgtaggttgcccaaacaaaacatcaatcggaatagattttattcggtttccatttcaatgtacgactaacccaattcaattttgattcccattttcatttctagatggacttgaataacccagttcagtttatcctatgtaatcgtataaacaaaacggaagcttgtagagacaaagggctctaatacaatcactatttgtagtaacaggttatgttctagatgtttaacaatgttttttggggtatttttttgacaaagcagagttttatgtttaatttatagtattaactgtttcttctgctgtaatttgtcatttaaagcttaataacattgcatcccttgaaaagaaatatatcataactaaaatcaacgtcatgtttgtatattggcttctggactaaaaccatgtgcacctaaggctattttttcaatgaaaaattattcaccgtattattaaaatggcttaattgttctatactttggaaaataaattttcttctactatattatttagaacagttgtttcaagctatttgctaagtttatttcttaaaatatttaatttattcttaatagtctagtgaaaattaataatctatttcacacgaacctccggtaggaaatcaagagggaaagcccgtttctaccacttgaccaaagaattacatttcatttcttttccacttattttgtacagctagcaattctaaccagcaagcaccttctctagcaccaaaacagctatcccaaattcaacaaccataggagtatatgtagcagcttctagcaccaaacttacctgaactcatgatcacatcttctcatcattagctcatcactactcagtactcactcctctagaatcatgtcatgtggttgatgccaaccctgatcaatatcgactgactcttgtcatctctgttcctctactttgtcacctctgtagctataagctgccgtattgggaggctctacagcaagcaagcaagacattgatggacattggacaagatgccatggcaatgcagcagccatggccggcatttttggatccacgaggatactgttgggcaccctacgagatacacaagcgagcagcaacaagggtaagcaaacgacggttcgtgcagtatctgtgaagatgtgtaccactcccaacattgtacagttgcaggcacttccatcaatggccgtgtttagttttcccatattctcaactttccatcacatcatatcacatcaaaaacttttatacacatataaactttcaattttttttccaaactcccaactggccgtgtttagttttctccctattcccaactttccatcacatcatatcacattaaaaaacttttatacacacataaacttttaatttttttccaaactcccaactttcttcaaacttccagattttttcaggaactaaacacaatcaatgtgtatcaacgcaccctgtggtatctcgtactccccctattttaaaatataataacttctatctcttaaaatttatctcaaaatataataacttctccaccaatattattttctcaaccaatcacaatctctttccatttaattttacatattctcttaatagtcatatccaactctaaaaccttttatatgtgatttaatagtatgttcttgtgaagaattcagactgcaacccgacgcagttgggcacgctactgcctgaatgcagtgtccactgtccaatggaggtttttgcatgtacggcatgtaaaatctatgaattaggagtactctgctcaatgaatttatgatttttgtgttaggcgtccggtatgtctataggaaatacatgccactcagtgacataacccgaaatagttttgaattcaggcaaattttaatataattagtatttgctaaaaaaaatttcatcatcaatttactaatcaatattaaatcttaatggagttttcatcgatgagctcagacagctgctcgggctagctagccgggcagtggctccacgtacgtacccccgatgctacttgacttaaagctgagtacttttgagcagctcctcatgataacttttttttttccgttaacactttttaattgcttaatgatatgtttctatataaaagtttaataaaaatatcaaataataaatcctttttaagtttaaaatagttaataattaattaatcactcgttaataatttatgcatgaaacatactagcccaaaccaaattgttgaatggaatagtactaccctaacacttaacacgaggacacatgcagagaataaacctcaaagattgaaagtttgaaactatccttgagatacatatatgactaggggtggacaggaagctcgtggctcgttagctcgctcggctcgtgacacgctcgactcggcttggctcgtttaaattttgtaacgagccgagccaacattttagctcgttagtcatagcgagccagctcgagctggctcgcgagccaaaacgagctgaagcccaccagtggacagcccatcaaacgaggcttagtagcagcccaatcatccacgaggcccaccacagcccttgatatgccaaaccctaggctaaaacaagcacacaagcaggttaagcaacgccgccgccgccacgcttcccacgcgcagacctgcgcgctagcgatgcgtcgtcgtccttcccatccgcgcggctctcgtccagcgcccgacgccaccgcaaacgccgccgcccgcgccgctcttccacggcgcccgacgcggccatggacgccgccgcccgcgctgttcttcctcggcgcccgatgcggcagtggacgccgccacccacgcccgacgcggccgtggaccttccccggcgcccgacgccgcagtggacgccgccgctcgcgtcgctcttccacgacacctctccaccctttgttcgctctctcttgtccagttgtccccaaagctcacgagctagctcgagcttacaaacgagccgagccgagcttgatttctagctcgttaggaagccagaccgagtcgagccgagccagctcgacatccacccctatgtatgacgtatttcatccgtcctaaaaagagccactcctatattccatatgcaagtttagtagtagcgtgaaaatactaaagtgcccccaataactacttccgttccgatactgttgtttctctaaacccaataattacacagcatatacgaagaacacaagcgacatcttgcgaaaaaaaaatccaaaaattcaaaattttcacttgccgaaagaaatataacatctccaatctgaaaaaagaaatgctttggacggtcaaatgcaagaattagcaagaactaactaccaagaacagagattaatcgtttgccttcaccaccgtacgctcgtgcatcctcttgcattagatcctctgcctccgccactgattgcgtcgcatccacccgtagcctccacctccatctgcaaaataacgagatgcacctgcctcaaccaccaccgccgccatattcgagccgaatccgtccgacagtgccatcatctgtattggatccgcctcctcaaaagcctctgcctctgcggccacatccaagctgccgcatcagggtgcaggtgtcgcatatgagctatttgcgaggatggtgggagggaaggaacatgggtagagcggttcatcgccaatgggaggggtaagagatgggtggaaggaggagagcgacggacgagacaagacgagaggaaagaggatgagtcaattctgtttttggttttttttttttaatcacgcttgggtgaggagagagacaaaggataagactgcccgctatcgctgtttctcgatgtatggagtagaaatcgttttttttttttggacaaagcctccaccccagtgctcagaaatcgtttttttaagatggaaggagtgcaagttttatgtataagaaactacgagactgggtttctttcaaagttggaaatttggattgaaattggtacgatgtgactgaaaagttgtatgtgtatcacaggttgatgtgatagaaaaagttggaagtttggatccaaacacagccaagattgaaaagttaatttgaaccagtggaacacaagaaaactcacaagagcaacaagtgcagtacactggtcctactagagcaagtgaagtacccggtaatcggtgccccggccggccggacaccatggcgcaaagctctgactgcctcagccttttcacctggcgatcgactggcgacgcaacacgacggccggcgagaaaccgatgcctcgtccggtcccatccatccatccatccatccatctcgctcgacagacacggggacgcgacgcgatggttcgacgacgacggatggcgcggggaagaaaggcatatatggcgtcgcagccagcagagagcacccacgcggggaaacaatcgcctgcaaaaatgcaaagcaaacctttgcctgctgcgctgcctgcgcgtgcgtgtgtggatcatcgatgctcgacggctcggtgccgtttctgcatgcgtctttggcagatgcgtagattcggcgacaggggtaccacaggacatacttcctcagtcaaaaaaaaaaaaaaaaaaaaaagacaaaccctgatatccgtgtccaatatttaaccgtccatcttatttaaaaaaattatgaaaaaaattaaaaagataagtcagcataaagtattcatcatgttttatcatctaacaacaataaaaatactaattataaaaaattttcatataaaacgaacagtcaaatgttagcatgtaaacccgcggtttgtcttttttagggagtatacgcttcagggggtgcagaatttttggcgcagaaaattcctgttcgagcttgtgaatatcttggccgtttaacgcgagtttcagtgccgctgctgggtcagagatgagttatgccttaggacaaccacaacatgcttaaaaaaaagtaaaaaaggaataaatatattgatgaagtgcaccttacacattgtgtaagccagcaatagaaaaaagtttcttgtggtgcacctcaaggttacaatcggccatagtgaataaataactatttttttctcctctacttactctctctctccccactatcccaaaaaagttagcagccatctcatatttttattttatagtggacctacgttaaagactatatatgttgtgcatcatactataacaaatagctaactatttatggatcataccttaagatgtgtatgcacattatacactgaccttgccattatggtacaagcttttatttactgtaacggatcaatttcgtatgcccttatggtacaagcttttatttactataacggatcaatttcgtatgattagagattgactgagttggtaaattaaggacaaagcacgggctgagtccatatatttgggattagttgggtgtgtgggttgggaataaagcacgtgtcagtctcatataattagagattgactggatgggtgcattgagtataaagtatagggtagatccatataattagggattggttgaatgggtggaatgaggagaaagtagttaggtggtgtttggttggaggggctaaagtggggctaaacttcagttcatctcataaaaacataagtctatgagagaaactaaatttagtttctaacttctaaacacccccttaatcttatggtggttacacacgtacgaaggagcgcacgacctcttgcgcatgatgagaaggacaggatgaatagatgagctgtggagcactgccaacatgctcgaaagtacagttattagtagtagtataaaggactacctatttaattacttctagctaattcaatgagctcaattttcttatcatcttgcatgccagcctatatgttttaaaaagaaatagaagtctcctttaattgcaaactaagaaagaagcccgcgcagatgtgcgggtattttgtttaatgtttatgtcaaaagcgtttcctagattcaaacataaatcactatgtcccggttatatataaatttgtctaatatcgccactacttattattattattattattttattttattatggatacttattatcgttcttttgaaacctgagtgattatttaatagatgaaactgtatttgtaatatcaaaataagaacaatacatcattaatcgactaaaaaaattatctccactactaacctaactgttcatgtcgatctgacttatttccaaatctatgtataaatattccaataatattttatcaaaaaaatatattataacaatatcgcttgtatgagttaataggataatactgttaaaatttgatatgaatgcccatctaacggatgaagccgaacatactaccaaggctttcttcctcgataccttaaaacatgggtcacatatcgacatagtcgtgcccatcaagaccatcgtggagaatagttttaacggctaattcactattagtaccctcataaaggattgcatcgttaagtacccatggtggcttaactcatccaaatgtatgcctttgctatatcatggtagtatagcaagctttattatctatgcttggcacccttttgagaatggaaaaagagaagacagaggtgattacaataatcctttttaaagttttgtggtatatagtagacacaatttgtttatagtgtaaatcaatattactcaaatttcaataatacatatacaatattcttatttgaaagtgagtgaggttatcatgttagtagagtgtatgacatacatccatcaactatgcccgacacatcggaattcctgaagtataagaaaatatattatgggtgttactggattgtttatttgttgccaaaactatatgacaaacaaaaaacctacatatatgaccatagttctcatgatggattaaggggttgtagtatagccatatcactcgctagaagtatttttaataaagtttatcatgtctatgtatcatgtgtgcttctcacttttcaaataccaatcaaatagttttgaaaaattcaaaaaaaaatatttgagaatcgtaatatctcacatattaaaattagataagatctacttgaaaaaaatataactaaattctgttgttttcatttttcatttttacatatgtagattcaaattatttgtcaggtgatattgtacaccataattatttgaaaaattattatgacattaattattatgtgccattatgtatttatcagttagcactaactactataggtcaataatagttcatttaattaaaggaatacatcagaattattgaaattgatatatatttaatagatgaacacttacagaccattgaattcatattacatctttgatctagtttaactgcgtatattggttgggtaatattttttatatcatggaaaatcatagtttagagaccattgattttctctgatcatagtatgtatgtatatttttagctatatatttttacttgtgtatatatgttactttgctttttcttacatgggagattttgtttttttttgggggggggggggttgttttttcaatagacctaatttaacggtataaaataacgggttcactaatttaaagtttgtagagtaatatattttagctctatatcatagaaaatgcaaagggtgatggtatggctcacactattttttaatttataataaaacatcaatatatagatttaaattattgatttaattgtcaagaatataaagaactaaattgatcataaaaccaacttatagttttcaaaagttaaaacatgcatggagccctccacgaagatgacactgacctaatttaaagttcgtagagtaatatattttatctctatatcatagaaaatgcaaagggtgaaggcatatatatggctcacactattttttaatttgataataaaacatcaatatatagatttaaattattgatttaattgtcaagaatgtaaagaactaaactgaccaaaagttaatacatgcatggagccctccacgaagatgacactgaccgtgataaccatgaaagtctacattcaatcgaagatataaatcaaatgttgtttagattttattatgctttagatatctcaacaacctaaaaataagaagagcagataatgcatatacgtgcttgagccgtgagctgatggtgattatcttggctggtcgtttgggctggtgcttttataattaatcttggcagtgatttttttcaatcatagttatcaatatctttggtttttatttcgttcgtacatacgtatagcttttgcctttttttttttcccggatgaattgtacgcaaggattttctcttgtatgtgaataggatattgggagtgagagattatttttttagatttaataatttaataatttaattgtctaaaataatggtctcttagctttaagtgaaaatcgaggattaaatgttttattttctctaagaacttctatgattttctttaatttattatagcgctacttagcaacgtagaagcatttgtagagtgacacatggtgacgtgagagcgtttgtaggaaatttaatggacagagtataacaaaataaatgataattacatatttctttagtaaataaacatatgttcaaacaccaataatattatggatgtatattaggtaaagcaaaataataaaagaaggtgtataagaaaaggaaaaaagtctagggggtatgttacgttcgtacttgtacgtacgtacttgcaggtggtgagggaggcatacgtataagggtctatttttaatctaatctaatagtgcaaaattatggacccaccaatttaaatgaaaatcgagggtca

SEQ ID NO: 59577 - DNA, 7382 bp, Oryza sativa
tgtggtataataatcgttgtcatatcgtttttttcgttctccttttaataattataggttgtgtgcatcttagttatatgagaggttttaaggtgtttgcatttaaaaaaggtaaagattcaacgctccacaataaaaagcctgtttggcacagcttcaggtggagctggagctcagccaaacaatttcaactacaccaaaattgggagtggagctgggtgaagctctcttacaaaatgagctagagttgtggcccaactcctgaagctaaatttaggagttggtgctgtaccaaacaggccgaaaaggtaccactaaaaaggtatttaaatattggcataagtacttaggtagtaagggtaaaaagataattttctaggagatagagaagagtataattgtcttaattattagttatagataccacatcgttactggtagttatcatctacatgacgttatttgcgtgttctttttgagatttacattttttttcttaagaatagattcacacagtaatcgttattatgttatttacatgttttttagaattcactaattaaaaaaatatgtcttagggaattaaataacttaaattaatcatatcatcttggtgtattggttggaattcaatagagtttcttttattattattattttaaaaaaaaaacttctccacaagaatggcggttatctaggttatatgcatatgtgctagtggaggatatgttcttggttggactaaccactatacaatgatttctaaaaggttccatcagacgtattaaacgtattaaatttgggctttgcttcaatgaaaaacacgagggaggcaacaggcaagcgtatatatactgtgctggaaaagcatacgaacaacttcgaagaaatacccgcgctttcacgtacaaaagccaggtttctcagcatcggaaagcataaagacttacgctaaaactaacaaaaggtcatcaattagaaatggaatactaccatttggcccggtcccaatagaacatttcttcgcgataatgcagtgctctgttgcgtcgaccctgccgcgctgcatcgtcggcgtcgtcttttctcggcatcatgtcgttgtttatcggcatgcgcggacagccgcttggtagctttcttaagctcgctgaagctttcgtcagtcgccaatgggagtatatattccccaatcccccactatatgtaagtttatttcgatctcaattgtcgcacacccgttttgatttgcatgtacatttacacatggttttattcggtttcctcagcggaaccgaattcctcccccctttctgttactacaatgtttaatattgcattctattttcccctgacaaaagaatactgtacattctttatttttttctcgaaggaccagcttaggcggctggcattccatttatcttagaaggaacaaatacgattttgccaaaacggcggtatgaaaaagaaaaaaaatacatcaactgcagcaaacaggcttaccgttattgtacaagtcactctaagacgatattctcgttaaatccttggcgcctcccatgctccaaacccttatctcatccaaaatgaggttgcatacttgttgtatagatgattcactttacattgtttcattccattccatctcccctcctgatgaagaaatgaatactcatgtccattgagttagtttgcgtatatagcatcacctgatgaacatgactgaatgaaatggcatttctttctagctgcacgttgccaccttgtttataccgatactagcctaatgctagcactggtactactcgtggactgcacccattcgacgtctccaaacactcgcttgtattttactccacatcagggctcaggagtggtggcaaggggggttgagcagatagatcgataacgatgaagcacatgacacccctcggcccaaatggaggctttgagccaagtaataagaagtcaccgccgcaagttggagcgattcctcaacgctcgtgtgaaacgcgacgccctgactggtcgcctctcccgctctatctgcgacgacgactctgcatgcgcccaactggcaaaaatctctccctccagatcagccccccccaattcagcaagtctttcttcagatcagtatctgatcattgaattttacttctcttgcctaattcagtactgtactctcttgggttgttgggcattgcgtgttgagtatgtccctggctagctgtaaacctgtaacgacgggtgtggcttcaaattttaagccaaaaaaaatcacaccttttgtccaaagtttctattctgtcgactggcttttcagttttgaactcggtgatgtggaatctgttgtgcaaaatgttttttccctgatattgctatcaacgagacaacgagtggtggaccacaagtaactctcggctactgttcatagagtatgattttgtacttgatcaatcgtactttccagggttttatttaaccttcactttggaccatggcgattattcaagcaagtagcaaagcatccatggacagtgacacgaaacaaccaatgagatgaccaggcaagatgttaatgcaacacgaaagggggccaatgctcagttgcacaagtccaattaacacattgaatcaagagattaacaaaatgggatgaagctgagtacacttgcgttgcgtcacattaacaaatcctttttagttgtgttctaaactatcgcattcatctagagggagaagaagagtcaaaggccaattaggtttctggaggtggtgacgccgccgtcgacgacgaggttgtggccggaaatgtatctggagtcgtcgctggcgaggaagagcgccgcctcggcgatgtccctgggtctcagcgtcgcgcccttgagcgtggcgaggcccctgaccacctcctccatcttctccacctcctggtcgctgggcacggcgatgtcgaggtcgatgtcggcgtcggcgtcgtcggcggtggaggcgtcgtggccctggcgccaggcgttgatgagcatcggggtggcgacgccgaagggggagatgcagttgacgcggatgccgtgggcgccgagctcgcaggcggcgttcttggtgagccccacgatggcgtgcttggaggcggtgtaggcgtgcgggccgaggccgccgagcacgccggcgacgctggcgacggagatgatgctgccggcgcggcgctgggtcatggcgagcgccgcgtgcttcatgccgagcgcggcgcccagcgcgttgacgcggagcacgcggtcgaactccccggcgtcgaacgacaggatgctcttggcggcgcgcgtctggcggcccagcaccccggcgttgttgcacagcacgtccaaccgcccgtagcgggccaaggggcgctcgacggcgcgctccacgtcctcctccacggacacgtagcaccgcacgagccggacgtgcggccccagcgccgccgccagcgcgtcgcccgccgcgtcgtagatgtccgcgatcaccacctgggccccgtgcttcacgaacagcctcacgatcgcctccccgatccccctcgccccgccggtgacaatggccaccttcccttccagcctgcacgccaaaattccaaccaccattaacaaacagctccaagaaaacgacgagacgaacaacacaacagcgccatgagtaatttgtagtagtagtagcctacctcttgggcatgggagtgggggcgccattgggggagtcccaggcgtggagcgacggcgccatggacggctggtgcgccttgtcagggaggaggtcgagtgcggcggcaggcatggcgagatcctgggcgtaggaggcgagggtagtgtgcatgtacgaccctgtcctagcaagtgatagtgtgtgcgcctctgcaggggagaccggacaccgccttatatagcccgttggggcgcgcagccgcgcacggcttccctcccccgtcgaaagcgacactgcgttttctgaccacaattccgtcgacgtgtttggctcagctgccgcgcgggtgcgcgcgcgtgagcattcgtggaacgcgactgtgcgaggcagcagcgaggcagggagttgtctcggcttcgtgacgggtagaccgagtggcgcggcacatggttggagccggtcgagttgaccgccacgggtgcgcggttttttgtttcggtcaggatccgggaccttgacgctgaaaaagagttcactctctagtaagcctataaaattcatgaaaaaatcattttaaaaaagtccagtcaatttaatttcgaaacaattgaaaaaacaacatgcactacaaatgggtcgttttttttttctgttgttccttggcatgcacatttcgaaatgttttttgcgtggatatgggtcggtcggaacgggcatgccttagactgaactttaggattgaaccggtgtggtcgtgtggaagattgaggcagagcggatcaagatcttttttggaatttttgtttgggacgtgcagctgcaggagaggtaggcttggtcaacctcactgtaagactcgagaggcgttgttggcgtttcaacttggctcccacgatttccagcggtagtggttgccgatcggaggcgagttccaactctttcaacctaaatataggcaggtagatttgttcccaagtgagggattaattagttggagtattaatagaatccggagtgtgattgctgtaacaccatcctaattgcttcacggaacaaatcagcttcatgccttttaccaagttgtcaccaaacaagtactacgtgcctaggtcgatctgaccgtgcttttttccttgcccaattggatttcgtgcttaaggtagagtttgaatcagctacttattttttatggacacgcttgcagaattaataaatagagcttcagagacttactcttccattctaaaataagttaatttctagattttaaagtttatcacaaaacaagtttatttctatgttcttttgggttcataaatcaataaattttatcccttcaatattccttaactactcacacaccaatatatttttctattaatgagagatattttggacttttatcattgctgctaggaaccttaacgtttgacttgtaaagaatccccacaaaatttaaattttaaaacataattttctactctctttattttaaaaagaatcaaattatagggaagaatctggatacacattgattctttttggacagagtgagtagttaattctaggtatttcaacatagttttcttttccgcttttaagtagttaatcatagatatataaaagttttactaataaattatttcttagtcactaaaataaaccattttggtatataattagctattggccaaccaataggactgtgattatttttagagaaaaaaatctaagaaatatcattcacaagtgcccaattccaagaaatactatcgataagtgtgagttccatgaaatgtcattaccgtttccgtctatccgcgccgttaaatacattgtttatcctatagcacttaacggatggttgctaacagaactctaatggtgacggtatttttgggataaagtcgcttgcacgatggcatttcatggaactcacacttgtcaataatattttttgaaattgggcgcctgttaatagtatttcttggattttcttttatttttaagatacgaggaattgatttattttaggatagagttaaatactccctagaagcttttagagtgaatcttttttaatctttctgtcaggcagtcttgtctattaaagtgtaaaagttttattctagatttatttgtcgttgctgtcatatctagttggggggtataggagtaagtcgcaggaaaaaaatgcattcccctgaatataaccgtggacgaccacgtttaatatatatgattaattttggatggctaccagacttcgttagtgtggctgcttttcacgctgtcttttgtcctgatttttgccaaagctttgttatagtataaactactccactaattaaggatatggtattgtagcctttcatttttgttatgctgcatcaccctgcatctctcaaatatataaacaaccaaccaattaatcacatcaccttttctgtcccaaattgagtacaaataattgatcatacaggtacctcaattagcattggacgctgtgcttttaagacctaacagtgccatcatactgtatctctcaagggaaaaaaaatagtgccatcacatcgggcataagcatatgaccgtcagaccgtgggattagacacggaggcgattcagctgcaaatgtgtgaagatgatagagtgcttatgaaggttgcatgtggtaggcttaagacaacggtcatcaactctttgcaaactatggatggagattcacaaatagacttgaataaatgtgctcttcttattttagtttgatcttttattttgttgggtgtgtttagttcatttgaactacactcagtgtttggatgttatttttgtaataattagttgtagctttgatgagcaaagcccggaatgttttattccgttatctaaaaaaagacacagaggcgatattgaaatgtaccattgatctgtttacttttctttggtgctggtgcatgatatttcagtactttcgatccgttctataatatttacgttttattaatgttataattaaacaattagaattttaaatatagatacctttaaaatattgtttctgaagacactataatatgatatacagatcaatcttaaaactactttataaaattaaatatttacatatttttctatataataaaatatatagtaaaaatatgttctgaaaaccgtgtcattatctgaaatatcaatatctactattataaaaattgaagatgtttttaccggtatttggtacgtcattcgtatttgagtcgggttttaagttcgtttgttttttaaaatatagatccgtgtttgagttatattttaagcttgttaccttttggaagtataaaaggagttttatgagaaatatattttaaaaactcgcatgctaacttcagatgaaagatggactcctaattgcagctcatgattttctgaaaaataaatatccaagtcaattcccacaataaattttaccctagctaaactgtataacaataataaaattaaaatagcatttacccgttgcaacgcacgggtattttttctagtaattataaaaccaaagaaagtagtttaaactttgtaagtggagtccactagtatatgtttacttttcaaagataatatccatatatgcatattttaacgttgtgtgaacgcatgcatggtgatagagtctagggatggtagtgggtcgg

SEQ ID NO: 59578 - DNA, 38751 bp, Oryza sativa
tgcaagtagctcatcaccatcagtcaacaagttttactactaacggtagtaacagccttaataacaggctaacagcggatcgaagtgcaacgcagcgtgtattgcacagactggccagccggtcacggtgtacgtccactctgatcagtgaacgcacttagtaagtgtaacggtgaaagcggtagattaaggctcacccgacgactttcaccacggttgaacggagacattttctgatggttgtactgctcactagtcgcttctaccccgtgtacttgtacattaccgtagtacggtgcagctccgactgttaaaactcaaaagaaggccactcctcagtcctcactgtcctcggcaactcagatcagcaggggttggatggtcaactttccccacctcctctcctcccaactttcccctttgctacagtagctccttcttcttctccagcccctcttccccccaaattccggtggttcgccgccgatgatggttggaggaggggtccggccacctcccctattagtatagtgtagctaggttgtagtttctttgtcaggtttttcctgtttctgtggctatgtcccgtttggttacgttcaagcgaagagctctgattgctggtggtgatgattaccggagttggagctgcgacttgaaggacagaatcttcttcttatgctggtgccgaactcattggtctgcgccgtgtgcagacggcggttgccttggatctccaggtggcgctgcttcgtacagcggcggcggcggccctggatctctgggtgccggtgctctgtgtggtggcaacggccttgaaatttctggcgatgttgctccgagcgacaaccttggcagcccaagtgttgttgctctgtgtggtagtcttcaaactccaggtgttgttgcttcttgtgatagccttggagctcttcgtactactgctccgtgcgccggtgatatcttgagctgctgcttttctacaacggtgaaaacattgtgtgggtatggcatcttatttctccaatctgaaggttacttcttcgttgggagcttgctccttttcatttgttgtggtccgcttcagttctacaatcctgcagcaatcctcggccttctacaaagacagaagttttatcaaccatatgatttctcgtcatgtggactacctgttctaccgaatcttgcttccttttgcttcaaaacaacagtatccatacagggtctatcattcgggttgagcaatctctgctcctcagatctaatgaaagactccatggaaccaacctgctgagtccggtgatacctacaccaaaatctacggctcagaaacaaacctccgatctgtgccgtttccgtggtgacagctgtaggagccttccagtctgtcaagcggtgtgcatgtcaatggaggccaaaggattcaatcgtcgtggctttgctgcaaaactctgttgatctgatttcctactgttgttttgtttcatcagaaagtttgcttttttagagtggttactctctaccttgttaaaaatggtttcttggcttaagttgtatctttatgtgatgtattggggtatatcccctaaattctgtctttttgaataaagttgttcatgttatcttcaaaaaaactcagatcagtaggaagaaggaaagcccaaggtgaccaggtcaggtccacatcacgggaagtggccttcggggaaggtggcactcggccccgtgccctccggtcgttgcgttacagcgggcacacgagtgtgagaagccgctagcgggggagggagcggtcgctacccagagattcggccgcacgcaccgcagcagcagcgggtgcggggccaacgccaacgcatccgcggcaccatgacgcgctgcgtcaccaccaggattcaggcccatcgatcggccgtgtcacgcgcgcccccacacacacggggggcagtttcgtggctcgatctcatctgattctgatgaatcgctcgcgtcgcgtggggtggcgctaccgcgtctgttggtggcgtggcgaccgggggaggcttcacctcacctgcctcccggctcacgctgcaacaactgcatccccatccatggaccggtcgggagcacgtagtacactgcagtgcgctgtcagcgagggaaccaatgcgagacacacacgcgctcgcactggttgttggttggttacgtggacgtgcgcatgttgcagataaatatatgcgcggctccaagaacgaaataatatcgggtggggtaaagaaatactactggcatgggcgcaagcttaggcatctttttcaaacaacgtggaacttgctggctaaaaatttcttctccggacgcaccagcttgtttaggttgtggttgtgcctcaccggtttgacaggaccatgttcacgcatgccgcagtgtgattttccttttccaattacacagaatgaagcatacgcttgcacactgtatctgcgtatatgtatcccacatacagctgaaaatatgttttctaaccaacgtgcaaagagacagaattcatagcaaatccctgaccttagtaacagagggaaaaaaataaggatggatacttactgtgaatgtactatatgagctcgttttactgtgtcattcggaaagcaacgaaaattgttaacaagagaattgatctctgactaaaatttgtcacccgcgactgcttttgcctgttttacagagccattttggcttaacgtcaattcttgctttaccaattattttgtatcattgaatagcactttgtagccattaagattgaaaccagccttagtaaaatctattgcattgaggtataatctactttatcaatattttagtggtatcaaaaatttgtctatgatttagcattactaacattttagtagagcttcaaatcaaaatggtctgcaatgtccagcacttctcaaatttataatggtgtaaattgttttctatcgtctatgccatattagtggaagcagccaaagtagggatcagctaacagagaaaaacaaggtcgcaacggttctttgaatcaaatgctatatttttcacaattattactctgcttctatccaaacaagtcgatttcgaaaacgaaagaaatcaaccatgttgttccactttaccatcagaatatcacttgttgcttttggacttttgctagcttcccttttggccttttatcccgtgagctctcttacctttacggtttgttcataccgcggatagcgagcatccgacctggattcaattagccacgtcaagccagtaatatccgttcgtttcacgggcgcaaatctttgcaggatatttgatgcgatgcctatcacgacagtaatagcggcgtctgcttgcggctcggccaaaatggattagatttcgatttctctgccctgtaaaagtgtagaatagtagtgcgacttccaccatagcctctcaaagttcagtcaacaccaaacaccttgcaaagccgccgcaagtgatgtcgatttttcagatttgatactacttagatactacaaatctaatgaagaaaaacacacagttcacttcgaacagatgcagatcctgttactagcgcagcaagtttagcacaagcactaccgaagagcagactttccattcaacgtcaagaaggaactaatcatcaatttcatgaaaaaagaaaacatgcagaaaaaaattcgagcagaggcagttcctgtaaaacctcttgtcatttacttgcgcaactacatcacatcgctgatcataagtggtcagctatctcaaccaatcgagaacattatcactgatgagtgagtgattcagtgtcagctacaaatagaaaaacataaagaaagccgagacaagacacgttgacactgtctttctttagaacgacgcagcagaagataatcccatatatgccgttagtgcgcgtcctttcccactaatcaactcacaaatctgcattttagatcgcttgctcgatgcaggctaggaacggcacgcacgcacgcacgcacggcctcgtcacatcagctcccctgttccccctcgtcaaaaagctcgcctactcacttgcctcattgcctgccaagtaataaacgaggagtctagcttaatcgagaaaaagtaattaggtacgcgatcgaggctgctggtaacatgcaagccagatttctacacacgcatcgctttcgcttgttaggtaaagctccgagatgagtatccaaagtgccccataagcatcccattagccaattaaggtcaagaactgttactagtaactctcgttgggggtgggggctactcgccatcgctgatgaatttgtgtggtgatgctaaccttggatcgtgcgggtggtgggtggccacttccgtttttccaaatttccagtggcgtcaccacgttcgcgatatcgaggaagaaaaatatatgcattatgttcgtcgtctctgcgtcgctcgcaccaacctccactttctctgaagatcgttgcgccggaggtctggatcgagcagcactgcgacagagcaagacatggacacatggttgatgattggtgtcgcggcgtttgtcaccacagaagaaatccttctttttttccattagctcggtgaaaatgttgggccagtttggtttggtgtcctaccaaaatcttggtagtatcaaagtttaggcaacttttggcactatcaaatttgggtggataaattttgtactatctaagaactggtgttggtaaaatttggcaccaatccaaacatatagaagcactattcaaaattaccaatgaattggtagggcataatttggcaccaaaccaaacaagcccgttgtcgtgcgtgcatttgcgcgcgcgtgtggttgagagagaggtcggttgctagatgggcacagtctgtttcgtgttgctgaatgctgtaattaggtcggttttgtctgcatcggttttagcctgtagcagttaaattggccgtcagttcaggctttcagttcagcattttgttgacaatatggcggttgataggtcagatggtcggttgacgtcggtgtaagcagcgaacagagtaccagacacgtgaaatctctgcacgcccggtggatgtgtgtttagccttttccttcgtagcactagtagtactagctagaggccggaagtatgtggacttacatggtggctgtattatttttggcacgttgcatagcattgccattgttaaaccatataacaatattgtgaatggataaaatctgttcacaccatatacttcctccacttataaattatttggtgcttagaacaaggattgaagaaactttttaaaactataacaattcactatatataagattaactttataaattttaataaacttatgatactatgatagtattttacaagcgaatcttacctatattgttccttttgtttttaaattaagtaactgagaaaatattgatggttaactttttaaaaagcttaaacaagtatagtcttaaacataaaatatttatggccggaaggagtagcctatttaagaggaagaaatttaacacgaaattagtttaacccaccaattatgctgttaatggattttgtcttgtcttttttaaagaaaacaaaaaaaaactgtcaggtttctctttccactctccataaattttggattgattcatttttttttctgtacgctacacatgtacactcacgaacgagtgtgctctcccattaacataagctcagaaagatgaaaaacaatgcacaatctttgatatcactaacattcttttaatatcacacttcatattttctccattttgtttttcttaagaaaattataatttttttttcataaatggatgctctaattttcagattgccatcatatttgcctagttgctttcatattattggattcaagtgagaataaaaaaaaacactaggctcttagggcacctctaattttgctgcgagacatgcgatgagttcgattcatgcaagcaaaacacaatttcggctcaatctctgcatcatagtgatcgatttgtgagattcacgcacgtaaagaaaataacggtccccctacgtctgcctcccgctgcagcacaaccggatggagaatatttatattggcttgtgttcaacttcatttttgaagttgatttttcactggcagtctggcacacatcattcgactcttacggtgtgctctgtttgatcttcttttcttttttgcaaatgcttgattggcctcacattggatctgctcttagaattaaggaatcagtcccgttaaaggctgaaaaattatccaaaatgccgtttatgtgctttcggtataattcatcaatgataaaatcagcgaactcagactatgggtgggcttcggtttcttcggttttctaaaaattcggttctcaacaaaaccaagcggaattgtttgtaacaaaaacataaactgagccaaattaacataacttactcggttcggtttgtcagtttattgagtaagctgaaaaaatgtactccctccatcctaaaatataacaacctaataccggatgggacgtatcctagtactacgagtagatagggggcatgttcaaaatttatagtattagaatacatttcatccggtattaggttgttattttgtattacggagggagtgcgtacttgttctaccatgccgtaggctgaagtcctgcaagtagcgtagcaacatattgggccacgttggtagtcagatgggctgcataggctatgggctgtaggggttagtgagagatggatggtattaatggattttttttccattggtcaaaggcctggacattgtgtttttcacgtaggggaatgggatcatagaaattgatcggtttgtacgaattttttggttgttagagaagagaaaccgatggaaaagccaaagaccgatatataggaaaaataaaaggttttcggtgattttatgtccaccccttcctcagacacccccccaaccccaccgaaggaggaaccgactaccgatatttcggttcgattcggcctttggtttttcctcgttaggctaggggcgaagctagaacgaaatgagggagggtgcctcttacttaatttactttactttaaatcaagtttaagttgatgcgggtgtctaagtttacaataagagaggtgtacacatgataaaaatatgtgaagtatagcttaaaaaaatttctggaacccctccatactctacctccgcccctgcgtcaggccgaaataggtccaatctgagcctcaactcctattcggcccttgtgtccacacagatccagacatgtcacagtgattaaaaggcccatggtgatggcccagtagccgttatcacaacaatccttcccggcttcccgtaccgtcacggatgtcattgctaacctcgatcaccccgtgtctaattcaatttcaagcgaaattacccgtcctcttttactatcaaacaaacgaatccgtatgtataaaaaccagctaatagtctaatacaacctgcagtacgtgtagacgacgaccttatacgtatcatagaattaatactaccgtacgtatcatagaattaatactaccgtatacatggccacggtgtagctagggcgcgcgtgctgctgccgctgccactattcctggtccatttgcatcagcgggggcacaggcggacgcatggcggcggggtggtgctcgccgctgtacgtggccgacctctccatgttgatggctgccatctgcacgcccagcgggctcgcgccgctcagcgccgccacggcgtcgatcttgggcgggcacgacatgctccgcgagtgcgccgtggcggtggaggcctcccgcggaagcggcaccagcacggcgcgcccgtcctcgttgcgggcgccgtggaacacgaaccggtcgtcctccacgtcgtagaagttggccgtccgcacctcctgcgccagcgcgcagctccagcagaagagccacttggcgcagtcgctcaccgccgcgcggcacgcgtgcccctgtccgccggcgccgcactcgcacccgcacccgcagccggaggccgggagcttgtaccgcttccgcatctgcgtccgccagaagccgccgtagaggaagccgcagaggcccaggagcacgcccacggagacgacggtgtcgcggatgtcgtcgtcgtggacgttgagcgccgtcacgctgaagatgaggaacggcgcgacgcagagcaggatgaaggtgaaggcgtgcacgtacatgtttccgaacccgagccgctccatgttccacccgaacacgcagaacgtgcacgtcgccgacagcgcgcacaccgtcccgtcgtcgcagcagtcgaacagcccgccgctccactccgggctgctcaccaccacgcgccggttgtatatcttgatctccacctcacggtcgttctccgccggccggtttccgccgccggcctgcgccgccgctgactcctcgtcggaatcctcgtgctgcttccgtcccagcgggccgtacgccgcgtagaggccggcgatgacggggcagccggtgccaaggccgtagccgatgttgagagcccagtccggccgttccttgcgcgcgtagctccagaagagagcgcagcagaagtactgcgccaagcaggtggcgtgaagcagcaccaccacgacgagcatgtgcgcgcggtcgtgcggccgcggcgcgccgtccttgcagtacaccttgcggatctcctcgcggtcggcgccggcgccggggcgccaccggaggagcagcacgaggtggtggaagatcttggggtgctggtacaggcacatgatggtgaagagcgcgttgaggatctggttgatcacctccgtccacttcttccgctgctcgtcgtcggggatggcggagtcgagcatgccggtcatgagcatgaacagcatcagcagcccggcggcgacgaacgccagccagatgatcatggcgaagttctcgggcttcctgcaccagctcaccgcgtagctccacagcttcccccacttgatcttcctcacgaacggcacgcggaaccgcctccgcggccgccggcgaccgccgccggagtccacctcctcgtcatcccccgacgccgcctggccctggccccggtggcggaggcggccgacgaaggttgaccggaggaaccagtccctggacgggtgggcgcggaggaagtccaagaaccgccgcttgcgcacgctccggctcagcgcgcccgtctccaccgtcgggatgtagatgggtatgaagtccatcagccgcattgtcgacgacggcgcgccgggctcgccggcgacctcgacgatctcatgcccctcgccgccgtccgggaccatatctgctcccggctcttgttccagacagcagcgcgcgcttggagacttcagaacagcatgtggtttgcgcgcgctaagaactagcgcctgcaactgcaaagagtttggatacgtggcagtttcttcgggtcagtagagaagtcagaagagtgcaaaaaatgtcaacacagtgcagcacaaccagaatgaccaaatctgtgctcgtctattctgactgaccattgctttgacggacttttgaaacaggattaattaatactcccttcgtctctaaaattttacgtcgttaacttttttttaaaatatatttaactgttcgtcttatttaaaaaatttaagtaatttttatttttttctatcatttgattcattgttaaagtatttatatatacatatagttttacatatttcacaaaagtttttaataagacgaacaacaaacatattttaaaaaattaatagtgttaaatatttagaggtggagggagtactactcgtacttacgtctgccacaaggtcaaacatggttgacctacttgtttaatggctaggtgtaataaatttgattatctaaaaggagtagtaattctatgaccagaaaggcacaaattctctcttttttacttagggcttctttgattgattggaaaaatggaggggaaaaaagtaagaacaggaatcctataggaactagtacagttcaaccattaaaaactcataggaaagacatagaaatatttcttgtgaccatgatttaaatagaattctaagaaaattaacatccaccttaaacttattttttttactatgcgtacgatagaaacgaagcacgattggaagatatgttttactttttcttgaccctagattgtatggattaaaaccatctggtggtcctttggaacgaagggttttcacatgatttttgtgggattaatgatcctttggatctgccactgttcacgtagaaggaattgctcaaacgaattatggagggatattatagcattaccatgaaaacgcatgaattcaccgcaacctctagctagcataggatagaagctaaatcatatgttcaagacaaccctctgttccaaacaaccagccctataaaattcctttgtttccatgttgatcctatcatagtcctacatttcctctattgatgtgtgtgtttttatcctgtatttcgaattagccctcaaaattttatttactgttgatttaatacttaacattcccatgttttttctatacaccatcaaataatcattcatatagtttcctgcgtttctttaataatatgttttgcatacgcgtgtctattcatatatctttattttaacatgttttctattcaggcatttctccagtaaggtgtttcaaatattagtttatagtgtctaggtatttcatccagagctattgataactcttatgttattctttccgagtattatgcacaaatatatttgttaaatgtaacatctaggcttgtattggtcttgcaaaatattttgctctaaaatatggggttcattaaaataaattataatagagtgaattgtaaaatttggagttctgtatcttggatgctaaacaaaccgagttttgttttttaagttcactctaagacaaatatcgagaggaaccaaaagttgatcgcacaaaactatgtggtgagatagttaagccataggtgcatgacttcacttaatagggtttaaattctggtgtttctgaatattaccacacgttggtgtattttcaaataaaatttatcgttggtccatgttttttttaacgtaatgggcgcatacgcggttttgtgcgtgtaatccatgtaattggaagagaagaagttgaccccactgattgctccaatgtattgaagagggttgtgcggtttgtctgtgatcgtgagataaccagatgtttcatctgcaacacctttgtggaatgtggatgcaaggaccatgactagaaatcattgtgggtcaatctagaaacggatatgatgcaaaacgattctcgattgctgagatggtagtggtactgtgttgggtgcacctcagtaaattggattttatttctgcataggaccacggcgaaacatactacgtggaaaccgggcagatcacagtgcgtagtggcagtaatgttctgaacaatacgctactgctacaggaaacataggagcctctagtttactcgactcatcaagaattcaagattcaagaggcatccaaggcatgttcttttggttatgattccaaaaaagagaaaaaaaaaactctgaagagtctgaaccatctagaagaaagcacaaagactactactaccaactagtaaaagctaaacacaacttggtttgggttgtcagccatgttacttgtagcaaatgtcaccatatgcaaggatttttccctcctgtggtgggcggctgaatttacaagtactggtactttgtttaacaaacattgggcgtcactatcaacatggtgctgagccaacgatgtgtaggactccaaacaaaatgtagcgagaaaagaacgtcaaaggaaaagaggaaagctgaacccaacagcggaagcactcagcacggctccacggaatgccaagaaaaatctaacactgctaagtgctaacggggtcgctgttccaaacaggtttcgtttggaaacagttacgatcagatttcagttaccaaatcaaaatgacggttttatctactaaaagatagtagcagtagtacagtggttgcaaaatcaaaccaccgccgtgcctaggcctcgcgtactactgaaagcgctgcttctgttcaggcgatgatcggtttgatgatcaatcgcaagaacaaatggggacgattaacattgccgttagaaaaaaaagagtagaaatggagaaaaggctagcatgcagaaaatcgtaacaagaacagagtaaccaatccatgagatacaaaggttgagagcgaattcgagaactaaaggagatatgaataagatagaacaaattgcagagcgcatagtatagcagtatagcacgtacctgagctccacgccgacccatctcctccaaagctgcatctccatgaccagcctgaagaattccactggtatgcaagttcttccttcttttccctccaagaatccaactgtccaaggcctccacacctctactgcctcttgatctttgcctagctacctcacaagagcaggcaagcggttgaagaggttgtggatgctggaagggaacagatgggtgtgggcacggttaaattccctggttttccgaggttatttcgatttattgaccaaaaggagtcttctttttttcgtgttcagaggggaagctgggactgggaggagaagaggacgctgctcgtcaggaagtcagagaaggcgggtggggtagattttagacaagagcaatcaggtttggggctttgaggctttgagcatcggtcgcggaacggccttgatttttccagggtcatcgatcgaacggtccgaggacgattggatcaggtcgtcaagcgcgagatggcgatacctgataagaatggactgtagtccctacctgatagacgccatgagatgatgagaaactccaaagtttgctgcgagagggtgaaaccgaggtgcgatatagtgatgcacgggcgacgggaaactattctattctaaaccccgagggtagggatgaaaacgatacggaaacgaaacggacagaaaccatctttattattttcgttttcatatttattttttcagaatcgaaaaccccggacacgaaaacagaatcaaatattatcgaaattaaaaacggagcgaaaatgaaccggtgcgaatacagtaacgaaaatttatcggaataaataaaaccccttaaactaagctttacactgtaaagtcaaatccttaagtgtcaacagtgaataatttatcataaaacacagttatatcatgcccagttattaaaacttaatagtacatcacaaaacaaaatctataaaataaatgatccgtgtttaagagataaatacttttgataaataaatacagccaaacaccatggaggcaaaaacggcgagaggtggtggggatggcacgagatggcagcccggcggagacacggcaacgtgagatctggatgcgccgctccgccacccaactcgcagagtcgtggtctctctcgtcctctaagtgtacatatatctctcttctctctaagtctctagggttagggtagtctggtaggtaccacgaattcggttgggctggagaagaaatatggactattgtattctattggcctttgtaattttggaaattccaacaaactattcggaaagtttctgatcgtttccgagctccaacggaaactgctattatcatattcaattccgttttcgagaaaatattttcgaattcgattccgttttcgagaaattccgactagctgattctgtttccgaaaacaggctcggaatccggaattgtttccgtaccctttttatccctactatgatagatatcacttattgtttgcatgtcactcaaatagttttgaatatttttttttaaaaaaaaacttgagaagtgcataatgtgatatactccaaaaacatgtaacttaaaattcaacttctacatgttacaagaatcataccttaactatcgttaagacatgtataaattgaattctaagttacatgtttgtggagtgatatatcacatgttaatatatctttttaatcttttaaaaaatttataactatttagatgtaataaaataacgagggaacagcaaagcaaatcagcgggtctcaccgcggctgccattatcaagcagagcggtgggccgccgaaagttgaaatgccgatcaggcaatttgatggccatatatatgcccactgccttgagctcgtagttgctgaggcagtggcttgcaccagcatggaagcacgtagtacagcgtgagctccgggggtatcgcgtggccagcgaaaacgacgcgcgggcgcgcgccggttgcagcacacggcacgcgggctcgcttcgttacaaccacgtcacaatccgatccgaccattttttttcatatatcgatcgtggctgtccggttcaccgttcacacctcctcgcttcatcagagttcagataaccggcccatttgtcgatgtcacacgatgtaaattaaaattaaccagctgttgttttgttgttgttgttgttgcgtgttctacatcaacggtacggacaggcagaaatgactccaaacattgacgcgtagatcatcttgtttttctcgttctaatgatatataggaaacatattatatgacatcacagaaccgaacaaggggagattgggagaatgatactgttgatacctttactgtatctcgtacactgaaagagtgcacgaaacatgccctggtcttcctttcgaccaaaggccaacccaacagagcctcaagtcatggcacggaaaaaggaccaaagaagttggaattttttaaatttttaatatttacataaatattatatcggtgaaaaaatttataaaaattgaccctggcgccccagtggaaccagatgtatcatgtttaaattctactactatttctttacatgacataattctccttgtttctgtgtatataatgtttctatgaccaagactacgatagaccaatatcaatttcgtacactaatacgacgaaaaagttacaacataaactcttacttaaaatatgaaattgcaaaacaaccaacttcaatacaatttttaaaatattattaacaagttttaccaataaataattttttaagtgttatcaacagagcttcaatacaattttgctagtattttttttatctcggccccttgccgcccacagatgaaaaaaaaactagccaaatactttttttggcactgaataattgcatttcactccttgcaacaccagtagtctaccacgttagcttgccgcccaagtgaagggcggaagggtctatttttgtaaatatttttgttgatataatatttctgtaaatattttttaaaaaattaaaaatgaaaaaaaaagaagaccacaaagcaatagcactactagtctactactggtgttgtgaaatcaaacagtagctttgccttctatgggggacggaccgggtctttttctcttccttctttcaactgttttttttttctttgtcgtcacactcagttgatcaatgatcgttcactatagtgatgaaaatagttgaaaaaggtctcaaccattttaataatcgtattttataaaaaaacaaaatcaaatatggtaaagtcagaagcgaaaacgatattagaaatatcggaaaactggaaacataccatacagacggaaacatatcggtattgatcggaagccaataataaatatcaaaaatattgaactgtaaaatcgtatatttaacttttcactatataatatgatgaaataaattcaaagttacgttaagttataatttgtctcttttaaccttacccaaagttagagatttagctgagaagttgatagatctctaaactatggatcaaataaagaaatagactataaatattaattaccataatataaaaaacaattattgccataagaatgtggtaaaagtcgagaacagtcggtatgaaaagaaaattccaatttcatattttttaccatttcccttctcgtttctatcggcaaccattttcacgttgctcggttggtaaaaatggaaacgaagcgtcggtcaatcgaaacttttcgtgacaatattcagttattcacccctactcactagcacgtgaatataacatggctgtgcaacaactcgaaagatggatgggcgggtggctattgctactccatcaatttcacaatgtaagtcattctaacatttctcatatttatattgatgttaatgaatccagatagatatatatgtctagattcatgaacatcaatatgaatgtgggaaatgctaaaatgacttacaatctgaaacgaaggaagtacttgctaagggtactgatcgccgctgctctcaaacccgtcgaactgagctgcccggcccgcggctagtgcacagtccacccatggtttggttccattatttggacgacacaatggggagtgacctttagtcctttacaccattatgcttcggaaaaagtccacttagactcccttaattatttaccggatctaattcgtgacccttaactagaaaaccgggtaagacgactccccgaattagtgaaaccagtgcaatttgacttctccggcggtattggagggtggttttgctgacgtggcgctgatgtggtggtgctaacccggtcttcatgccacgtggcgcttacgtggcattagagttaaaaaatatatatatgggactcatatgtcattcaacacaaaattattgtgggacccactgacacgtggggcccacatgtcatccttcatcatttcttcctcctccctctctctcccttctctttttttctccccattctctctttcccttccagatcagcggtggaggcggccaggggccagagtggcgacggcggcgcgcggacgagggctagagcggtgacggcggcgtgcaggcgacgaccgtgccaccgcctgccccgtctccaagccggcccgccgccgctcccactccaccccctctaatgcggcgcccggtccgacccgtgcagccgacgacgtgggcggggcgttcgggatgggcgcagttaggggctccctcttccactttctcaagggcacctacaactcccccaacagcgagtgcttcgttggcggcgcgcaggccgtgcggatgaacgcggcgggtgggtgacagctttgcggtgtggggcgacctcttctccgccttcaactgcaccatggttttcatgcactagaaggaggatctgtggaactctatcatcgccggcgccgccactagcggcttcctctccatgcaccatcgagggcgccgggcttatgcttaaccgcgtcctcgcctctccccgtcgatgaccccaacctcgccgccgccatggccccccggccgtgtcacgccctgaagttcccctccttgctttaaaatttgttaaataaatcgtccgaagaaattgtttaaattaacctagagatgaatccctaaattaataaatgcaactaataatcagaatcggcatgtggaatttttcttggattctacatgtcaaaatatgctaacaggatttagtggaatttttcagagctcaataaataattttaaccaattaaaaacattaaaccacaataaataatccctggaaaatccttttttttttcttttctcttctttttcttcctttttcctctctttttcctcttgttgggccgtcggcccacttcctcccgcgcccttcctccttcctgggccggcccaatccctccctcctctctccgggtcaccgacaggtggggcccacctgtcggccccttcttccacctccagccggcggtggcaaccgccgccgaaaccgccacgccaccgccgctttccccgctcctcccgcgcccactccgcgccccacgcccctccccacgtcgccacccacgtcccgccgtttcccgccctcgcgcgcacccgagaaggggcaggattcgattcgaatcctctccccactctctctccccacctccctcacgtcggcgagaaatccggccgcctcccggcctcgtccgcccctcccgagcccatataaaccatccccgcattctcctcctccttttttctttttccatcggccgctcccgagctctccaccgcgcccgcaccgtgcgcccactcgccaccgccgtctccaccgtttcggccgcctctagcagccgctagggccgccgccgcaccacgccgccgccgtcgtcgggctcgcgcggccgaggtccgccttgtccacccctcgtccgtcgcaatccgtcgccagagatcgctgtccacctcacgccggtgagcaccactaccgccaccttcggccatggtttccgcccgccgtgtaccacctctctccctctaatccctcccatcttgttccctaggaggtctcggagctcgtccgcccatcgtcgccgttccccggtcgctcgccgtcgccgttcgccgtcgtcttcccccacgccggccaactcgcggtgaggcactcctcccctcttttccccttcctctccctcctagcgccgagccgggccgagccgccgcttcggccgtgcaccgtcgccttcggccgccgccgccgcctcctgcgccgccggttgccatcgccggcgaccgcatgctgccgccactagccatggctagccggccggctttggagccgagccgcgcccggcggccgcttctcccgccaccgcccgatcggctcggggccgatctgggccgtcggtcccgtggaccggcggtggaccacccgcgtggtgccggtccacgatggaccggccccttgagccgctaccgagtggggcccgcatgtcgacgcacccctgatgacgtcagccctgggatgctttattgcgcaataaaatccattaaggccttttcttttatagtaaaaacacatttaatcttctaaaattcatatctaattcatccgagctccgattaagtccattcaagtctcagtaaattcataaaaatgcgtagaatccattaaaaatggttttgtttcctgtttcagtagacttatagtgtgttttgcttgtgttctttgtttgtcgcgtagatttcggccgtttcgtcgatccgcggttcctcgaagacgttgctatggtctcatcagtgcgagagcaaggcaagttatgcattacgattgatcatattgtacccaatttacaaatgtctcgcatttctattaaatattgcattgttttacaatatcatgtgggatgggtcctactactcagccatatcttgtttaccttatgccattgataacttgggtattaaaatgcttagatgttggtttagggaatgcttagccatgcttagttcaactagtacacaatgggggaatcacattaatgtatagactttgattattggcaatagctttggattagtgccaccgcaagggtgttagttaattaaaatacactacatggtgggctgtgggtgcatggttttactagtcgtgcccatggcgattaaggaccggtttgcgggatgccctgaaagaatttatcgtacttaccacaagccagcgtgggcaacggctgggcttgtagtgtagctttcttctagccgatgtacccaggcgagggtgggcgtgatggagttgggtcggccggggtgtccggttgatcggcttccggattcaccgtggcacgaaaggggggctgcccgttgcctgctggggacgggggcgaaccctaaggtgtggtgcgattggttaaaggggttatgcgaagggtcctgtcacggcctctttccggtatgtcgtggtggcatgtcagcgcacggtaacgtgtcgtggggctgtatcttgtgggtacagttgcacacctctgatcagagtaaaactattcgaatagccgtgcccacggttatggacggtcgaccagattcactgtgattagtctcaccctagttagctaatgaactggtgtagttcaggtggttggttgggcctgttgcaacgtgttgtagcgttggacagtgattggttaatattgattaattactaccctgttttactgctttcaactactgttgttaaatgctagctttatgcaaatgagcctttagcctcccttggatatatcctgcatcatacctcctcttccggtatgatttgctgagtacagtgggtagtactcagtcttgctctcttttccctcacaccagagttgaagttcttttcagttgaagatgtctcgaagaagtttgtttcgtcactgccatcaaggatgcctgtggagtgaaatcgccccgctgcaggaatcaagtcttcaggcttaactcgcttttatctttttctgctgcatttgtaatcttttatatttttgtaagacgtggatctgtatgtcaacaattgtcgtttgtgtatcctggctggtcctggacaagggtttaatgcacattcagcttagaaattttggttcgtgaatttctgggcatgacaggccgccgccgccgccgatttggaagggagagagagaatggggagaaaaaagagagaagggagagagagggaggagaaagaaaggatggagaaatgatgaaatgtgggccagtgggtcccacaataattttgggttgaatgacagatgagtcccatagatatttgttttaactctaatgccacgtaagcgccacgtggcatgaaaaccgggttagcaccgccacatcagcgccacgtcagcaaaaccactctccaataccgccggaggagtcaaatttgactggtttcactaattcgaggagtcgtcttacccggttttctagttaagggtcacgaattagattcggtgaacaattaagagagtctaagtggacttttgctcggtccgcgaagcccatatgagggaggaacacaccgcactacgagcgcaccatgcgtccacccgtcttgactaaacaaaacaagcaggcaccagcaccacctgcccggctagaaacgtctgccgattttgtccaagcggagaggagccgagctagacttgcaatctcacgcgtcgttccacacttccgcttttgttctgcccgcacagattgaccgcttaccacccccatcgatccatagctgtagctgtctccccggccatcccgggcaattaacgaatccgacgactaattagcacggcatgatgccatgctggctgagagcaagctcaagagtatagttaactgacagcttcaaattatctatagttagcttaatagtcaattaatacaatagttacctataaatatatattacacaattaatatgtggttctacctatcatacatacttagagtctgtattgcagctggctataaatctgtatcccactgctattctcttttcttttttatcttattcaaatgtagcctctgctattatactgctctgatacatactttctgcttgtggttcagcgaatcgtaggcgagccggcgaaacgagcggcgactcgaccgacccgctgccttggccttgagttttcgctgtcccttttaccattttccctcggtggcaggctgcctgagaccatgccgtgcctgctgctccgacgactgggacgcgagagttggcacggatcaatgcattgacgtccagaaatgattccagtctagacgcagtacataggtgtggcgtgtagaacgagccgttggcgagtagtattagctgcagagaggtattagcgagtagtatgtacgattcgcttccaaatgaaacgaatcttacgaaaatacacggggtgtgtcctcagcgtttggtattggaataagttcattttagctctctggtttgcattgtcctggtttcagaagttgggagattagttgtatcttgtttttttttttacaagggtaggtgtgagtccttgtcggctttctggctggataattattgtaattttatctcacatctcgccggtgttgacactatggctgagtaatatacctccctttccccggaaaaaaaagaatgaaaatcagactaagtgaccaatgaagccacctaaagttgaaccgattttgctaaacatcacacgggtgattttttcgttgatatttgacagatttttgcccctacaattatgcgccgagatcagtacacgattctgcgtcgatgttgtcgtgaggtggagatgagacctcgtaggtcccacgtttgccgctgatcacgattcacaagaaatttacatcctagctacgtgtaaatatcctatatagctaaaataaaatataaaattacagtcctatttaactaaaattgtatatgtaaattcagttgatattaattacaatcctatttaactaaattcacatttgtaaattcagttgatttaacatgtaagtgcactgtaattttgataaaaatattgtgtaagtaaatatgtacttattattttctttaaaatataaaattacagtcctatataactaaaattacatttgtaaatttagttgatttgacatgtaagtgcactttaattttgataaaaataatgtgtaagtaaatatgtacttattattttctttaaaatataaaattacattcttatataactaaaattacatatgtaaatttagttgatatgacatgtaagtgcactgtattttttattaaaatattgtgtaagtaaatttgcattagttattttatttcaaatataaaattacagtcctatataactaaaattacatatgtaaatttagttgatatgacatgtaagtacactgtaattttgataaaaatgtcgtgtaagtaaatttgtattagttattttattttctagtatgttggacgtaaatccaagggaagaaaaaatctgggtgaacccgagtgatgcataggcggtccctgaacaaagtgaacttaattcttttgctatttcgcagggacaggctcatcttaattgggcctgcacattgttgagccggatgctaatggacggcccagcttataaacccaagaaacgggccaccaattttgctcgtgtgctgagctgaaaggcacacatgaattctcacatgaggcagcacagatgatcgcggtattgctgattgctaatccctccttgctttccggggagctgtctcggccatctccaatccaccggaattgagggggggaaaccaccaagggtcgccgcaaccgccacggcgcgtggcgagaggaacacgacgccgtccatcgtttagccccgcgggcacgcgcgtcctcgcgctcgactgcatgtatgaagccaaaacaactctcgccacttgtgccaaaaagccctgcgtcctacaggcacttagcccttgttttcctcctgcttctaggcacaaaagcacgaaatctgccgtcacctgagttcatccgtgcatactgcccctgatgcaactccccctgaccccctctataaattggctaagctactgctagtcgatagtacattgagcttgcgatcgacgtatatatatgttggtgtacttgtgcagggtggagaagcagggcacgtgagcggccatccagtgtagcttcgctgcgcgtccatggcggcgaacgcgcgtgatctggagtttggatggtcgttcatgtgtccgtcttctccaccgagcactggcatatccaagaccgagacagcgagactccgagagacattggtcgagcgagcgcgcgcggcaccgtatcctgcactgtctatgagttgacaacacagacagctgtgctttgactgtctatattcataacactgatctactacaagaaagtgtcatatcttatagtactatgttagtttattttaagatactgttacattttattttaaattggtatatctcatattaggttgatttattttgagagacgattacatcctattctggttggtttattttaggatagtactgtaataatatatcaatatctcatattaaattaatttattttaagactgttacataaaatttttgattgatttatttaagtacagagcgggtaagtaaacgtacacgttgccatgtcgttcacgtttgcaaccaaggcaacaactcgctacatggatcagctcatcagcccacggaaaagcggtgctgccgcgtgggctgctcgtgtagtaggcccagcccatgagtccaggaatcacccagccgtctctctccaaagcctctcaactccatcagcgaggcatccaccagcgagccctttcctaatccgacccgcgccgccgccacctcttcctccgctgcccaagagcgatggccgcctcccccgccgccggggccgcggccgccaccgtctcgtcgttcgtctcgccgtcgtccttctcctccgtcaagtaatccagtcatctccgcgcgcgcgcgcgctcgcgcttcgttgattgattcgttgtgctgtggttctcactctgtttgggcgtgattgtttacagggcatcgaagcccgaccgcctccgtccggcgaggagggcggcggccgtcaacgtccgatgcgtcagcagccctccggccaccgaaacttgtaccgtcctctccctttccctctccctctccctcctagcaactcatttatggttgctcccaaactgctcactgccgcttagtaggtttttgctatagtagttatcgttggaggtgtgcaatcgaatgcaatgagctcgatattgcctccgctgatgctatcacacgcagtttaggaacaaccagaaagttactgatactatcactagcactgtggtagtaagtttactgaaagattcagctttcgttttgaagctttcaagacgaaagtaccacgaaatgccaatatggccaagctgcaagctggctatctgtttcctgaggtttgttttgttccaaccatttcctctctcttctttccctccctgtcttcgttgatgctgttttattgaaattgcatgttgatattggttctttgccaactgtggagcagattgccaggagaagggcagctcacctgctgaagtttcctgatgcgaagattataagccttgggatcggtgacactacagagcccattccagacgtcataactaatgccatggcaaaggtacatcgttgctcttaatataataaacaccggttgtgtagcttcagatgatttatgttgcagtttgtcaagatcgtagttaaatttcttattgaaaaaagaagttcggcattgcatggcacacagttcttatggttcaatgtaaatgattttgtcagacaggctgtgcatcttcctaggagtaaactaagaaatcatcatcttcttttcttttttcttttttttttgcattttttgtattatagttattttttttcaaataaacattgatctttgatgggtctatttgtaaatgcagagagcacatgctttatccacagttgatggttatagtggttatggagctgaacagggtgaaaaggtatgcttatcactttactagcattttctgccaatacatcagcattcagttgacaagattgtacataactattttgcttcatatatgattttaaagtttgtgtagaatattctagaataattggagcaggatagatctttgtgctaatccatgaggttcagtaacaccttatggcatctgctggtgtggttcatcgaattagttttttgaactattaacttcttgcactaatagctgtcacaaagatcaaacatctgccacattttcttgatgagtggattcttacttttcttttactgccccattcaaatatattagtcttgacattgcatacatttcatatagcttcactatcataagccgtttatgttcatcattctgaaattatacattaattttctgcacagaaactaagggcagctattgctgcaacctactatgcggatcttggtattgaagaaacagatatattcgtctctgatggtgcaaaatgtgacatttctcgtctgcaggttctgaaataatcctatcctccctttcagtttatcattcatgctataatgtcccttacatttcttccaattttcaggtcctttttggatctaatgtgaagattgcagttcaagatccatcatatcctgtatgaaaattcttcacttgatgttaacccttcctagtgcatgattccattcttaaactgatgtttatggtcatgtgctccttttttttcatttctatcatactgcttcttattactaactattactttcacacttgtctgatgtgtattccaacatgtgttccatttttataggcctatgttgattcaagtgttatcatggggcaaactggtttatatcaggaggatgttcagaagtatggaaatattgagtacatgaaatgcagtcctgaaaatgggtttttccctgatctgtcaagtgttccacgaacagatataatcttcttttgttcacccaacaatcctactggtgctgctgcatctcgggaccaattaaccaaattagtcaaatttgcaaaggacaatggatccattatagtttatgattctgcttatgccatgtacatatcagatgacagcccaaaatctatctttgaaattcctggagcaaaggaggtaggctttgggatttaagcccttcctaccacatatggaaatttatggattttctgcaaatacttaaatccacacctgtcatgtgttttcttgtgtgtaggttgccattgaaacagcatctttctccaaatatgctggattcactggtgtgcgtttgggttggactgtggttcctaaggagctccttttctcagatgggcatcctgttgctaaagatttcaaccgcatagtctgcacttgcttcaatggtgcatcaaacatttctcaagccggtggtttaggttgtctatctccagagggtctaaaggtagcgtttcagagtttctgaaaatcttcatgtggctcttttggcaatgcttcatttcatctctttgttcctatgcaggccatgagtgacgttgtcggcttctacaaggaaaatactaaaattattgttgacacatttacatcacttggattcaacgtctacggtgccaagaatgctccatatgtgtgggtgcacttccctggccgtaattcttgggatgtcttcgccgaaattcttgagaaggcacatgtggttactactcctggtagcggatttgggcccggtggtgaaggcttcgtaagggtcagtgcatttgggcacagagagaacattattgaagctgcgagaagactgaagcagctgtacaaatgagcagtgatccggcctttatattctcaacctcttggggagccatatcaaataaaaccaagcagagttcgaagacaaaatttactctgtcgggctatcagtagatgttagaattgaaacctaatactttataggcagttgttctgttccgctcggtatttatccattcagagccattttacattctgaacttctcttgttgtttagccctgatgcacctgagtgaatcgcaagcttatttatctccttttgctaagttcgtttctactactctgcttaatttgctgctgccgtataaggctcagtgatatctccctggatgcattgaaacgttaggcacacttgagtcactggttgcaacaaaattaagagtagagaacattgctcagaccaattcagttttctactctcgtacaggaagaaggtacagtaatactctattttaccagactaccagagtaccagtgtagaaagtactatcaaatatgaattgtactcagctacctagatgcgagagaactcattggagaatgaactctattaaccgaaatctatgagcatggagagaagcaaatcgttgacttcttcaggtcaagaacttacacgatcttaatttactgaccatgtgatatgattcccccgaaatatcacatttcccagatctacagctgcaatagtgttcatacggcacgcgccaaaatctaccgagtttcacagtatcagtatcaggatgcagaaattcacagtatcactatcagcatgcagaaattctgccgaagaaatcccacagtgcacttaagtacttaacaaagctccacaacgacatatcatttactcttcgtatgtactttgatagagaaatactcttcgtatctatcaaactgtaaaactcactagaaaatagctaaatcttcagggggacgcttctgtgcaaactgcaaagacaagtacttatatgacatcagaaaaggttgcttacaacaagaattagaggcaggttaacatgacacaattgtgaatattgtcaacaacagtcatttttcgtaatggtgggatgctgacttgaataacagttacaagaatacatcacaaacaagtttacatcaatccacgaataaagatgacagctgacgaattgatgtattgcatcaggccctcttcaatgatttaaacaaacaatggataacgatgaacgctaggacgaaacaggaatatagaaactgaaaagtaggttacagccaagcacactttggagagctccgagcctctcatatgtgacaaactggatatcttgctacctaactaccactaatagcgagcagagaggccgacaaccatatccttctgaaggtaccaataagcacatgaaaaattcttttgagtaagacataaccaaaacacttgtgacaaaagaaaaatctaaaccattcattgaatatcaccggaagaatactattcatcgaataagaaatatgaaattctatagaaatatatagtggtgatcaattaacagagttcccttcactaactcaatttctagaagtgtaagacataaattatgccagcaataaacataccattgttctcctaaaatttcacattacaacatagatatccatcctttgatgtttgatcccaacccaaactcccttgtcaacccaagtctacaaaaagaacacctttttaagattttagacccaaaaggatctacaatgaacgaaataacgcgtggcattgtactctaattatcacttatcacgtagaagtagtcttcatggccttgaatgctgggtggagcaaccctagttcatccttgacatcaagtgggttgctagtctcattcctgatcctcttcaccttcctgctgccaagcgacttgtgtgtaaacccatacatttgcaagatctgattatccccaaaattgaaagcacgctccatctgcttgaggcacctctccacagggtaatccccaaacttcccacacggcttgcatccgacaaagtgagtgaccagtggccaccggtgatcaccaagtcctggatggtaattctcaagcatttcctcatacctatcaaccaagataccccaatatccatggaggtaatacccattctcaaggtacaccttgtcaccccatttctcacgccctgtagcaaggatgtataccatggccgactgatcatcagcctcaaacaccggccgatccttcaagtacttggtcaaaaccttcccggcctcaatacggacagggccctttggtcccattggtgcccatgtatcaaggaaatcaagcgaccattggcagttgcgcagcaagaagctgcctgtgttgaggccaatccagttcttgtcgtcgtagaccatctcatcccagccgtgcatgatgaggttgtaggggccgtaccgctcccatggcagctcgaatgccatgtcggagaacatggcgtcggagtccatccaccagaggaactcgatctccgggtgcgcgaggagcagcgcgcggaggagcgggagcttggcccagaatccggccatctcggcgtcgagcagcgccatgttgtagaagatctcgaggccgtggacgcggcagtagtccatcttgttcttgatggacttgaggaggtagtggtcgccgacggggttctcgcacggcttgggcgaggagcccgtgacgagcagcacccgcggcttgacgtcgttgacgaagggcggcgtctccgggtggcggcggtgccacgcggcccgctgctcgtcccagtcggagatcttggggcccagcgtgtagggcgggtcccggagcgtcctcggcggcgggtccggctcgtcgtcccgctgggccgcgcgcccggaggaggacgacgagccgccgcccctcgacagcgcgtcgtggtgctccgccagcgcgcggtgcgggtgcgagatgaagcggtggcggagctcgatgaggtcctgctgcggcgtgccgaacttgcccgccccgacggtgccgcggagcacgacgacggtgagcagcaggcacactacggtgagcttcgcgttcctcgcgaaccgctggatctcccgcatccgccgctcccccaccacccgctccgccacccacattttgcccccctccctctcctgccccttcctccgatccccccacaccgatcaaacaaacaaataaacaaacaaaccctcctcccccaacccaaaagcagcaaatcaaaaatgcaggcaaggaatcaccggtataccgcgtctacggcgacggcggcggcgtcggcggcgcggagtggtggtggtggtggtggtggtggaggaagaagccgaggaggttttgaaccgcggagttggaggcgaattaataagagaaagggcgaggcggagtggtgccgcgacccgcgagcgagcgaagcgcgcacgttggcctcggagagcggattgcggtggctgtctgagcgatcgggaggcggaatggaaggggaaatctggggagacgcgaaatcggaatcgaaatcgaatcaaccccctgacccggccgctgcaaggaggaggaaggaggaggagaaggagaaggccgaaggggaaggtggtggtggtaaaaggggaggggaatagccagccaacgcgttgcgagatgcgatgcttctactcctttccccgctgtcgcccggtaatttgacttgatcctctcgcgtgggcgtatgaccggtggggccacccgcgtggggccctacgggttttgtatggtaattttctctggcttttttttttgctcggttataaacggggggttaattaaccagtggcggccagttgtaaccagcccaggggcaagcgacgtcgcgaggcgattgcacatgacgcggtgacttttctccaacgtttaaacacgcgtccccatcaacggccgtgccaccacctcgctcaaacgaagcgggctgttcctccgcgtcgctgacgggtgggccattgcgtcgacactgacccacctgtcagtggcgtggtactagtttcggcgatgtagctgccggaggtggagttgtcggttgaggagctaatcactggtgtgtgatggcgatggccataacgatgttttttttaaagattaaagtggacatcagggtatgtaagccaaattactcctctagaagcccagttattatgccttttccttttgtttagtttgggttggtaagtagcgccaaacagtagtagttttatttttcaaccatgtaacatcacattggaccaggtttctctcaaatataatgtactacgcatgtttacggttccgagatggccttccgtttcgggctatgacggaataacgtttttcgtgaaatccgatgaaaaaccggtagatttcgaccaaatttcgtaaacaaatatttgaatacaaatacctagagtttaccgataaacttatgaaaatcggtcggctttggtgaaattccgagtgaaatcatcgaaatttcaattggtaattagaaaaagaggtaactgaaattgttttccttttttaattcgttattctttttttcctactataaattccagtaaatacacggaacacattaattttttcaaaaaattatatcccaataggttctacgaatatcatactatttataagatttttttccttttctatcattcaaataggtctcagatggtttttaccttcgagcctcgtcgaaatctcaaaattttgtgaaatgcaaccggttttcgtcaaaattgttaacctgggtactacgtgtactactgtactagtagtacagagatatggaacgcctcgaaaacagacttcaacaacagagacgctagaacgaggggcaagtaaccagtaatcactgccacttgaacgaattccgcacagggagatgcagatccgatctgacccagagaactcggtgttggagcgagagacagacagctgagagtgcgtgaattagcatgttcacgcactgatggatctctgagctgattccaaatttcagcactggtcttcttcatggacccttgatcagcggcgattattgtaaagcggccagtaccggtcgccgtcaacacgggaagctggggccagtgccgcccaagaacttgcacgtatctgaagccaaaccaattaataaattaagcaatcaaccaaactaaacccatttatttgccggccacttgctagaccacggcgtcgcctgcatccgcagcggtaaaactacacaaaaaagtgccggtggatccggcgctctccacttcactaccacctcggacctttccagccgatcgatacgatacctcccgtgctcctcctgctcgccaaatgctttcgcctgcgtgcgccgtatcattcatcgcgagcaccaaattaagcgcggcagaggcagcgccaacgcgtgtgccttttttttccgcggacgagccggccgtggaatcggcaagcaaacatgggcgcgtcgcgttgatacttgacctccttttgccgtttccttttggctcgagcttcctcaggacgacgggaaaaaggctgcacattagcatgttcttgatggttgtgagtactatagggaacatgggcagaaacaggggtcgtgcaggcaacgcacggcagcagaaggcagcggtcgaacgagagtgagacgtgcagccacgaccggaccaggcaccacccaatcaacgagcggcggcgacgagttcgcacatggacaagtagctcgccgggtgggtacatagggcggaaactctccatacacaagtcggccaggacgactagtactgtatcatggctataatactgcatcatggctaaagcgtatatataaaactacggaacatgttaaccatttttcaacggataaaaaattggagtatatatagtctactgtggatgtatgtgtatcagtgtatacagtacccataccgaaatgaaaaagccatgaagaaaaatgaaaaaaagaaagtatgtttttccccatcggaccatacaagcaaaacgccaaattggactagtgactacagatctttgctgaaaacaaataaagattcttaacgaacactaaagatatactaaaccaagcacggtggtgaccacaaggaacacatatatttgttatcaaatgcgctaaatgggccctagtggtctagcagatcaaagccaatgtagcgagcacaaagcatttgggaccacggccctacgctgctcaacattgcacgaccaactgacctggaatcatcgaaaccacaccccactaaaaaatccccagtagaggaaaacaaatctatctcgtcttgatcagttgagctcccgacttcacgtcaaaaatgagtgcagatgatctcagccagctccctatcaacacaagagaatatgctgttaaatcactaggagttatcattagcatagtgcagactagcacagccacaaggtacacgccagctaaaacgaacctatccagcataataccaggcagagggaccaaccaactgggctatcagcttaaggaaaatgtcacatgagaaaatattcatggatttatttttggacgaattgttattgaaagcaacaaggccattcaatgcagatgtatatgacagagaagccgtgaattcagtgatcaccgcaaaatacacaagtctgaacccatactgctaatcagcaatagcgtccacacatgacaaatggaccaaaatgtaacaaaaatatacatttttactgcaagaattgctacttcagtagttttaggaaaatgtaaaagattgggcttcgtgcagtcagttctcactttctggaacatcctatcaccaaagtctatcatcatggtgcattagatgaaactaatcgcatttctgatacaatattttacagttcacagcgaacaaacagtaaacagaggaaacgcacaaacatgcaaatttgtccttgttcatgaattgctaagcctacattaagacttgaggaaaatacacagagtgattattagcgttcaacggagaaaacaaatggagatgttccgcacctgtaggccattacaaagcttactctgtgggggcaaataaaccataaacattatcatgaccttgtggttgttgtagggtataactgaacccatgcaaattcctccttgtagctgacattttgatcgcatgatcctttacatgtgtacacaacaattgttgcccaatcaagagagtctggctcatttttcacaccaaagtaataaagcagctgtggcattatctgcagtacaaattagtgtgatatgtaagcatgtctgtgtgaaaaagggggtgggtgcctgtttgccccttactgtcgtacaccttagggatggtaggtcttcactgactaagtagaagaaataatttgaactgatgggatttgaaagaaaataccaaactcaacataaaggctgcagaagtatttgataatctcatttacagtactattttgagcagggtatgaattcccactaagccatggtttattggataccagcacaagccagtaataacaaagagccaccgtcgggtatatcttggctcagtctggcctggtatcacaactggttaacaggcagttgagctagcagccattaacttttgggtcttgactctaaaattgatgcattggtgtctgacaatatgcacagtatgtacccagcgaataattcatacagcaaagatataagggcaagatatttggcatgagggagtagggtttgcaaatttattacttgtgttgcaatgtgcaactggatataagtgtatacccactatatttcagtgacggaatttgccccagaaaaaaaaaagaccaacctgaaattcatagcatagtggacctctacagtagctacatgatgggatatcggcatttgatggacaaccagccgataacgcccatagaggtttggcattctcttctcgacagtatctgcataatgtaagcaagtttattcaaattcctgtaacataatattttgagaaaaaaatatgcaagggcactaaaaaaggctaattagaacattaactacacaatgctactattctgaccaggcaaaggctgatcagtataccaccaaatataaaaaagaatccaagcaactgatgcaatctcacctcaatacttgctttggtgctcttgagacccgctcttgaaaagacgcccagcatttgttgtcagcatcagcctacaaaaataatagtggttaacaaaaacaaagatgaacagataagaaaaaaaaaagaaaagagagagagagaggatgtagggttaaaacctcaaattgatccatccatgactgcatcatatcatctggtttaccaggtctttgcatcaccaaggactttgagttactctcatcacaactgtcagaattgaaagcaccctcatagtcgattgcaatctcatattctggccaagatttgctagcaggaactgcaaagagatgaaactataaaaaagagatatgattcaatgtttacaagcttatcaagcactcaaatacaatcaccttttcctacagcaggaaaaatagagcttgaagcttcagaagaactgattaactgtaggcaatcactcttatggccagagcgccagtgcagtgtctgacaaatagaaaaaaaatagttcaacaaagcatgctttagggcatatatagattaacgattagcgggaaaatgacttataaatacctgatgcttctcagagcagtagcgtgctttcttgcagctactacagagtttatcacctttccatgtaccgcaccaatggcagacaggagctgacagcatagttgaataattgaaagaaatctatattatttgactatcaattaaaacaaagagttcaaccatgaaaaatggccacctattaataaaagttaaaacagtttaacaaggctgaaaaagaaaaatgttgcctatgaaagcatgtcacacaagaaaattcagcaactagcataacacataaatcttacacagggtctctgcaaatgaacagaatgattatctagaccaaaaaaaagctgggaaaaacagaagaaatgcttattaactttagaacataatgtaggcagtacctgacatgctgagaaaagtttttgcaacagtagaaaaaataatgaggatgaagctttaagaatttatcacatggaagattcgatcaagtcacaagtcattatcaatcagatatttatacaacagctagataagtgaggaccgatgatccatacacataatgcaggaaacacatcattttgatacttagaatcattaagaaaaagaccaaacatggaaaggaatgccaagctgccatccaaagaagaaaagaaaactacctcctggacatagtggcttgtcagaatcattgtgctttggtggttcacttgagtagaaggcattactacggggaagctggcaccggaaaaccttcacgctgtaacccacagcagtcaaaatcagcacaacaataggctattagcaaaacagctgtagaacttcaattcaccttctacacggattgccttgtctatgtttccactggtcgtgctggtctcggagtaagcatgccattgacgggcacatgaacatgaacaaagtgcggtgaaatgatgccgcattgtcctcaatcggtgcatatatctgcacaaaattgaatcctatttgtgattgatttcacacccaaacaacaagtagtcagctacaactgcactatccacaaagcaaacacctggaggacgaactgcaggggctcgccgcagaagccgcagcaacgcgagttccccgatggcaagttcacaggatccaaccacgcctgcaatacagcaattcacacaaaccacaacatcaacacctggtcgacgaattgtaccaatttagcgagtgaagttcatcaaaaacgcgtgcaatccgtacgcaccgggatgcctccggccttgctagggaacaggtggcggaggaggaggcccgggtgcttcggcttctccagaaaaccaagcgtcacctccgcctcttcctcctcctcctcatcgtcgtcctcgtagcccgcgccgccgcctccgccgccgccgctggcgggtggggatcggtggggcagttcgggctcgtcgtcttcctcatccagcgaggtgatggtgagaccacgaagcttctcggcgttggactccatcctcggcggcggcgtgggggcaaaaatgcgtgcgtgttcggcgactcgcacttgagagtcgagacggggaaatggtttgggcgaaaaaccctagctagcctcctctcgggaatctcagccgtccgatgcggggctacaaaacgaaaccgaccgacagacaccgaccgagcaaaacctttcgccgcgcagccacctaaacccctctcctcccccttcctctcccgccgccgccgcgcgcgcgagccggcggccatggcgcccgcggccgccaccatccgcgacctgctcacctccttcagccccgccgcggacttcctcgccctctcctctggcgacggccgcatcaaggcatggagctcgaagctttccgcccgcccatcctccaaaccgccgggagctgcacggttactgatgatgccatgggctaactcgatcctttccacctccattgcaggtatgggacgccgtgcgcggccaccttcagaccgagttcgctgatatcccgccggtggaggtgggcggcggcgcgcgcgcccccggggcgaagcgcggtcacctcgcactggactacacctgcatgaagtgggtacagctatcgagcaaggtgagcattgcccccgaattttcgagcttctacggttggtgttgtggtaccgtgtgcctatcgtgtgctcgtgtttttgccttgcagaagaagcggaaggcagggagttcgctgctggtgcttggcactggcagtggagatgtccttgcacttgatgtcgccgcagggcagtggaagtggagggtcactgattgccaccctgggtacgtttggtgcttccatgggaactcgtggcttcatttgttaaactatactccaagctcattgaacccttgattgtcgctttgaacatgtttggaatttctatgttaatctccgcaagctttagctagatgtgttctcttacattggagtgcttgtttttatgtgttcaggggtgtcacagctgtagcctactcgaagcatgggcgaagtttgtacaccggaggcactgatggcatggtctgtaggatcaatgcctcagatggctctgttgtagagaaatttaaatcttcatcaaaagcaatttctgcattagctgtgtcaccaggtatgcccatgaaattacgccgctggttttatgtctggtttcacccccactgaactccccatttgctaactatgcatacactactttacttcctatgttgtgtgcccgttggtcatct

SEQ ID NO: 59579 - DNA, 50324 bp, Oryza sativa
ataagagatatgtcaattttgtgaacaatgttactatcactttgtcgtatgaagaaatgatcaaaataaaagttttagatcttgatgagttattcaactttattgttgatgactttttcagttcatatcatttagtatttttaaatgttgtttgaagttgtcatattttcaaattcaaattcaaatggttcaaaaaatattatatagaaaaatgaccaaaataaaagttatagatcttgatgagttatacaactttgttgctgatgactttgttgctgatgactttttcagttgaagtcgttcattgatctaaaattctatttgaatttttcaaactttgaattttaaatttcaaattatttaaatagagtcagatggagaaatgaccaaaataaaaattttgcacctcaatgagttctacaactttggttttggtgacttttcgatttgaaatcatttaataaccccaatttttgttcgaagttgtcaaattttgaaaattcaaaatttgaatctttcaaatgaatttatttgtacagaaccgatacaatagttttagatctcgatgagttatacaattttgttgtttatgatttttgcatttgacacacaacaatcggcctaaaattaaatttaatgttctcatctgtgacgggctttatttttgacagatctcaatgagttctacaactttatttttgacagctttttcatttgagtttttttagtattataaaattcaattcaaaattcattttttctagaagtctgatttgcttcctcttcataataatacttgctaaatataatatttgatccaattaactcggttttgctaatataatatgtgaaatatgtgaatggatatgaaatatatgatcaaaatggatgttatgtgaatgtggttgtgttaaatatattgatggttgtgtatatgaatgaatgtatatgaatgggggatgttggggtgtgacatcctagcctagggcttaataggattaatagaatactcataccaagaatttacaactattttttcggaagccgatctccaaagaactttgatgttaagcgtgttagccctggagcaatttcgggatgggtgaccaaccgaaaagttcatcccgggtgcacatgagtggggataaaaaagtcacccaccggaaagttcttctcgggtgcacatgagtgaggataaaaaagattggcatgggagaggcgggatggcatggcatggctagccaaaaaatgaaatttattttttttttattatactcatctgtgacgggcattaacttatgcctgattgagatgagagtcatctgtgacgagctatagttaatacccgtcacagataagggtcatctgtgacgaacgctagttgtggcccgattgagataggtcatctgtgacgggctatagtttgattagtcgtctgggtcaaagctatcggtgacgggctttaattagggcacgattaagatagattcatccgtgacggccgtttgcccgattgagataactcttcacagctgtgacttctaacctgtgacggacgccatgcccgattgagatggggcttacggtccgattgagatgatggtatccgttctagtgacactttgttgccatatcgagtgactactagtgcttctgattctcatccgagaacctctgtatttgggatgcacctagtgcttctcacttactacctccatcctaaaatgtttgacgccgttggcttttttaaaaatgtttgaccgttcgtcttattcaaaaaatttaagtaattgttaattctttttctatcatttgatttattgttaaatatacttttatgtatacatatagttttgcacatattacaaaaggtttttaataaaatgaacggtcaaacatgtttaaaaaagtcaacggtgtcaaacatttagggaatgagggagtatttcctaaaggcctctcaatctcacccgaatacctctcattttagtggcactctaacttactcaagataattctggcatctgctgcaactacatgtgctacactcagaaatttaatctaagagcagtcttatgcatgtaaaacctctcgagtaatcttcgttccatccgcgtcgtttgatctttcttgcttccgcgtagtgaaaagtttggtgcgtgtgtattgttaatgcgatgttattgttctgtaatatatcttattaagtacttaaatcctatgttgaattgattgaatgtcaattttctgcaattatgcacatctgttctgaaattagaaaccctcgctctttttgcttctttggatgatgactcttgtgaaatttctgttattttgaaaaaaaaattgtggaatgaccttcagaaaaatcaaaaatgggaaatttaggtcattgccaccaaatggttttaccatttgactagtttgggagctcaattgtctctgttacgatagtcaggagattggttaattggtcgcttggaattctacattgtcatattctcaacatttttgagaatattctacattggtcgcttgaactcgcatcacaagtggatccatatcctcgaaattcttgaataacaacagagttgcaaaaaaactgagttgtactgttcagaaaacatcatacagctaatcaaaatccacgcaaatttgttgcaaaagcaatgagtttcttgcggacttgtgattgatgttgttcagacttatgaacccaaattgcacgacaaaacaattgaaaactgcagaggggagtcgtagaaactacactcagaagtttcctatccccatcggtagcattttttacagaacagaatggatccaccatgtaggcggttgaaagcacctactgctggtaagcatgaggctgtgtacttctcaccatatgttggcaatcaatcaggtcatgttgaccttccgatcctacttgatccacaatgaatcttgttcttgtcacctgtttcctgaatacatctcattcccaccctcgtgtacctctctttttttttcaaggcattctgattttctttagataattctggcgtctccaccaactatatatagatgcagataacaatttgatatttgtatatgtggatgcttgcacaacttctcgattaattaatctttgctacctcctcagccatgttttttgcttccttttttagaccctgacgaatagttagacagtggaaagtttggtgggtccattgtgaagttgagggtctatcaattaattgccagatttttctaatatccgagtgtttgagagaataggaaaagagaagattgagaatatgcgtaaaaagaaggaggtgaatcattagcgcatgattatttgagtattatttattttaaattttaaaaatggattaatatgcttttttttaaagcaacttacctatagaatttttttttttaaaaaaaacacaccgtttattagttcgggaagcgtgcacgcggagaacaagagaaatcttctctctttcacctgctgctgaacgcagattagtcgatatagctggtatcttactatgcatcagatctgatacccatcgatatcggctgatacccatcagtatccgatcttgtacctatcggacatcggtaccagacccgataccctcgttaccagctcaacgatgtcacctcctccagtaccagctccttgttgtcgcccgcacgtgtagcattgcgtgccttaggctacaaaattccaatcaataccgccggcgaagaggaccatcaggactgcctcgaacaaggccttgatcatctgcccctccaactgcctcctccgatggaggtgctaattccaactgcaaaatcgtgaaacatagatgtgtaggcgtgtagctgccatcttgttcaactccgatggacactgtgctgtccttcagcgtgcagctgctccattacggagcttgagataccgcggagttttagttggttatttcctatttcaatctttacataattttttgaatttttttctaacaaaatctaacatttaaaatcttttagtttctactgaaagttttcatagaatatttttagaaaaattcccatgcaaaaatctaacttcctattaaaggtttattcccttttttaacagagcatctatgttttatcttaaagttacataaaaccctactccatgtaccaaaaaaataaatatatgatatgatgtaactcattctactactacgaatctggacaactctctgtccagatactactagaataagtagtactaaaatatgtcacattttgctttaggtgtgttttttgtgcgacaaaggaagaaggtattataaccggtgatacataacctcggatattatggttttaaagtttcataaaaccccacatctatgtatgttgagcaggaatttacttaagattctaaatcttagagtgtatatgaaatttttaattattaagttcttgataaggttgatagtttaactcttcactactttgaaaaaaaaatgtttcaaacatgttgcaattaatcaatatttgaatacgtgtggttttataaaatagttagaccataaaacctatggttaaataccataagccataataactatagttttctgtaactttaatcataaaactagaaaaaagacctggccgtgtgttgcaatgggaaaataaacattacaatattaagcgatgcttgctttactggcttcgcctcctaccagctgctttacccaaaggctacctttcggtgcaaggtacgccatgatgtaatccatatgacaactttctgctcttctctcacccgcacacttaaataagaattggcattgatgaccaccataataccagtttaataaaaaactaatagtaatatcataagtgtcgatttaattctgaaagctagtttgattagcttaatttcgtgaaggggatggacacacatatatacatgtctacgtgtacatgcaagtgttcctagcaatatatctgtgtagtcccaggcttgattaattcaatattattttattttggtggtgataatgctggtttagttagctacagagtgacacattcatagcactcgcagactcagtcttatttctttctcaactcccatatctctttcttccctgtcccatagccacacatagccttctctcgatctctcccgtgtaggatctaacaacaagaattaagccaaccagaaggggtgaatggttgtagaacccaaaaaccataacttttatcggaattaaaagttactctcgaatttgatatagatcgatctgaccggagtatatgcgtcggtttgaccgctcgaagaccttcgatctgaccggtataattgctccggcctaaccacccgatgcgtcgaagtcgctagtcgtcgccgccggtctgaccgccgtagtgttgtaggtctgactgcgccgatgtcgtcgttctgaccgccagtgtcccatcggttggaccaccactcccatgcaagatctctcaaagtagattgaaacttcattacttctattcgtgtttataaagtacaacaacaacattcctgacaaaaatctcgactaaactcgaaaccctaacttttctcacaactcaactatctaaaaatcgatatcagaaggcgtcaccctccctctctatttatacccaaggtaagcacaaaaggcacaaaccaaccttatacaagaagttctaatcccctagaaaaacattcccaaataagaaacaaacttaacaaattccaattgtaccaaatttggactccctccaaatttaaactcctcatcccatatgcacacaatatctctgtcgtttgccatatgaaatattcatcaatcacgtgcattgatctctagcctaagtatcccacaagatatcccgatcgtccggacgtcatcatatcccaagttgactcccgatccatctccagcaatgctcttccaaggcatcaagactcacctacacatgaatcaaacacaaaaccatatccgagcacaagttctctgcaatttagtcacaaaacatgaatgtttagagctccatcataataatggtactagggatttgaactctaaaagctatagttttgtgataactttgatattaaagttgtagttctatgataacttcaatattaaatatgcagttttatgatacttaactttaaatctatagttttgtgataaatatggtgctaaatttgtagttttatgatacaacaccttaaatcaaaatacatgtagttttgtgaaatttactcaactatatgtaatacacattctttatcagttttactctctaactaggaaggtggcccgcgcgtatgcgcgggcacatatattattgaaaggttagatttttattgtttgttaaaaaaattatcacatagattaagggcaaactaaagttcggatactgttattttgtaataatttaagggttctattttttttgttaaggtatcttaaaagtccattcgcaagcttttgagtgggagatggattaagtacttacgacttttgaatcatatttttttcttaagtaaatagattaaatcgtctcgtgaaggtgcatgatatagtaagaaagggagggaagcatattcatggagaaaaagaagaaagggaaaaataaaaaaaaagggtggggaagcgtaggtacccacgtacataggtgcgtaccaaaggtggagaggtgggacctcgtagtatttagtttgttctaagatcaatttaatctaatggtttataatattggacccatcgattcaagtgaaaatcaagtagtagatactttgctttttttcttagaatttctaatattttctctaatttattagagcaccacgtgacatcttgagggcattttaagaaattttagtggacttaccacatgtaattagaatattaagatgtaatatatatatgtatgggatgtatgttcatattcgttttagcttcgtccatgtttatatacatgtagagaaaaattaaatatgttgctagcaagccattagttgtttaattaatagcaattaattttgacacctatttacaattggtcatagttgttctaacagatttatcttacgactttgattatgcgttgatcaccaatttacttatcaccatgactcgcatgaaaaaaatatgtactttaggggataggacaactgaaattgatgaattatctgatttatgtgatagctatttgagattataaacgaatgaattgacttctgaaaagttaaaaagttgtttaagaaaagcaccatttagtaacttggaaagcgtggagcgtgcaaacgaaaattcaaaagatggaatcagggaaaaaatagggccttaaactcccttgtaacactcttatcctagtaagagttctgttgatattcgttaatattgtgctcacaattataacataatgatttctttcaactgtacgaacaaataatacaaaatgcaaatacaacataacacaatacattataattattatttaatcaactctcgatttcagcttaaacagagttaagtgttccacggtacttaattcttctctcgctacatcacatctttaattttattttcatgctattaacaacaacggtagcgctgcagcggtcgtgatcacccaagatgcctcaaacacgacactctgtcacatgtgcgaaaggcaaaggtgcagatgtgcattgtggagtgggccaaaaagagaactttagacattattaacaatagatccgatgatttaaataatgggtccaccggttttagtgtaaatgtaacttagttaatatatatgtatatatatatatatatatattaaattgttaatttaatgggtacacaacattatggtgatggtgtagattttattttaaaacactgaattatttgagaataataatccaaagtaataaaaaatagatccgatgatttaaataatgggtctatctgtttaagtacatgtatatattagttaatatagatcttaaattgtttatttgataggtacacaatataatattgtgtaagctttattttaaaatagtgcattatatgaaaataatagtatttagtaaattatcttacattattgattttagagctaattaacatataatatggtgtaaattttattttcaaagtctgcatagctaatttagttacctgtgtttataaagagttatatgatggtattttctttttttctaaattattattatttaaacaaatatatatcagattgtataaatggaaaaaagaagaaaaaaaggaaaaaaatggagggaggcgtacgaacaacaggtccacatgcatgtacgtacgtgacctatacctatgcacgcgggagaaaaaggagaggtgggacccatattatttggtttgttttaagatcaattttatctaacggtgtataatattggacccactaatttaagtgaaaatcaagggtagatgttttgcttttttcttagaatttctaggattttctctaatttattagagcgccacgtggcaacttgagagcgtttgtaggaagtttaatggacttttagtatataaagatagatagatagataaatagatgatagatagatagatagatagatagatagatagatagattgtcatccatgcatgcatgcaagcaatatcataggctcaaattatccttgatgcatgtgcatgacacaagaaacggtgttgcatgttaatcgatattaattcaaatcgcttgtgagggtgtattggtatcgatacacaaatcatatactccctccttatcaaaatctaagacctatttatttttcaatcaataccaaaaagcaattaacttaattaccaataccatgtggcaaaatcaatgaatatacaaccaataagtattagaataactttttatttccgatcaacaatttaatttagcacacaataactataaataggatttagaattttaaaaaaaccaaagaatgaaatgggtgtcagattttataaggagggagtactgtatatgctgataatgcatgtgtatggaggggagtatggtggttcctagctgctgccttgatccccgacttccacctcgcgtccaaccacctcgatcggtcggcgcctccgcatcagcggttggtcggccaggtggaggagctgcggcctgcgtaacctctctctcacctcctcctcagccaagattaatctctttttatctcccccttctctgcacggttagagcaagcttaatattataaccaactgctagctctaaattatctttggtcaatctaatagctcattcatataatagttatttttaagcattaatatatagtcccacatctcatacacacaacgtattagaatccgtgttacagttggctataaatctagcctgatttccttcgctccagccagcgtttctgctacagtacgtctctagctatgtcgtcgtctacaacctggccggtacttgtgacggcacctgcacctattttcattgatgcagtggatcatacggtagtattgattactatacccaaatacagtactattttaaggggtaataaaagtataaaacacatgattgtaggttttagtgaccgtcaaattacaggtggaaagatttttaccagtgaaaagaaataggtaatctccaaagcaggccctataatacaaactgtgcgcatcacatgctcatgtttcttcgcgtggtaactagagcctgccgacaaagcttgatagaattaattaataattttaatcaggatgtgcagagtcacattattaattactgggtcgtcacgagcctcttgtaggagtagtaacataggttttcatggcagcgtccaatgcgtgtgcaatattctttaccaaagctaattagcttaatttaacaattctttattttgcgcggatctagaggtcagaaaacaattaacccactgctggcggcaagacactcttcttccttgaaaaacaggcgccattggctgtgccatatacacaatctgaaacctgtaccactcccacagcaccacctcactccagggagatcatcagcagatgagcaaaaatggttgcaacaacagctattgtgggtgctaccacgggggtgatgaagcccctcctgtccaagctcaccaagctgctgggcgaagagtatgccaagctcaaaggcgtgcgcaagcagatcaagttcttgatagatgagttgagcaccatgagtgctgcactcgagatgctcgcggattcggaccagcagctcaacccagaaatgagggattggagggacaagctacgcgagctggcctatgacctggaagattgcatcgatgattttatgtctcgtgttgaccatgatggggaaaagatgggcttcaggaaattcttccgtaagttgaagaaactgaaggcgcgccatgagattgccaatgagatcgaagagctcaagatccgtgcgatcgaggcaagcgaaaggcacaagaggtataattttgaccaattagcacacaactctagcacttttggcattgatcctaggctgtcggcgttctatgaggaggttgataaacttgtgggcattgatggtcctaagaagcgtatcattgagctgctagctatggagatgaaagggtctctaaaagtggtctctattgttggttgtggaggtcttggtaagactactcttacaaaccaagtttatgacacaattcgaagccaattttcttgtgcagcttttgtgtcagtttcacaaaggcctgatataaagaagattctaaacgatattgctgaaggagtagggatctcttctcgtactccggttggtaatgatgaaaagaaactcattaatatactccgagagcatctcaagaataaaaggtaagcctagttatattatcaatgataatatatatgaatgcatgcgacttaatacccaataaaaagatttggtaactgtggaatgaaattacaaatactatttcttgatgcaaatgagatgtgtatatcttaattaggtaaacattaacaattttcttatctataggatattcgcaaacaaattaatggtgttttttaggtttcgaaatggtttaagatctagctttgactactatatctgttactatcgttcttaaatcatagtgaaattacattaggtcatgtttgtttcatcttatagattgtataaaatagcttgcagttatctgaaatttactcttgcatgaaacattagcacgtactccacgtcagccctcagcccactactttggtccagccatacactgtggtgatctgatttggctggaataccgctcagccaatgcacgaatcaaaaccaattctaggttagggaaaacgaccctctcgtgttgcccttagctcttttgaagcttgatgagtgttgactcaagtgcaatgacaaagtatgaggggtgtttcaatcggaccatatctctacagtacagctagggcacagtggtgggcttagcagctgccaacacagaatgccgctacaatgcatgtgctaacttgttcctcgccgtctaccacctctatgacatgtgggcccaatgtgtaagtaacattggggtctgcgtgaacttgcggttttgtgacaattttctccattatcattgcaacaaactgaaatatgtcactaatgttgtaacaatctgataattcagtgactaaatatgcgattctctgaaatttactcttgttacaatgaaggtgggaagcttctttaatttgtttgtttgctcggttactatttagtgattgtggcgatccaagaagtattaaataaatatattaatcctggttaccatctaggtctctgaactattatatttgagtctacaaatttattaatcttgcagacattgtccaaatattggtgatcatcttttgcttgagccatctctctatataatccatcacactcaaactcttccatttcaattctccagttcttgtcataatgatctgatttgttagcattttcttcgctaaccacagttaatattgccaacattttcaattattatcaacttcatggccttcaagaacaaattactaaatctatgtaaaaatcttgtgacagatactttgttgtgattgatgatttatgggatgcgaaagcatggaaaattatcgagcttgcattattaaacaataattgtggcagcagaataatcactacaacacgaagcgttacagttgcatcatgttgttcttctcaagttggttatatttatgagatgaagcctcttagtttcaatgaatccaaatggttatttttgaaaagaacatttgattatgaaaattcacattatcctcatccagaaaatattttggataagatattacgaaaatatggtggcctaccattggcaatcattactatatctagcttgttattagatcagcatgaaattgatgaatggcatagggtacttaatactattggttgtggacttgcaaatgatcctaatgcagagacaatgtcaaatatattatcactgagtttcttcaatctccctcactatctaaaaacttgcttcatgtacctgagtgtatttccagaagatcgtaagattaagaaacggcatttggttagcaaatggattgctgaaggattcattcatagacacataaaggtgcaacttttggaggggcttttaactatttgccactcttacaaatggtgcttaacgatttgccacaaggcccacatgtcatagacacatgagggcccacatatcatagacacggtgtggcaaatcgttaattgccatgtcacaagagtggcaaatagttaaatttcccacttttggaagccgggttttacgcgtaaaaccaactactaagatgcaacttttctctgagacccattccaacttgagaaaacaacagcagcaacaacaacaactcctcctgagaccgcacaacaaaaacgacggaagtcagccccgaccccataggccataggcgctcgatcgtatgctgcctcgatccggcctcgatcgatcggcgcctcagcagcagcagcagcagtagcagcagttggtcggcctcggccaggtggaggaggagctgcaggactggcctctttactcaggcaagaatcctctctttttttatctcctccttccctctctccgcacgattaatcgtcgtgagaattgagattagccagcgttctgctacttctcgagttaacgtcgtcgtccacagcctgatctagcagctcagcacggcagcacctgcttcttgcgcgggtaatcccccctaaggtgaaaaatggtcaataggtgctggttttaaataaattggcacatatgagccggtacagtagtgatgggactgttaatatatatgcatgcgtgggaatgccctatagaaaagtccggtaaccttggaatgaaattacaaaaacttctttatacaaatgagatgtatatatcttaggctatgtgggaggtgaggttgggaactcacctcccgcgcacgcaaaacggagcgacacatttttttttgaaaaatagattaatatgatttttttaaagcaacttttgtatagaaaccttttgcaaaaaaatgcaccgtttagcagtttaaaaagcgtgtgcgcggacgagggaggtgagttgggaaaggtaggggaagaacacagccataattgtgtaaacattaacaattttcctatatataggatattccctccagttgaaaataaacgatgttttgcaatttgaaatgatgtaaaatctagctttaactattatatatgttactatatattatttgcaaaccataatgaaattatattaagtcttgtttgtttcagcttatctctactattataaaaactgaagatgtttctgccataattttggtgcatcatccgtgtttgaatcggttttaattttatgtttcagttaaatcctttcctttttttcttatgccagagtgtccctcttatcagagacgtgcgcgaattaattgggcttgcaccttttcacgcgtctcttgccacaagcagcgatcgggcccacgcttgagtctgtattccacacgcgcctttgcgcgccgcctcgattgggcccgcaatgccctcgcacgtgcaatttttcgcatgcccaattgggcccgtgaagccatcatgcgcacaattttcccttgccgcgtgtccgattgagattgcgtcgtcctcgcccgtgatttaaaaattgaagatgttttttttcaaaactatggtacattatccgtatccgattcctgtcacgcgtaacaattgttgactctcgagcgaattgcgaaagacagtatatgtgatatgaataccaagcgaatgaaactcgcagagtctatgtggatatcacgtacatcgttgctcagatcatccgattctattcgtattacacgatacgattcttgggacatgttagcacgatttcaagtcagtctccacacatgctcgtacgtactaccagggataacgttacaataattcataagaatcagttttactttcaaaaagaacatgccaaatgaaataaagaatgatcgaaattgctgaatccgtccgtcatcaattcttgcctgacttaagataaagctagacaacaaatcgagctcatgtttgaaggcctcattatttggcttatgctttcctgtaagcgaaactttaaattttagaacttaattttaaactcgactttttggttttttatcgtactttattttacatcatttacttctgaatcgctaagaatatgtatataaaagatttgcatacaaatagtcttttgtttggtaataagtgatttggataagcacatgaataaacaaaacgatggtatgtgattatttatgcactgacatatatgtacaaattaaattggctctacccgttgcaaagcacgggcaccttttcttttctagtagattgtaaaaagtaagcttgcagattgcaacaatccacaagctggaaggaagtacattgtttcattgtagcaataatatggcatgtgtgtatcgttacaaccaatgaaggtgggaagctgctttgtctgtttccttagttactatttggtgattgttaccatccaagaagtattaaataaatatattaatcctggctactatctaggtctccaaactattatatttgagtatataaaattattaatcttacactcgttgtgtccaaatattagtaattatcttatgcttgagccatctctctgtccaatccatcgcactcaaatcatcatttttaattttcctgttcttatcataatgatttgatttgttagtattttcgtcttagctaactgtaattaattctgccaacattttcaattattatcaactgcgtggatttcaagaacgaattactaaatatatgtaaatatattgtgacagataccttgttgtgattgatgatttatgggatgcaaaagcatggaaaactatcgagcttgcattattaaacagtaactgtggcagcagagtaatcacgacaacacgaagcgttgcagtcgcatcatgctgctcttctcaagatggttatatttatgagatgaagcctcttagtttcgatgactccaaatggttatttttgaaaagagcatttggttatgaaaaatcacattatcctcatctggaagatgttctggataagatactaggaaaatgtggtggcctaccattggcaatcattactatatctagcttgttatcatatcagcatgctattgatgaatggcatagggtacttaatgatattggttatggacttgcaagggatccttatgcagagacaatgtcaaatatattatcgctgagtttcttcaatctccctcaccatctaaaaacttgcttcatgtacctaagtgtatttccagaagattataatattgacaaacgacgtttggttagtaaatggattgctgaaggattcattcaggatgaacaagggcgaagtgcatatagaactggtgagttgtattttaatgagctcatcaatagaagcctgattgaacctgttgatgtaaagtatggtcaggcaaaggcatgtcgagttcatgacatcattcttgactacatcaaatgcaaggctactgaagagaactttgtcacctcattaggatctacagtgcctggatgcactacagagtataaggttcggaggctgtcagtcatcaacagcaatgaagaagatgtcaacataccgacaagcctagatctgtctcaagtacgatcacttactatatttggaaatcgcatgcaaacttctgtatttgatttcaagtttcttcgtgtgttggacctagtatatagggacagaatgggtgacctttttgcaaatattgaaaaattgtttcatctgaagtacatgtgtatctcctcatatggagtggattatctcccagaaaaaattggagaactgaaatatttagaaacgctggacataagacaaaccaatgtggagatattgccatcaactatcacaaaccttcaacgactagctcgtctatttatcaatcaggacacgagattttcagatgaaacgactattggacaattgaagagcctggaagagctaaaagaatttgtagtgtctcagtctgaacaagtgacggccctccaggaagtcagtaagctaaccaagctaaggacattaaaattaacactgcagtcaccattgtcacttgatgattaccatagttgtgtgggaacattattgcaatctttatgcaacctttatgatttgtgcatcatggaccaatcttatgaaaattattgtcttacgttggattcatggcacattgcttctccttgtagccttcgtaagcttgtaatcaaactagtactcaccaaggtgccaaattggatgggtgtgcttggaaatattggagtactagttctaggtatcctgtgtatagcaccagatgatattgagatacttggagcaatacccagcttgctttttctcgagctacaaacttacggaggcaccaatggaaggatcatcatccatggaaacaacagattcataagtttgaaatatttctccttggttattcatgcttgtgggactgcattggagtttgaagcaggatcaatgccaaaggttgagcacctcaagcttcagtttcatctgcatgaattggaatgcctgaatggttcttctgactcaggcatccaacacctctctgctctcggcaaggttgaggtcaaaattatatgcaaaccctcttatgtcattgaattgaatggtttgaactatgatctgatggaacaaaagagtgattgcatcgtcagatgtgtagcaagaaccattaaaactgctgttgagacactccccaaccatcccactatcagtttcaaaacatatcatgtcgaggaatgtgaacattttgaaacagtaagttctccctcagaattgcaggcattaatattgttcactgtatcgcatatgcttgaccatccaaataaacaatttcgatgttattctgatgcacacttttatgtgccttgctttttttgacttctgttctagcgtatcaacaagaaagtaaaggcatgttctgactgagtgaccccaaaatcagaaaattgaagagaagcagacagcgcaagcacagcgggaccgtcatctaggaatcttatgtatggcaccagaagatattgagatccttggagcaatacccagcttggtttttctcaaactagaaactctcggaggcaccaatggaaggatcatcatccatggaaacaacagattcataagtttgaaatatttctccttggctatcggtgcctgtgggactgcactggagtttgaagaaggatcaatgccaaaggttgagcacctcaagcttgattttcgtctgcacgaattggaatgcctgaatggtgcttctgacttaggcatccaacacctctctgctctatgcaaggttgaggtcgaaattaattgcaattgcttcaagcacacgtccaatttcttcgatgactttgaattgaaatgtttgaactatgatctgatggaagaaacgagtgattgcatcgtcagatgtgttgcaataaccattaaatctgccgttgatacactccccaaccatccaactatcagtttccaaataaacatttcgaattggtaagttctccatcagaatggccggcattaatattgttcactttatcgcttatgcttgatcatcgaaatgaacaatttctaacttattctgatgcgcacttttatacacatttccttttccacttctctgttctattttatctagaaaatgaagacatggacagtgacggagtgacccaaaaatcagtaaattgaagagaagcagacagcacaagcacagcaggacagtatactcatcttcatttcctctacggtatcgccaacaagatgaaacaaattaatgaagatgagcaccggcgctgcctgggattagttcttacccagtgatccaggcgaagccgacagcaaggtctaaataactactggatgtttctacagctgggagtcatagctctgctgatgttgttgctggatatatatgttgcagtaatgtagtttcgttcttctttctttggacgaatctggtgtgcttgctgaaataatttagtgctgaggcgcatgctgttgtttcactgattctggacccaacagagattgtagtaattaagattattcaaacaaatattcttccgttaaaagttctatgagcttgtttctcactgtggtttgtttgtacaactcagtacacatttggttactggttagtctcatctaggtgatcaatgaattttacatgaaggttcatgtcattatcttgtttctagctatgaggacgctcatgctagggctatgttttgtctccaacctaggatggaagcctttgtgagatgacaaggttaaggaaaaagaaaccttttgtctaacaacgcgatgatttgaagccttcggttaagtttgatttgagcttgtgttgcttgtgactaaccgaaggcgttgagttggtgtgtggttgtgttggagagacatgtctcttggctttggatgtagtgtaggtgatggatgtgtcaaatttacactggaaggccaagcgatcctgcggatcgaactcgggagatcatgagcagcactggcctccgatcattctgttcccttctcttaattacctcactcttcttcctgttacctttccggctttccttcccttcttatgctcagaaaacatgttgttatcttgtgtgttatattcacaaaaatttgaaatgggaaatacagctcattgccacataatgagctgctactttttgtaaaaattgtttctataataatttttaagagtaagaactctcgtataagcgtacttgtactctctatttttcagacaataagctccaacaaccacatccgcatgcaaatattgtgttcactatacccatcagtctacaatgcgtgcatgtcattcaaaaaactccagtcgaccagtaaagcatcaagtgcttctcacttgtttcctaaatacctctcattcccacccgaatacctcgcgttctcatgggactcttttgagtttctaaagatggttctagaccaaatatagatgcacataaagatttaatttgtgggcactgctctaatgctcacacaactcctcgattaatctttattgtttctcttttatagaccaggatgagttttgtctggcagtgggaagtttgtaattgggtgtttgttttgagtgtgaagtttttgttcattaaccttgtgaggtcccatgttgaatggactgattgcgaatctttgcatttagtagcacaccagggaagggggtgctcaaatgggtttcttctctcttttttttttctgcttcttcagatgatgatgtgcttgtgaaaattttggtcttttgagaaaagtagagttggcataatcgccacaaatatcacaatggtagatatagctcactgccaccgaatgggctggttagttttgtagacatttgttttgctaccttctttaaactgaactctcgtgcaagcatattttgtactctgctttgtgaattactacgttacactacaaagattttttgggaaaacaatacatgtgcataaattatgtcaccaggataactggttaagggctgtattactagactcaaagaaatgtaacttctcaaatcccaaccattctcaaaacaatcagcgcacaagacctgaagaaagagaggaaatgggtgtcaacagtgagatgatttagtaagttcaaggagaagcaaatgatattcgagttcatggttaaaatagagctcaagaaccaaaaccagaattacttcaatttactttagaacaagcttcaacaatagagaaaataatgcgcattaccagtgagaaacaaattatcccattgttactgatattatcaaaactaaagtggatattacttagtacatccaccttgaccaccacagtagaacatgatatcctcaaatgggcgcctgataggcatttcttggattcaatgttcaaaaccatctgtgtttggatttaatgtgagatcaatcgtataagaaaatgtgaccaatccataagacccaaccgaggtcaaaattgcatgttgcgcacaatataattgtatccacagactagctaacatacataaactacagaacaaaactgcagaactacagtgctaaaagactggggaactggtcagataacaataccattggataaagtctagtgtcaaagatgtatggtacatagcacgtaacatggaaattcaaccagatttgccaaaaataacagcagaacattggatcatgcgtgtccctataaaactggactcaaaagggagaaatttcagtttataaggaacaatgtaattttatcacttctactgcccagaggcagggcctacaagaacaccctgcgcagatccttccttcatgctgccttcttcctgggtgtcactatctgctttccggattctgatcttgtacttgagctcaaactccgtgatttccttcttcttcttctccagtgcctcgttcatgcgagcaacaacttcctcgaggccctccttgttgcgttgcactgcaggcaagacctccttgatagtccgttcaaccagcactcccccaatcattctgtagcagcgcctcgaggggtcaagtggctcgattgcaccgatcacgagggagtgctcactgacttccatttccagctctgtgatcttggagtagagttgattcatttcagagcgcatgttggcatacatgtttgcaaccatttgctcgttgatgacttctttgtcagcaccacttggttgaccagccattttgcttggaatccactaaaacataaatagattacaaaagaggcctgcagagaaagagcagttagcttactaacaaaggtaggtatcatgaagttctgtgtaaacaaattcatgggcatattttaaaagatggctactgatggatatagtaattactccctctagtaataaagagctcttttaccttaaatataagaagctactttgatggctagaccacaatatgcagttatcatatatgaagaaaggttacaaaagcgtaattctatgaagtacttttaagaacaaaattagtgcatatgtcacttttttactggaggaagtaccaagcataaaagtaaggcaatatatagggaactttggtagtggaattccatttggagttacagatgaatatagatgactccatgtaccatgcaaaggcacgaagcaaaggaactgagacatttcataataacataataaccctcagtattcaaggcttttctgcatttccatctgccagggtacaactcattaactaaaccctatagtcccattatttctgtaccatccatcccatcactgacataaaactgttgacccaaatcccttatctagaaagggaattatttcggtagatcacaactcccctgatcccctcttaaccatcttgtgatccccacaaggcccatttaaaagttagtctgccttttaggacagcttgcccctattctggtagcacactgtccttgtaccattactctggcagatcggatagatcaaagcctacacaaggaaggtgcccacatagcgcataattgaagttatattgccaatgactccatcagctaaaaaaagctccatctattacagtttgctaactgtttcaggaatatttatatttccgaaaatgtggtgttagggatgcaatatggctggtcaaataatgcacatctaacacatctaccacgcaaggtgggttggaataactataaatttcaaactagcaaagacgtgtaaaatgatcatgtggaaatacatttgctcattctaaatgggatactgggattcttggacacgctgtccaacaaagggaacagcccactcaagtttgttaagcaatgagcatgccatcttaaggacaattactcagatgtgcaagtgcaataaccaatcaatatcagtatagcatgctgcatcctaatttgagattttgctgcctgaacttagcccaaggtaaatttgacttcacaacggagataaactgtaagcaactaattgctataaatacaagatagataatgcgagcttggaccaggcaccagctagaaggaacacaccagcttagaagggaatcacggtggtgaccacactaaggtaccaaacgcatccacctaaagacctcatttggaatgcatgaatattacaaggaaaaatgcgatatatatctgtatactacttaaaattttagtagtggtggtggtcgttctgccacaccacccttaccactaatatttgggtctcacaatctatactttgcaccaccacaaccgacctaacaaatgggtcccatttattagcccctactctccaatgatttttttccgtttcagtgctggctctcccaaaatttcaaaatcacctacttgttcactaaggaaaataataaaactactacttattagactaaatatgtgctcaatcgatttaataagttagaaactcaattctttttccgttgcaacgcacaggctcttggctagtatacatgtaacgcatgctaccatcgacaatcagacgaagaggatcaaaagaatatacagatcgccatgggctgatccaacttgggacttttgtggggggaacaaacaaagtgttaactgtattaaggttaaggctctgaaattaagagcttcttccagatctacagaagagaagctagggttaacacaagcaagcaagcaaattcgagggtgtgtgagatgaatcagaaaaagatgatgtggatgctcaccaggacgcaggaagaggacgcgacctgctccgcgagatgggagatcggcgcaggccgcagggagcggagacgagacggggaagattttcgacgcacaatgatcttggacgctaagattatttcccctctctctctctctatctatctctctgaaagaaagaaagaaactcacccttgctgtctcagcggatacgcctcttccggctgccgccgcggcgggcgaactccggtggacggtggtcggcagctgcgcggcggcgcgggcggtggtcggcagcggtcactgcccctccgccatgaatcggggggtctttgtcgaaccattttcgtttttagatttttttttttaatatttacagaaataatctatcgaccaaaaaaattgcagaaatagcccctgccgcccaaatggtgggcagcaagctgacgtggcagacggtgggtcgaccgcgccgtctgccgccgtcggccaaaattgcgagagggcggcaaggggctaattgcaattttggccgcccattcagagcttgcggccgtacttttcatctgggtcccgagggcggcaaaggacccagatgaaaaaagtacggccaaaagacttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctaggtcgtagaaacattatatggacttaaacaaggagaattatgtaacatgaagaaatagtagtacaatttgaacatgatacaactatttacattgcggttacatagatgatattagattcgaactaggagggaggtagtgcaatagttgaacacaacgacgatgtaataatgggacaaggaagcatgacagtagaaatttcaatatgctaagttgtccgataatagctaacccctacgtgaggatccctctcctctctcaaaccgcgctttagtaaccctgtattgctctggtagttcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggaatcatgtaatcaaaatattcttaccatgaaatcgtcgtcaagaatatttggacaaacaaagaaccttcgacccaatgttgtaagatttatggaacgaagaacctgacaacgatcaccacacctgcatcttggacgggcttcccatggagggagtgccgtaattagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgccgaatagagtagtgttacgaagaataaagcgattgcccatacggaatgaataagcatatgcagataataaaatacctcacgatcatagttagggcacctaaaaaagcgccttcctcgaatatcaggattcctcgaagtcattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgagggctcactcattaaggcgacttatataggcgcaaaaaatcgagtgatacccctgacatgtgaacgtggtggggtatggtgggtatgcctgattggcgccgaaagatacatgcatgatcagtgccgaaagttacattggtcgtatgcgccaaatggcgggcaaatactcgtatcacacgcaaataaaggaggctgcatcggtgcggcagaaagtagtcatgcatgcgccgaaaggtattgtgcatgcgccaaaaggtatcgtgcacatataacaacaacgtagtcattacacaagcatacagtactggaaagtgaagcaagtaaacaaaaagaagactgctctactggccctgccccgcgccgcgaccacgcttggtcctccgggcctgtgctcgcacgtggtcctgggagaaggtgaaacgatccggtggcacagcacgggtagcacgagtgtcccgcggaggagtggcctgcgcctggtcctgcgtctgcaccggcggtgcgcctcccagctgtgaggggccgatgacgtcctctgtcgagcctgaagcgaagtcgaagtcagtgatgtcgaagagcacggtggaagacaggaaggggtccgacgaggtcccagcatggtccagtggtggaccctgactcgacgtgccggctgcctgtgacgctgaccctgcagcctgggagaagtgggtggcctgcgtcatagcgaagtgggcgaaacctacacatcgacaacgggacccttgtaagctaagacataaaatgtatgtaaattgattatggaagtaatgttgtttttttaagtacctgtggggggcacaacagaaggcctagccgaggaaggcggggtgctgaacggtgcacgaaaccctgaagcaataagcaagtaaaacggctcacttatatgtgcgaggcatgtatagaagtagtaataaaaatagttaccgccgtgcggagggggagtcggcctaggaacgtgcgcagctggacggggaccagtcggtacgggtggccgctgtacagctgcgtctgcccgagcaacgtcgtctgcacgacaggtgagcactcggagaatcgagcgcatcgactccaccatccgcgtgtacgtcgtcaggtgctcctctacgggtaccggaatccccgcgtctaaacgttggatcgtcgttgaaccgtcaacgacgacccggttgatgtcgtcgacctgcatggttaatttgttcgtaaatattcgtaaaatttgacgaagagaaagacatgaaaacataaaggaatggtgcgatgcagggtactcacaacacgagcgaagtcctggtcgcggtgcctggcgtagaggtctctagtgctcgcaacgtggggctgctgctccaagggagcgaaggtgaccctagtacgggtgcgtggctggtaccagcgtaggtaggcctggtacgactcctcagtgtgtggctctccctcgtggtccacgacctcctcggttgcgagcaaccagtcctcaacaaaagtcgccaacttggcgggccagtcgccagctgagtgctgacccttgcgcgagtacctgcgaattaatgtgtaatattagtgtgaaacgacagatgttacaaattattgtgaacaggcagattttaatgcaacaacggaaagcgtagagcaagatcttaccggtgaacagcagctgggacggtggtcggaaacggtactggaaagggctgacggaagccgaacaaccgcatcacgcggaaaggggcgtgaggctcaacgcagatgtcgaagaccatcggaaccgtagtcatccagtacgcctggtccctggtgcagagtgtggacagacccaacggcgcacgagcctgggtagccgcggcactgtagggctcccacacgacgtcagtcgtcagaaggcggtcgaactccataacaaactcaggatacgaccgcctaacctggacgtgagcccatcggcgctgcaatacgagacgatcgatgtgatgtacaatgaacttagcaattaacttaacaatacgataagatcgatgcaacgtacctgacgacggcaccacagagtacccatcgtagggtagtcgacctctggtcgctcctcgtacagtgactcctcgtacgcgtgctggtccacctcagggcggccgatcgcaatcctctcagttgcccagatagaaagaaagagagggcacccaccaaaggtcgcgctgggatccgtcttcgtgcaagactcacaaagtgcacggtacagagccgccaacaacgcggaaccccagctccactgaggcacctcgcctaccgcggcgtcggcgatgctcctggcgtagtgcacgagtcccttgtcgaccgcgtgcccgtgaccgccacagaacatcacccagccaaaaagccagagcaagtacgcctccaaacatcggctgtacgagtactcgtcggcctccgcctgtagctgctcaacctgcaagcagtcgataaaatgttaggcaccttaactgcggactaaatatgtaatacgattgtcatttcggtacaaaaacactcatggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccgtggtcactggcccaactgcgtctcccgcgagcggtagccccaacaagtacgatacgtcctgtagggtaggggctacctcaccgcacggcaagtgaaaagtgtgcgtctctggcctccatcgatcgaccaaagctgctacgagggacctgtccacagtccatcatctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccaagctgagccccctgcactgcagtaaggtgagaccggtgtcggtaatctatcgctgggtccaacaactgaggtgtatcctgacgtgccatctctgaaaaatatagtgtttcgagttagaacaattcaaaaaatagtactgtaaaacaaaagataacttgcaaaattatgaaatagtaataaaatcatgagattaattatgtacaacaagagtacaggctatttaaatatagcaaatgttactaatggtacataacgatgacgtgcaatttaacatatatgtagagttcaataatataacataacattacgtgtcgaagtccgacatacatcagcatacataaagacgttaggcgccttagtccgacgttacatgccgaagtctgacattacacgacgaaacataaacacatcgataagttcgaaacgaattacaagcaaatccacatgccgacatagaacataagaactacaccacgtagccagacgtggcacgacgacgcctaggacgtggtcgagtggaggtagtgccttcacccgtagggcgagctccatctgctgctgatcctgatagtcctgcctctgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatgggtcaggaatattgagtacttcatcgttagtctctgtgaactccccagctatgccgaacccataaatctcgccgctccatgtatgatatattgcttgcttattgaagtactgtgacacatatactgtatgtggtatgccacactccactgcggcagcaatgacatgggtgcatggcctgtggagcagcttcggctttgcacaagagcaatgacatgtgccgtcgtctttgagaacacactcctgcttcactctcttgcggtagatacccctgcctgccttatcttgacatagtatctcaaacctgtgctgttgggtaccttgcactagagctcgatgtttcatggcctttttacgcaactcctctagctttttctgcatgaaagctccaaacaaaatgctgttgttcggcatagagggaagaactgcctggaaccgatccctaaaatacctgcatgtcccatgtaaaatgaactccactatgccaactagtggcagtccacggacaccgcgcatcacccagttgtaaacttctgccaaatttgttgtcattattccatatctagcaccacctgtgtcatacgccttggcccatttctcttttggttcatgcagaatccactgagaaaatttccgaatctctaatctagttcttctaaccaatgttggactatccgttgggagaggtccaagagcttgaggagggtcagcaacggcggtcgatggagccgctgcacgctgatcactgcatttggctgtcaactcatctaatctcttccaaaactcattgaattttttctcctggttctgattgcacagcctcttgaacatgttcatgagctccttgttcttgaattgcttgaagaaattagctcccatatgacgcatgcaccacctactctgtacatcttcccaaacaccggggtatcctcgttccatactcccaaactgcaactctcctatcgctcgcagaatgccagcgtgcctatcatgtatcaggcatacatttggcctcataccaacaacttttgttttaaccaatttcaggaaccagtaccagctgtcggtattctcactctcaacaaaagcaaatgctaagggcaatacctggttgttcccatctacccctattgctgttagtatctggccccgatactttcctgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcaatgtgtcagattattgaccttggttcatatgtgagattatcgatgacatgcacatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcggccggttcgacttggcaacccaaaactctctatgaagtgacactgcaaaatgttttaccgcctccttcatatcttctgctctactataaatcgctccctgaataacctcattttctttgtactcccatctcacactatcctcttcagagacgatcagcccagaaaaatcctcactagcccattctgctggattaatatccgtctcatcatctgacgaatcaccttcctctacacgctcgttgtcagaatcctccctctccatttcatccacaatggcaccgacagtctccccctcgtcagccactccacctggttgaatgcccactggagctactacacccccatcctctcgtgcgttgacctcctccacagaagtctcgtttacttcagcacttggtccctcgccatcatccatgttcgtctgcacacctggatccttcgggtgaacaaacggaaccaaagctagaggccacccacgttgcaatgtattttccaaataccatctccacactcgagagttttgaactggcattagttcccaataaaaactctcagttgcccgacttactataacattgattgttatgtcacttgtctgtggatcaactctcaagcccctcattaaccatccttttatagaaggtacactcctctcagccggtctctcaattcccctttctgatacaataaaatctgacagatctaccccagttggcccgtaacggacgtttcctggtccatggtaaacttggaatatttgtttgttcgacatatctgtcaacgaaataactagatcatattactctttcatgcaataaacatctacaacgtaatatcttcttgtgtaagccaatgcaacggtaatgtattaattccaaactagcagatctacgtagttatcgatatctacaatacgcacttctagattagtacaactaaaaccctaaaaatataatgcatttattcaaacaaatttttaaagaatacacactatttaactcaatagtcacatataggatctatgaatattacctgaaatcggcgtctgaatccggcagggcttcgccccttcttctcttctcctcccctctcttcttttttttttcactggaattgaggagagaagaatgagggctgggggctgggcagcaggccttttataggcagcgaggcctgccgcccggccagagggcggcaaggggccgcctgcaaaatagccggccccgactggcttttttgcattcgggcctcttgccgccccaccagagggcggcaagggttttcttgcaaaaaaccctccctccgtcaccgcccgttcctcccccgtttgccacgtcagcttgccgccccagaggtgggcggcaggggctatttctgcaatttttttggtcgatagattatttctgtaaatatttaaaaataaaaatctaaatccgaaaaaaattcggtctttgtccatgagcaagagtatacgggcccattttgggcccagttgggctttcaatcattggaggattaggcccaaaccagctcttatccattgggcccatggttaccgtcatccacctggcctcatcccataaagggcatgcttgattgcgtactttatcatgaaagtctggcaagtgatcgttcaaggctgtagttgttttgtgttagttctgtgagcattttatgcttaataatcttatagacagattgctttcctttttttaataattgaatataacatcccggcctttactcaagagagctacagccaataattacatagtactccctccgtttcacaatgtaagtcattctaacatttcccacattcatattaatgttaatgaatctagatagatacaatgtaagtcattttagcattccccacactcatattgatgataatgaatctagatagatacaatgtaagtcattttaacatttcccacactcatattgatgttaatgaatctagacatatatatctatctagattcattaacatttcccacactcatattgatgttaatgaatctagacatatatatctatctagattcattaacatcaataagaatgtgggaaatgttagaatgacttacattgtgaaacagaggaaatagcactcaaataagagtgtagttcaacaaatcattgaaaacgcccaatgaacaaaataagtaacgaaactaaaataaggagaacacattattgaagtctatttgtaaatctccatccataattgacaaaaagttgtataattgtcatctcaagtttgcaacatgcaacttttataaactctttgtcgtcttcaaacttttgtagttgcgcccagtatcgaaaccaatatgttgccctaaaaattacctgcatataagagatgtatggtgatttatcaaaaaccaaatcattcctgctcaaccacagagtccaacatattgcataagctcctacaagtacaaacttgctccttttcttgtccaccccaaaagccaaccatcaaaaatgtgggttatgctactaggaaggtaaccaaaagagaattgaactgctctccataaaaactttgcataatgacaatcaataaaaagatgttggatagatttaattttcatgcagaaacaacatctcaaacaaccattccaattccgtcttgccaaattatctttagttaacacgacacctttaagcaaataccacataaagatctcaatcttaagcagcatcttgagcttccaaattatcttatttttctcaatatagccattattaattaaagcaagatacattgaccttaccgtgaacataccattctgattaaagttccatttaaaacaaccagatgagtgattcaattggatatgaacaatagaagcacacaaatcatgccaagaaacaagattctgacccactaatgctcttctaaaatacacattaagaggaacagaattcataacactagcaattgaagaacatttccttcggacaatggtatacaaggaaggatacttatctttaaaaggcaaattaactaaccatttatcttcccaaaatcttatttgttccccattattcagaatccaagaacccatattcaagaaagtctccttaactttcattagaccggaccaaaaatgaaatcaccatgtttcctatcaacttgggttatagacttattataaagatattttctcttcaacaagtcttgccaaactccttcctcatttattaacttaaataaccatttactcaacaagcatttgttttgaatttccagatgctttcttttttttgaaacacataatagtacataagcatgtgctcctatgagcatttcagaatactagaccggtctagcctatcactgaaagaataattaattataaatatgagcacatgtgctaagtctaaaaattgaacatactccctccgttctaaaaaaactcaacctagatagggatgtgatatctcctaatacaacgaatttgaattcactatactagaaggggtcctagattgtttttttaggacggaggaagtaggtcggtaggatcaaccataagggaccttaccatctaagctaacctcaattcgccaggcaagcaattagacattctgacgatatgtactaacctctgttgtacgagtaaagaatttccttctcactgataatatgaggttttcagatgaggtgaatcccacccaaccaatcagatccatggtgggaccaattcggttcatagatcatgtagtgtcccaagactctcctttcctttccatgcagtaaggccttgtttaattcgcgaaaagaaaatttttaggtgtcgcattggacgtttgaccggatatcgaaaggggttttcagacatgaatagaaaaactaatttcataactcgcctagaaaccgcgagatgaatttattaagcctaattaatccatcattagcacatgtgggttattgtagcacttatgactaatcatggactaattaggctcaaaagatttgtctcgcgatttccatacaaactgtgcaattagtttttcattttatctatactagaaaaaaaatccccgtgcattgaaatgggtgaagtctattttaatcttattattgtcatatggtttagctaagataaaattcactgtgggagttcgcttggatatatatttttttagaaaatcatgagctgtagttaggagtccgatcgtctcaagttagcatgcaagtttttttaaacagattccttatatgattccttctgtattaccaaaagtgaacgatcttaaaaaccgactcaaatattaatatgtatttccaaaagtaaacaaacttaaaaattgactcatacacgaatgacatactaaaataccggcaaaaacatctttaatttttgtaatagtagagatagagaagagatatagattaaaaccaaaacataaaattaaaaccgactcaaacacggatgacgaacagcggaaacatcttcaatttttataaccgactcaaacatggatgacggaccgcggaaacatcttcaatttttataatagtagagatttaatgctccatgtatgtgtccaaagattcgatgtgacgttttttggaaaaaaaattaggaactaaacaaggtctaaatttcatatttgtcgattgaatattgctaaaaagatactttgaccattaaaatttagaaactactaggtacatatctggcaatgaattcaatcaaaatttaggacactacgtcataaatgtgtatgtcttgaatgttacgtgtgcctcgcgaccacgagctttttacttaattaatccctggttgattcaaacgaaagttagggtgtatttagttcacgtcaaaattaaaagtttgattgaaattgaaacgatgtgatgaaaaagttgaaagtttgtgtgtataggaaagttttgatgtgatagaaaagttagaagtttgaagaaaaagttgggaactaaaccaggccttacataaattttggagaattttatttctatgggatttttttcctagatgatcctttcaataaaagcaagaatgctctgtatcggtcgacagggggaggtgggaaaatcggtcgctccccatccccatgcacgcaccccgctggatccacccacttgtccctccccttgttccacaaaagatatttcatctagtgtacttataatatttcacatgtatagatctaatgttgcagtgaattaaaatattcttttgcaacaaatcacctgtatattttagaaaccatctattatgggaatttgttttattttttgttccacaaaaatgtttcacctagtgtagtcacaatattttactgtgtatagatctactgttgcagtgaactgaaatactccattgcaacaaaaaaaaatccacatttttggaaccccctattaaggaaattcgttttattttttgttctaccgaaaaatatttcacctaatgtacttagggcattcccaacccaatgactaggatgatgtccatagcattaaataagttgccacctaggacaaaaaatgatgtggcaagtgaataaatgaagaaagagaaggaaaccatgtcttgcatgagacatggtttctacacaacatccaagacatcatgtgagataagtagcattaaattgaagtatggaatagtggtgtttgcattggaagagtagtgtctagtactagtttcttaatgatgtggagtttatagaaaccatgtctagtgttataggttgggactgcccttataatatttcactatgtatggatcaaatgttgcagtgaactaaaatattttttcgctatttgctgaaacattgtttttatataaggtgaaacaacacccgatttaaacgagttaaatattttcgatctacttagtgaaacaattccgatattcctagtggaacatcgtgcaacatttaaaaataattcaataacaagctaaaaaaaattcgtcggaatatatccatgtatggtcttgttttgaagatttaattgcaacgaatttaatagtgcaatcggatcatgatttggataagtaatttaagagaaaattcaatttaaagtagttttgcacgtaaatcgggctgacgtcagcgcctgatttttctccaaaccgatcgggcgcccgaaccgtagactcgtccgaataaaaggagtcgataaaattcctatggaatgtactatgaggtagaacctcatggaactttcctttgagacattatctctcctctaactactgctattgtcgaatgacaactgcgtcacattaaaggacgtggaaacccgttaggtgtttggaataataaagcaatatattaattggtaaaattttttgggatccccccattatatggccctagggggctatttatagtcctaatacaggctcataccctatagagtttggttagtacaggggaatttacatggttcctcttatgatagggacattacaatgggtataaaacgtcttatacattcatgggccctaaggtgatcttcttgggccagcccattaggtgacgaagggcctccatgggccgccaggccttcttaggtccttagccgaaggcctcctctactccagatgacggctttatgcttcgcttgatgtccttcgcccttagtgagccttcggtcggtcgccaagcttggcggcgaacctattgatctttatcgtcaggcttcgtccaatggttggtagcgaaccccatggtcttcgccctacggcttcgcccaaaggacttagccgatgctttgatggattaggtagtttcggcaggttaaccaaaggccctcatgacattcctccaacaaccgcttttcctgcggtccaataaaactgttatatttgtgttttgtaattctctattttatactagttgtattcatgtcaaaatcctttgttttctcaatcctgtaattcaagaggccctattccactccgtattccaccacctgacgtactgatccaaatcaattccactccctattccagcacccttttcgaggacggcatgctgcgaggcgtcgggtagcggatatgagctagcagagaagggttgtgtttagttacacgccaaaattggaagtttgaagaaattggaacgatgtgacgaaaaagttggaagtttgtgtgtgtaggaaagttcgatgtgacggatgaaaaaaaaagttggaatctaaatagggccaagagcagcagctggcgtcctagctcgtggcgaccttcttggggttcagcgattgtgagagagtagaagagaggatttatggtttggtttactttatatatgagtccagctactgatcaatataattgtgctttacattttacattttgaagtgagctattttcacatgactacacataggggtgaaaacggagcggaatcggatggatagtggtcataccatatcctagaccatattttttaagcagattcggagcgggtgcggatagtgtacggatgcggagcggattgtttcagatgtcagaaatggtgtggaatcggttcggaaatggattaaatttatcgaatgttatgtttgtatgcaatcaatataacaccaagttagcaatgcaaggaacaataatacaataatcaataaacgacataaatacataatataaaaatacagctacacaagactaagaatacataaaacagattaaaaatacatgagatgaagaaatctagattaattgatcaattaggccattagatggaccaacttatgttatatgcagtagatatagcggttacatgtgttgataatttccgattatcaacacatgtaaccatgtccttcttgtgccccaaaacagttataagcatcatctttacatcctcaactctaaaattttgaaataatatggaaatatttcatgataagacaaaatagtgaacttattctcacaaaaatctagaaagagtttatcacatttttcaagtgttttttaatgtatgtctccctcttcatgtgatttgtagttttcatgattttaattataactaacattatccaaattcttgttttagattcatgtggcaactgcttgtagcaatgacaactgcaatctacattcctaaatttctgctgttggtagaatttgccataggattatagatttatgaggtttgaccttcttaggcaaaaaaatacatatcatacaacatatacagataaacacatggacatcttattgaggacactaccactagaagtctcaactagtgatactttatttgccaaggtcataacgtacctaacgtaactaatgtatggcctcgcacaatgctcacttgagttaaatcgttcagagtgccaaacttgtttgggttgtataccctctgctccacattttaacttgtaaacatgtgagataagagcaacaacatggtgcaatttgtgatgtcagggatatcctttcttcatataccttccaacgttgaaccaactcatttatcaagctacacttaaaagggatgcaaaaccgatctgtgtttgaaagtctattatgcatgatggtctattgctatacattgattataatattgttagtttatagttcaaaactagcttttaggggtctaattcccactccgtgtaaaattgactgggggccaaagcccccacgctaataactttttttggaaaattttcaattaagcaataaaaaatagagaaataattaaggaatacaatccttgtcaaattagcaaggattttggttcgaaatcctttcattttagtagcttacccaacttctttctattcaatttttttttcaaaaatgagatttaccaaaattttcatgactctaaggtccaatccaatctatcttcctttcttttcctttcctatactaaaaaggattgaaattcatcactctcttatagttcattgtttccagtgtgctagcttagtccctccattttttctgttggtcgatcgatcaactcgtctccgttgttatgcgttgcccgctacaacctccttgtcactattgtattcattcgctgccgattggccggatcaaataagtaacacatactagtttttattatttgcaagtgtgacacctttctaaaatctaatttttttatatgccactagagcttgtaatattttaccctcactactaccattcactaatatcaaccgattttactccatacaccccttttgcaaaatcacaaaaaagtactcatttttccacctcaaacccatgtacaagtccttttgcccatgtatcgtgttgtcttttacctttaaaacttttagaatttagataatgttagttataattaagatgatagaatgaactatagaatttagttttagacggtaatgtggttttagttactagcattttgtctcaaaaaatacttttcattattttaatttgaactaacgttgtttaatattttatttaagatttatgtgcgatgatgaaaaacacattatgcatcgttggatttgcactggtactaggatttgccacaggattatctattgatctctcatatttttgggtgcaagaatgaaatacatatcgaacaacatatacagaggaaacttgaattattatatcctgatctcttgtatttttagggtgcaagcaagaaaaatacttccaacaatatatataaattgtcggcatgtgggccttggcaggcaccaagcgtcttggagagatcatcccacaatttgtatagcatacagctttccttgttttttgctttttctttatccctaggggttgtatttttctcctgctatattcgatgaataagcacattcttgtgctggttcctttcaaaaaaaacaatatatataaataaaagttggatttcttatcaaagtcaatgctgagtaaggtcttcagtttgttttgctcttaaaaagttaatgtatggaattggaaagtgtcgagtagataccaatactactagttataagagatatgttacccaagcaatatggggcatccaggtggtacgtatgtgatcaaaatatggataccagtgtttattatgacttttgtagccttagatttagaatttctagtgaaaatattcaatttagtattctacatgaaatggacatgttagctatacttgtcaactagtctcaagtcatttataaatggttactgaataaggctgttgtgttacttatcgctactaatgtgttaagaaaagtagtgaaattatttacaagatttgccacatcacaacttaatataatcacaaccaacaaacctatactacgacaattgccactaccaaagcattttgcatggtaatttgtgttactgcaagcagctatgtggttgcgtttcagcggctgtaatgtgcagccgaacacaccctgaattccctcctctatctccgcacccgcccaattccgaggcccccgctcaaacgttccacggaacgaaaatttcaccacgcccccgtgggaaaaaaaataccacccgtctgatcccaactccccaaaccagtgtttcacggtctttgcattggaagcattgcccccaccgtgcagaaacgggcgtgtacagctacagcagcagtatggaaaattccttgcacccaccgaggctgccctgtagaggtggccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggggccgtgcccgtgccggcacggcacgcccgcggcccacgggccgttcgggggcacggcggcccgtgaaggcaggccgccagcagtgcactgtgcacagtgttttttttttttaaaaaaaaggaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaaagaaaaaatggtattttcgctacagtaacgggccgcccggtccgtgccgtgccgcgggccgtgccgtgccggcctgctacaggagccgtgccgtgccgtgccggcccgcgggctcggccagcggcccaagcacggcacggctacacgggccgtgccggcacggcccgttactgtagcaggccgtgccgggccgtgcctgctacaggaacggccgtgccccgggcggcccgtttggcccggcccatttggccagctctactgccctgcactgcatgtgtctatgggagcatgtaggcagttgtaaacatattttaaaaagataaaagagaagagataagagcagcgggctatatagatttatagccagctgcagcacaaagcatttgtgtataataagtgagaccaaatattgattgtgtagtatatatttataaataagtattgtatgaattggctattaagttgactacatatgttttgaagcgagcttggataaaacgcgctctcctttggataaatacatcaccgtactccgtagtactagtagtagacgacgtgttcccacctgtccgtacgcccgagcgagaagagcgcgaaaaagtcaacagtgccactcatcacccgacacacgtgcgcccgctctgacaccccctcccgaaaccccaaacccctttcccactctctctcacacaccacgtcccatcccgtcgcgtcgccgcacattcacccccacacccttgccgcgccgccccgcctgccgtgccgtccggcgaacctacctagcctagcgctagcctagctgaagccagcaagcaagtgcaaacagtgcccaggaccaccaccaccgccattgccgccacctctccctacagctgttcgactacgccattgtcgtcactcactccaccgtactacactcgccttcttctctctcctctccgacacgacagcgacttctccctcccgccaccttttccctccaagaaccaccccccaagaaagcccagaccagagagacagtgtgccgatggcgatggcggtggagggtgcgggtgcgggggtggtggtgagcgagccggaggtggtgtcgataccgccgacgccgagggggatgtcgacgccggatgggacggcgacgccgccgccggcggcggggaggggcgcggcgacgccggcgaggcgggtggtggaggggctgcggggttacctggaggaggtgggacacctgacgcggctgaacccgcaggacgcgtggctgcccatcaccgagtcccgcagcggcaacgcccgctacgccgccttccacaccctcaacgccggcctcggcttccaggccctcctcctccccctcgccttccccgccctcggatggtcaggcactttccctctgcttgcttcttcagtttcttcctcctctctgctcctcgcccttgccatttccctttctttctttctttctttcagtttcagatgtgaattaatgcaggttttctgactgtctagtttttttttctttttcacttctgcttttactgatttggtctgaggttatggtttttgttgatttggtgatctgaggatgtaatgtgcatcctgtgttacttcagatgttatgcagtttctctggaagtgttttctttagttctacttttacttctttgatctgagattatggttcttcttgatttggtgacttgagactgaagtgtgcattctgtgttcttcagatgcgatgcggtttctctgaaaaatgtaattcttttacttttgggtttactgctcgaatgtaattcttttacttctgggttcatcttgctctcgaaatctgaagctgtaattttgcattctgtgttcttggtaggaggtaattggattgggcgtgggatatattttgattttactgcatcagtttgagcttgtgattctttgttgcttcagtgatttgagactgtaatatgcattttgttttcttgattggaagatgtaactggattgggtttggaaatcactgaagatttcacatattctccatcactgcagtgcatattctccgtgtccattcaaaaaaaaaatctactgaaagcctcatccaagaacaagacattgttgctttaatcatgctctgggtgtggagctaccccttttgctacactttggactttgttgtccaggattcttcttccttttttaaaaaaaaatcagattctttagatggatattcagtcccaaaagttttaaagcggtggtgaaattgtattgtttatttgtttttcagattgttccagcttgggatttcttacatggttaggaacgaaatgttttgatgataaatatatttaacaaaaaaaaattacaacactttttagcaaatgtagagaaaataactgaaactgaggggtgaaaatacagatctgaaacatcttttttttttttcagtttcaaggatttattcctgaatcttcagtttatatatgagttgattgagttcttttgttagcacgtgcaacggcctcctgtgaaaaagcatgctcagcactgaaagaaaaaactgtactatgattcaatacaatcatttcaaactgaattttttcggtgccaatttgtgccttgcaactggacacagtatcaactagtagtattgatactctgaagtgcattgttttcagctgaactgttgtacagtttgaaaacacatcctaacaaatggttctttgcactgtaggagctggggaataatatcacttactgttgcttatttctggcaactgtacacactctggattcttgtcaagctccatgaagctgtaccaggaaggaggtacaacagatatgtggagcttgcacaagctgcatttggtgagacatgttctctagtctttaactattttgcatgtccattacaattagctttctattccaagctggatatctctgacatgatttctgctaatagtagcactgagttatgagtaatgcaatgtatataatcatggccttaacaagatctgtgtcagaaagatagagagaatctcctaacagtataatgtgctcttccaataggagatttttgtgttttttggtgggacagtggctagtcaaatgtactaacaccctcatgattgggtcacatctggatagcttgaactgtctccattgatggataatagatcaccctcatgttacagtaatgcaaaatgtggaatcttttttgctaccaccattaattactatgtcatcattttaatcaaactgttgcatttgacagctcaagtaattattgcctctggttacaccaaactcagaacatgcaatgttgctaagattctctctgccgatctgatccatttgactggtgaaatgcaaaatcagcaagaatgtctgattgctcttgttttttttttcattcgttcaggagaaaaactgggaatgtggctatctcttttcccaactatttatctgtcggcaggcagtgcaactgcgttgatccttgttggaggggagaccatgaagctcttttaccaaatagtttgcggcccaatctgttcaccgagtccgatttcgacgatcgaatggtacttggtgttcacatccttggccatagtcctttcccagcttccgaatctcaactcgatagccggcgtttcactcatcggtggcaccaccgcaataacatactgtaccatgtcctgggttctctcggtcagccaaccgcagcctccaacagtctcttatgaaccacaagcatacacttctcttggttcatctttgttctccaccttgaatgctcttggaataatagcatttgcattcagggggcacaatcttgcacttgaaatacaggtttgtcctcaagaaaccaattcacaagagactttttgtactctacagttaccatttggtggttcagtgtttgaatgagctggaatctgtaatttttttcaggcgacaatgccgtcgactttcaaacatccagcacatgtcccgatgtggcgcggggccaaagtcgcatatgccctgattgcaatgtgcctcttccctgtcgcgatcggaggttactgggcctatggaaacatggcaagtactacttgatcattagacccaattgttgctgcacttaacactcttaagtcctaacagtccttggaacattctccctgttgttttccaatgcctgcaggtgccacagggagggatgctgacggcgctctacgccttccacagccacgacatcccccggggcctccttgctgcgacgttcctccttgtcgtgttcaactgcctgagcagcttccagatatactccatgccggttttcgacagctttgaggctgcctacacgggccggaccaaccggccttgctcggtctgggtgagatcaggcttcagggtgttctacggcttcctctcgctgttcatcagcgtcgcgctgccgttcctctccagcctcgccggcctgcttggggggctgacattgccggtcaccttcgcctacccgtgcttcatgtggatctgcatcaagaagcctgagaggttcagctcaggatggtacctgaactgggggcttgggctgcttggcactgcattcagcctggctctctgtgtgggtggtgtctggagcatcatcagcagtgggatgaagttcaagttcttcaagcccccaagctagattgaccagcaatttccagtatcaaacttgcaaaatcagtacaaattctggtgtgtttgtgatattttcagacaatggaaaagcatatcccagctggcctccgcattgtgggtgtgcttgtcatatggttatatgaatgatatatgatgatgatatatatggtttatcttacatgccttggcaagaacagaattatgtattttctattttgaacacaagaaaaacaacaatggaatttcaccgaaacaattataaatgatccaagattctttgcacgattcctagcaagaatcaagttatcactactaaggctctaggacaattcaaatggttttgggctgattattaactcttttatgctctgcttagctactaagaaccagttaggaacataataatttcattggagtgttttttttttgaaatgttttctcaaaagacaatgggcactatctagcaggaacttatttaatcagagtcaatgttgcgatcaaatgaaattattgcatccaaaataggggtaataatatcaattttaccatttttagttttttttaaccagacaaaaaagatacggtaacgtcacgaaaataaattatcaagatgactatgataaaatagcttcggatagcatgaggcagcaccaatgttttgttccaaaatatagcaactttaagctctcaggatttgttccaaaatataacaacttctccaccaacattctcttctcaaccaatcacaactctctaccatttacttttcccacatacctccactacttatccagtcacagccctccaccatttacttctacctatttttttaataaccatgtccaactctaaaacttcttatattctaggacgaagggagtataattttgcatgccattgacaaatatgagtattgtgacatttaaagcctatctttgtatggtaaggctgaggttaagagcatctgagttggtgacatacggaattttactttctttttattctcgtgtgcctacttatctattggacaggagcacaaatactaacagttgaattttttttttgttattataccagaactacacatccaccctaactgttcactctaaggtcattgacggccagccaggaacactagtgattgagtcatttgtggtggacattccacaggggaactccaaagatgacatacgctattttgtcgagaacttgctcaggtgtaacctaaggaccctcgctgatgtgactgagagccatgccgaactttgatagactttgccttcttttttttaggggaatctcattttccttctttgcttatggtcagaatagtcgggatttcaaattggtagaacttgttaaaactctaagaaataatggagctccttgatcagcactaactactaaagcttcttccaaagaaattaattaccagtgcaatcatagcgctcacttcagtttactacatatacatatgcaactttctggtttagtgtgctctagtgtttgaaaaatgctgaactgaaataaaataaaaatattccgaaggattgttctcggacttcatgtgcaatcaagtgtgttattcttgggtattcaactaatgtttccatatatgcatgtccctcttatcatcatgttccctaacttatttgagttcaacataaacacttatttaatttaacattatcttaactacaacaccatatgcccaaatgcaacatgtacattgtattgactagaaaggctaatttgtatttagaaaaaaaaacaaatcatgatataagctttcaagaaaaaaaaccaatcaacttgacaattatgagcatgatgtacctagtatagacatctccgccctttggatgctgaagagggcactcctcagccaccatgcatgtcctatctctacctcttaatcgaagacccaacatgcaaggtgtcgtccaccaagttgggcatccatccagtggcccctgcctccccaccgttggatctaaaggtctagggataagggacattacacgtgggccttagagccatcggcatcacacgcaataggttaaccttagagcttccgttgctgccaaagggcctcggagaccatgtcacgtgatgctacaatatgagagcttaccttccttccaatttgggctgcctgagcttggggggataacggatctggctactcccaagctcataacagctagatctggccacctcagatctcatgctggctggatgtggcatttcctatggtcgggttgaatggaagggaggaaggtggcaaaaatacagaactagtggcatggtcgggtgaagggagaatgagcaggtggtacgtcatccagagaagaggagggagggctagagggggatgaatggagatatagggggtatgaaggggacctcacgtggacaatgaacttagtgtgggatcgaggaatctaattcagcttttttttggctgatttcactaaaaactggtaatgttgtttcaaacatgatatatggtttttaacataaaccggttctttgaaaacaatgattggagggggggtgttgattgatgttttagtgctaatggttccttctgccacgtcttcataatttgattcatgtatgttatgatctcttccatatgatctttattagcaatctctgtggctttttgtgtgcagtactcatcacttccttgctgatcacttggtccttccatccttatcctctcttacctttaatttcttgtcaaaaatagcttagctttttgttaaatcgttcccaaatgtgtaaaaccatgtttcatttgtttgatgaaattgtgtttattaagatgcatacatgcatagaaaaattctgaacaagaattaccttaattacttgatcattggaatgtcctaacgtccaacataggatgaaaatgatatactacatgtggtttaaattacatggcatctggtagcaccaagaggaaatgcttgtatgtacttcatgcatcatttgccatatgtttatgccaacaattaatgtatttcacatttttagctttgaactgatattctatatacacctactttgaaagtgtgatgaacacatttttttatattttttattaataattctctacaatattggttggcataacttatttgagttgataacattttggagcagcctgggtgtgttttggtaaaagtaggactctagctctcagattctcatctcaaggagttaaataccctgatcagatttttaaaaatggtgtggtgtagtagaggttttttttttttgggggggggggggggggagggctgctccgtgatacagaaaaaaaaatcaaagacttttctcatagctacttgtatataccagccaactatggaaaacagaaaaaaaaaagagtagcatggtcactttttagtttttatccactcctggtctcaaaatttttggaactaatatttaacaaaatgttttcctatagggacagtctaattcccacttcctgaaaaaaaaggtcaattttttgtacatccaggattgtcttgagatttgttcatgaacagttaatcttatcttctcctctcgttttcccatcccaagcacgaccgcactaatgggcgctcacgggcgccatcctcccctagcccgactgagccgccgccgccgccttgatctgaacagttggctgaaggccatcaatagtgccagcacgttccgaccaactaaccgcctcctgctgcccccctccctctctttcctcctcccaaatccggcggctgcaccattcccctgtgctggtgtcttcaccagctcgcaccgccatcaatcaccatctccataccctcccccc

SEQ ID NO: 59580 - DNA, 68032 bp, Oryza sativa
attcctgcagccctatctttctgctcgtattattttgtcctaaaatgctaaccttctgctattggctaccctaaaattaacatttttaggtagctgtgaggagcatggtttttagtggtgatagccaatatgttctgtcatctggagttggggaacgctatgttgccatttggaagttgggtagtggtaaaactcagagttcaagctgtatactctctatggagcatccagcgatctttgtggactgtaaatgttcagacattaatgatacagaaggagaaatacatgtgttggctatttctgagattggtgtctgctacttttggtctgggactaatatggatgacctgcgtaataagaagcccactaaaattgcattgtctgattcctctctttcaagatctaagcaaggttttgcaatatttgccgcaaaactgcaaggaatagatggccctaattctgcacatgttctgctggcttatggatctgtggtgaaaccgtcttttgacaaactgttggttcgttatggcatggatattagtttgggtgtatctgatgatggagttctcttacccatgattcaacccacaaagcctcagaaaggccaatctgctaaaaagcaaggtatactgctggtatctatagatatacacataatcctgcacttctgtttggtcccttgcctccattgcagaacgctcaactattgtcaatggttactcttgggctaaatctcaattgttttcttgtaggaattataacggctctagaccgtgctaatgcagaagatgcaatccttcctctcccacagctccatacgcaggaaaagaaaaggaaacataatgcaacagaatccagtggtgacatccagtctgcacctcatagtgaccttagttctacaaaattgattgagaaaagaggtaaatcatctgtttgtagcatcttcagtagtcataattcttttgttctcatggcagtgtagatacgaactggtacataactggcacagttagctagtggaagtgtggaaccacataagtttgtatagtacatatatgtgtgcttccgcatgtttgggcaaacttcaaataaatatactataacatcttataagttacaaatgaaaattattattataatccattctaataattatatacatgagtgcatgagatcaatctacctagcctacgaatacgcatgcaaaataacctggtcttttacaaaagatccttcaaacaacaaacatgttttcgggagtggggaaatgggtgtagagcacacccatttgcctccaactccatctcaaaggaagataagtgacgttatgtgtccatatgatctttctctagagacttttaactctgtgggagcaatttattgcaggggcctatacccttgtggttttcatggcaagaatgtaacaactgctatgagcaataattctagtctctcagttgttataggttttactatagttttaacattaaacacaaattttgttatatttaacatgtatttctgttaaattgatcttcactatttgctcaaaaacccttttgcttgtctagctcctatgcaaagaattgaagatgacagtgtatgcatcgaagacatgatgcggaagtgtggagttattgattctagagttgatcagggcatggaaggtcatcctagcatacccactagtattttatctgatctatttggcagcagcagtaaaatcgatgctaatttacccaacaagaaggtttgtgagaactgaatttcagtcaaatgttctgtacttccaccatataactgtttgcatgtttacacattacagtatatatacaactgatgaaacctgatgcattgatatggttcaacagattcgagcacatctaagatccttgaagcctggagatgcttgcgaacttttagaaaaattagtatcttcatggaaaacaaggtgtccatgactcttttcccatgtttgttcccccacaacgcattttcattcgtttttatccttgtatgcttaccaattgctgatttattctctacagatctggtagtgcagaggttgttttgcggtggatatactgcttattaattatccatggtcgttttatcccctttgagaaatctaaaaaaataattagcgaccttgagaaggtattatatgtgttaccagtactatctcttgtgtgctatgcagattatttgaaacatgttactgttgtggttgtcatcatgctgtgttgtagtggagttggggggttaagctattagcaactattgccttaaatgactgcagaatgtggataacatattctgattctaatttaaagaccaccaatgcaggcagggtatttcagaatatagtttcgtgacctatttttctgataaaagtacaagtaacaatgatggcaagaactcacctttgatgagaacttgccaagtcacaatctgagccatttgatccactctagtggatgctaatgtagttgttttcccatgagagttctcaagtcgtcattgaacaatggattcccattttagatatctcctgacaactcaaacaatgttgtattgacacttcataacatcaattaaaaagtcatgtgcagtattgagcaaagcacatagaaagttaaagaaataagcatgctgtgtatctagattgggaagatgtcatgctatgcagtgctagtaaattatagatatctttattttatgtaccatgactgatttgatcaagttgcccccaccaatgctggccaatttctgttatgtcaaatctggggttgtcaatttggctgcccaaacttataataaatttactaaagtatattgcatgcccagtatttacaaatgaaacacttcccaatttcaacaacatggtcagattttgatcaatattacttggaaaaaaactgagactataactgtgtgtttactacgtcaagaaaaagaactgaaaattcaaaggtcgaactgaaccaccgcaactatgagcttaccatgtcttaccatgtcgaacatacaaaacaaaaaattgaaatgaaccattacagctatgtgtttttcttcttttttcttcttcggggaattgcaactatgagtttaccatgcgaaacaaacaaaaccaaagttgaagagattgaaagaaaccatttttcgtttgcagatgtgtggggaaagatacaaagcagctgaagatttactgaagctttctggtcgtcttcgattgctcatggctcaggttttaaccattaataatactgcgtaatgagtcaatattcttagtgtataagttaatgatgatttaatgatcatgtgcgtacttcacttttgtagatcgtcaaggatccaaacgatgtttctgagcttccatcagaggagatgcaggattcagcggctgctcagtctgatgaagaggaggaagatgatgaaattgatgaaacggtgtatggtgaagacgctgattcgtctcaaacaagtgatgacgacgctgaatagaaacactgagactaagcgtagcattcttatgatgtgttgttttatattcaaacttgattaccccgtagtcaggtttgtatgactaagcaaccccgaagggttgcgcagaattttgacgaggcgaagcatcctctgaatttcacctcggtgtttctcccctgccttcaccttttaccacaacacggcattaagaccgagctaaagctcatatgccgtggttaactacttgatgggttctctcaagtgttaatgcctgcttttttatcacaccaacccaataactttagtccaagatttagattggtgatcactgcatcactttgatcacaccaacccaacaagtagtccatgatccaacagatggtgatcacaacatcacgttgactacaacgaccgtgtagccaacccggcgaaactttcttcgccttcaactaaacattgacaaaaacgacatgctaactggggcctcctgacgtgtccttccaacccccccggcctagtaaagagataaacgaaccgtcggcgccatccaatttgaaccgtcgccggccggtgctcaccagacaccagagtaccagacccattcaggccagggctcaccaaccccccacctttggcgtacctatttaaaccgctagctgccactctctccggcatccactcaagcagagcagagcagcggcaaagcaagtgatctctttagctcggatcatctctgcatttgcatttgcagctgctcgtcacggcaatggcatccaccaacagctggacccacgagatcgagtcgccggtggccgcgccgcgcctgttccgcgccgccgtcatggactggcacacccttgcccccaagatcgcctcccacatcgtcgccagcgcccaccccgtcgacggcgacggcagcgtcggcagcgtcaggcagttcaacttcacctcaggtatatatatatatatataccgccgtccactaagctcaatattccatcatccccgagatgcacttgatagtgcggtggcaaggggtgtgtggtttcaactatgacgtccgtcccgtgttcaatccccaacacgttcataattacattcacctgctgttctttctgcagccatgccattcagccacatgaaggagaggctggagttcctggacgtggacaagtgcgagtgcaagtcgacgctggtggagggcggcggcatcggcaaggcgatcgagacggcgacgtcgcacatcaaggtggagccggcggcgaacggcgggagcgtcgtgaaggtggagtccacgtacaagctcctccccggagtggaggtgaaggacgagatcaccaaggctaaggagtccctcaccggcatcttcaagaccgccgaggcctacctcatcgccaacccggacgcttacaactaaatcgtcatcatgcctatgcccccaaaatatgtttgataatatttgatctttgcgagtgtgtatgatcgaaataaagctgcttccaagcagtgattgagaagtgagcagcgagaagcttggtgtgtggtttggttgctgtcggagaatggttttgtttgacatgatgctgtcaacaccggctatgttatgtatctatctagcatctacctgttggttttgcgtgggaataaaaacatactataaaagataatgagctcggaagctactatctgtgaactgtgaagtactctgctttggaagatatcagctcactgtcttctgcttcctcatagaaagtttcactgaacatgattacatttcactccttttcaatgaggattagatagcatatcagtaatcagtctggtgaggccgtcgaaaattgatttttgtatcaataactattggttgccaccatttctacctatcatgtagtactacactagggaggtggatttttttcccccggagaaaggatgtccctctcattttaatgttttaataagatagataaatatgtgagatatcagtacataaatatgtaagtatagatcatttcccaaaccttaatgaaattggatgaccttccttcagctgtcccggaaaaaaaaatcaaagtagaaaaattaataaatttggctatgtagcgtaagttgaatttaaacttacccctttatatagtgatatatcatatatttttctttcttgttattttttttaaaaaatatgatttagatggcatgcaaatacagacgagaagaaataaaccttccttactagttactactctatcttttaaaattctaatagtatactgctgtactagttactagttagaaggaaaaatcgtttttcatactgatacaagatacaaatgatgtttccttgtcgtctaatccatttattgcattcaaattaactttcaaaattattttgcagcacattctaaattattttgcatgtctaaattaaccagagcaaattttataaaaattatgattgttttgtgtgtgttgttggatttagggtagtatgcttgtttgtttggcctgcggcctgagtccgggacatttaactatttgcaattcataatccctcatgtatctataatatgtgagtatagtaacaaatttttaattacccattcaaaagtgacaaatagttaattattcccatgagtccctgttgagagttgtgtgcggtgttaccgtgttcgaaagctggagtccccaacgctttgtatcgaaccaaaccttacgctttcagtaaaaagctgggctctctgggcctttctctaaaaaaaactatgattgtatttgttaattaccggttagcacaatttaaacaagtcatttaaaaatttataacaatagctgatgattttagaaaactacaacttaattcattttgtagaactaaatttaccatagttagttaacgtatattcacaatcaactttgttttttcattgtgatatgtaaaagttggattttatgttacatgtttgtagagaaatatatcacatgttaatatatcatctcaatgtttaaactattttaaatggcatgcaaacaacggtaacgttcccttcagagttaaaatccactccccttggcagctagtacaacttgcagtttgcaagttcatctcctgcattaaaactagcaaaagtttgagtacgtttcagaaacagaagaagtaaaactctgtcaaaccttatctattagtttcaccatttgtcgatcagtaaaaacaataatcgattcgtaacaacccgtacaacacgtaaatataattaagtagtactagtatatgcaatgtactacgcgtacgcaaattctatggagaaaagaatgcatttctatggattagagtacagcagagaacgctatagagatcacaggagttgacgacgacagcaacatgatgcaaacaattacccgctagcatatatataggccgacgagacgacgcacgatggatcagtgtatcctccctgactgctcctgcggcaacaggccggggatgaacggcacgccgaactttgggagccacgtctgtccctggatgaacctctcgacggtgtacttctgctgcgcctgctggtacgtgaccgtcttgacccctctccacttggcgcgcttgctcatgtcggcgccgtcgccgcggttctccacctcggcgtagtagcaggtgttgaggccgaagtcgccgagccacggcagccacccctgcgggtcgatgaacccgccgatgtcggactggatgtagagcgtccgcgagtactccttccacgggcggccgaggaacgtcttgaacttggcggcgtcggccttgaagtcctcgtgcggctcgatggtgcagttgtggatcaccgtgccgcccgcggagtgcttctccttgcgcccctgcgccgtcacgatgttctgctggttgtccatgcaccggcgcacctggatccggcagttctggagcaccacctgcgcgttgccgaagatgaagtcgatggtgccggtgatggtgcagtcgcggtagtactgcctgctggtgtgggtgtagagcgtgtcctggtgcccgtcgaactggcactcgtagaacgccgactggtcgctctgcacgcggagcgccaccgcctggtggttcttggacccggccgtgttctccacgccgatgccgcgcatgaagaacccgttgccgatcgcctccatggtggccgtgtccttggtggtgatgttgagcatgaagctcttgttccccgtgatgatggtcttggtggcgccgtcgccgatcatcaccaggttcgtcacgttgcgcgccaccgacacgtactccttgtacgtcccggccttcacgtacatcacgtacgtccccgtgctcttgaccggcaccttggccagcgcctcattgatggtcttgaagtcgccgctgccgtccgccgccaccgtcacgtccggcttgaactccttggagcccggggtcgcctccagcagccggcgcttcgcgttggacatccacacgggcacgccgtcgtcgccgagcagccggcggctgaatccggtgatgtccaggttcgccagcgtgtcggcgaactggtccacgatggcgaggatgttctccgtcagctcctgcgagctcttgagcgccttgcgcatcttctccgacgcctccgtcgacgtagagttctcgaacccgtcgaggcacgtctcctggtacgtcagcgccgagctgagccacgtcttgacgtcgtccacggcgcgcttgaagttgctcgtctggaacccgccgagcttgtcgaacgtcgtcttgaggtcgtcgatggcgtagtcgagcagctcctcgcagtccttgagcgcgtcggacgtgcgcgggtcgttcttgaggtcgttgagcacggcggactccctcaccgccttctcgatccgctccgacgtcgccttgaagatggccttggcgaggtccgtcgggttcgtcgcgttgcccgccgtctgctccagcgtggtctcgcacgtctcccggtagtccaccggctggcagaacgacttgatcgacttcaccgacgtcgacagctcgccgtcctccttggcattgctcgacccgttcttgaacgacaccacgcacaccgccgccaccaccgccaccaccagcacggtcgacgcgccgatgatcgcgcctttgctcattgcaacacaatgcaaccaccagtcgacgattcacgcgagatatgtatcaaatgatcgattttgcgcgcgcgcgcaaaggcgtcgggatcgatcgatgcgtcgtcccctaccagcggaaggggtccggtttattcggtctaaaaattggagcaacgaggaggaggaggaggaagaggaggaggaggcggcggcggcggcggcggcggtggcatctcttatacgagcccgcgctaactttggacatggcgaaaaacgacggtggttgcgcatgggcgtcggaggtcgccacaggccgaggtgaatggagagccacacgacggatgccgccagtttgtttttgctttgctcgtggggattttctagttgcatgcaggcaaccatctgaaattttgttgtgctatcggctctgaaattttgttgtgccgtactgccgtcggccactaccaagggtgaagctcctggagctgctattggtggagctgcatgtaggcgccatgttgaatgaaggccacgccaatgtgtccgataatgcttatgcacgggtgcccgatgagagagaaaaatatccggcgctcgcacgtctcattccacgtcacttggctccccacacctcgctcggctcgcctcctctcccccgttcggcgccgcctcctctcccacgagctctctcgcttgcgccgccgtctctccccagccgacctcacccgcacagtctcctctcccgtcaatctcgccagcgtcgttttctccgttggatctgccgccgctttttgtcttcctggacgttgacggcggcttcgtccccgtggtggcggccgacgcggaggacgacacacgtgcggtgaggtgatggcggcggcggtggtggtgtaggctcgccggctccctctctcccccaggagcactctctcctcatctccgccgccctcccccttctcctcctacagatccgatgatgggagtggtggagaagacctacgcgagcaagcctgtgttcatcggagagaaggaagatgcagtccatactaggttctgtgtgtttttttttctgtgtttcaagctagtatactcgtgatgttcttttgtgtttggatcaaatgtcagtggatatttcgatagtgttctatatttctattttcgacacacaggttttgttgatgtttcaatggttcaaaaacaatgtttcagttagtgtacttgtgatgtttctttgtgtgtgtgtatcaaatgtttgaagtggattttagatagtgtttaatattttcaaatacacggggtttgttttgatgtatacaaggtttaagtgtttcaatgacttaaatcgtttattgtatatattgaattaaattgtttcatctaactatctcactatgtttcacttttttttaagaactgtaacatttttttttctaagtgctgaaacatctattatataattaaaggaatagaaaaaggagcctccacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatataatccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagaatctgtctatatagaaatacaattaggaaataactgaaattcggaatgaaaaaaaggaatattagaagaggagactagagtccatatagaaatacaattaggaaataactgaaattcagaattaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgtaaaatttaaaattatgttgtcattttaatatatttgaataatataatgagaaaacatatatgctattatatgagagaaaatataatgatgctagccgcgcaatctgcgcgggccactatgcttgttatttttataaagggtgaaacaatgtccaattttaaatcgggcgtccgaatttgtagacggctaggcgcctcccagtacgttgcgtaggatgaaaccatcgttcaggccggttaggaggcaaaacgaatcggtttggtagttgagggatacatatcagactcgtcttattccatatttttactagtatggggtgggagtggaagaactcgaaaggcccataactcagggactagctagtagaacaaggaggaaaggaggccacctttttactcagccttactgttgaagtgtcgatgaaaaactgaaaacatagataagtccagcaagcaagtggttagcctcttaaaacgtgtcgacgatgatgtatcacgtcacgtacgttctcgtgcagatcaaaaggggaggctagcatacacggcctcggcctgtacaagttgtactctacggagacagcgacctcagccctccgagacgcaaaatgggacgggtcaattcacccaaaagttggaatacttggggaaatgtcaagggctgtgctctcttaaaaaaaaaccatcaataagcttaaagccaacggatcgattatacgtcaagcatcacgtaagtttgatggtacttcctccgtttcacaatatcattctaacattatatatatatatatatatattgatgttaataaattttagatataacatcaatataaatgtgaaaaatattagaattacttatattgtgatacggacagagtagtaacaaaggtgaacgtctgattacggcttccctgccgcattaccaaaatggaagagagtggcgccaaaacacgacaccagcttgcttaattatactactaactcccaaaagattaaagaaatagagggaaaaaaatcgaccggtagattgccggattgttatctgacaaatctcccaacgggagatattttactcccgtgtacggatacttcgagtagcaccaccgctgtgtgcacctctcaataaacaatacccatgacatgcagggagggagccgaaagaatgtcccagtactcgtacaagaaacatctcgactcactctgtcctttttttccccttttccaaaacgaaatcgagagggggaaacacatccacccgcaagatttttttcgatggaccaccagatggcctcttttccaaactgctacagtactaaactacgtctacaaacaatctgccatgcacgagatgccccggctcgcatgatcgcccccccgaccggccattccggattcccatctctccggagccagcaaaaatcgccgaaaaaatcctctggtccaggcgacccggcaggcccagcagcaaccgcaactttgctcgccggaaaaggcgcccggcccaccagccacgagcggggcaatcccacgacaccaccacacaagcgcgatcgtgcgatcgtccaatccaacggcgtcttgttagcgagcgttgaaggcggcagcggcgtatcgttttcggtcgtacggctgcaaaagagcactccagaacacctccagtgcacatccatcgcccacacgatcttgacgcgcgcgcgcgcgcacaaaacacacaaaaataaacgtcaatttgcaatcgtcaagagtagagagagtcgctagaaacatcaactgatggcaacatccacacggcgtcgaggaaaagaaaccatttctaattgctgcaagatgccaaaagatgccagcccgagaggcagagatcactagagacacatcaatagtagcaccagtagtgtaacaaattgggaatacactgtgggagtaggacagggacaatgacacaggaaggcagaagaggacgcatgatgaacacatcaacaagagagtgaaattcaggacgaaatgtcgacaagatattggaatctttggccacgcacgcaccaattcttgggtgacgcggccggaatcgaacggcacacccgacccaacccaacccagcgaactaaacggagtcaatcatctgatgacctaaaaaaaagggaaacaaattctgccaaattttattggtttttctttcccgtttgcttcctctcttcttctgcttgtctctcttttcatcacttagaggcgtgtgcacgtctcgtacaccggcgcgccggtcacctgcgcgactgcgccgggtagggcgcgacgcgcgtcctccgtgtgccgtccgacggcacgcggccaccgacgccgccgccgcggcttccgccgtcgccgctgacgatgtcttgcagcatcttctgcaggtcctcgagtgtgtccggcttctgcacgcggcgagatcaccggtcatcgcttaagtatgataactaagcctttttttaaaggtgataattgtggcgattacgatacgaattggtagagaaagtggttgcgtgctcaattgcgcctacctcgtttttcacgttatccatcatcaccagcatctcctgcatgaaatcggagaaatcctggccgtcgaaaaacagggcagaattttaataaagaatattatatactaatatattttattgcactattagccccaaatttttttttaaaaaagaatgataatattggttgctacgcaagaaaaaaaataatcgaggtttcacctggtcgtcgtcgtcgaggggatcgaacagcccggcgtcgtacatggctcgcttccccttgtcggacagaactgcagcaaccgcgcaaaaaaggatttcgttcgatcatacacgtagcgagcgcaaactgggggcggccgagcgggtgagccttaccggagtacgcctcttggatccgctggaaccgccgattggcctcgccggggtcgctcacgcaccggtccgggtgccacttctgcgcgcgcaaaaaaaaggatccaattcacaacacaatccatcacctacgcgcgccggcgcgggcgcgggcgcgggcgcggccgacgggggagaagagagcggaggcgggggacgtaccatggcgagcctccggtaggcggcgcgcacgtcggtggcggacgcgttcttccggatgccgagcagggagtagtagcagcacgcggacgcgccggcgccggcgccaccggaggcattgccggatccggcggaggcgtccatgggggtgcggtggcgggggcggcgagcgaatccgcgcggcgaggagggcggggcgatgcgaattgctaccgcggctgcatcgaattgggagggagaggggagaggagatgggtttgaagggcgcttggaaaaagaaaaaaaaaggttattattccgcgaggaggagacggatgcgtgggaaaatatctaaatagagtttttggtcgtcgggggttggggccaggtgaaggttcgagagctcgtgccgatgcgagatattttcgacgcccgtttcgggcttcgccctcggggttcgcgagtatttacgagtttgggattctctctcgcggcgcgtctgccttctagagccgtgaattacgctgcgtgggctttgaagatttgggctcgtcggggcattaggcccattttccctcggttcaggccttcaggataaaattggttgtgggcctttgctaccagctgaggctcattttgaaagaggatatataaaggactttttaaattaaaaaatggatcttaaaggatatttttttttcctaaatagttctttggaacaaaggatttgataccattgaattttatgagtttcctttggaataggtccaaagttagcatgaagttcaacctcttggaaagtctcttttcatccaattcgtatgttttcattcggtccgtccaaatggtttcccttatgttttgcttttttttttttgtataggcattcttgccaacatcatgtgttttaccatcgttgtgtgattgtgtctgtgatagctaacagttacgaacaccatgattcttttaagaaaaaaaatcatgtgttataccatccctattgtttcaaagagggttaaatagctcgcagttctacataaaagtatggtgaaacaacttgtaatgaaaagcattcccaataagcatgatcaacaggcctgggaagcatgatagagatctgcaagttaagagtagtatgataattcaatgagctatgcctggctaggcatggttgaaaaaaaatcctatgtgtttggaatgatacaggcggcagggaaaagagtacaactaagaaaataatacgtactgagaggattagttccatactcagtacgtacttgtatggaataaattagcctcaatctccatgtgagggtttaaccgaaagaccttacagtctttacagtcttacatatgctaacccgcgaaacaatgtccacttacatcccaagttcagagtacaagcaaaaatatccaaatctgaaccagaacacttgattaatccacagaacataaggtgtgagaatcttcacaatgtgggaagatcacatatccaactccagaatagatggaacagaatttatatcacatctcctattcactgttacagttaattactccataaccattgtaaactgtgaatgacatcgatattcaatgtcagtcatcaaactcccatgaccattgcaaacagcccaccttcctccagcgatattcaatgtcagttatcaagtggagtacttgtagaacaatatacttcatccgtcctaaaaataaacgaatctatagatatgatgtgatattttataatataacaaattttaagatatctttgtacaaatttgttgtactagaaaatataacatcatatttaagattaatttattttgggacgaagggagtacaccgttgaatattttcaaaccaaaataacgaaatgcgtgagagttgatagtaaatatagtttgaagctaagcctcttgcagtgaattgtaccaaaattatcacaagaaaaattagccagccacatggggaaccagctactcctacaacagtaggaaggattgatacattattcaggcattaggctccggacacctaggatcataattcctccgaaattgaagaaatccatctctaaacaattaaatcggaacagcacaatcatcaagttacgcaatattcggacctgcatatagcattcgaagattattagaaagcaagggaactattaagcatggtttgattttgaccgaaacatcagagaaccagatgatctttgacagtttcacggaagtaggcactgccccgctcaaaggaacattttttttttaagataaccggcatctacacccaaaggatgtgcacagctcaaaggaacatgcatgaaaataaatatagaatatataatgatccgacctgcctaagataattgcgatataaaaacctatagaaacaggagagctaaacataaagatcacctaattaaagtttggcattaagcaaaagcaattactcaaccccagaattgccattcaaagagataaatgaaaattcgcatctaaccaactaaccaagatcttcagaagcaacgcataactgaatcccaaaaatcctaaggaccttcttcagactgagcaccacaatcgaaccaaagaccatcgacatgctagaaataactgaatcccaaaattcccaaggaccttcctcaaactaatcagcataatcgaaccaaagaccatcgacatgataaaaacaacacagtagcactactcccacagttcaccggagcaaatcgacagaggccggcatctcattctttatacgggtccctctgagctctctgcatttccaagttatacaacgcctcttgcaccagagccgattgggcagcagcatccacggtagcaggagtttgctgccacatcctatctctgatctcttctcgcaggcctcttatgaataatgccacgtcgaagcagttgctggagactggatcgaacagcttggcatggtacaagcgctcctcgaactggtctctgtactcgctcactgtcatgatcccctcctgcctcagatccaagagtgccgtgagcttctgcttgtgatcatagggcccaaatctctcctccacggcctcacagaaccgaccccaatcacgctcatggcgcttctcataggtcatcatccacagctcagccatcccctccatgtgcatcgaagcccaggaaacccacatcttcattggcatgccgtagaactcgaagtagcgcgtgcacttggtgatccacaggcgcgggaacgtcccgctgaaagtggggaacttcagcttcgccagacgaaagaaccctcccgagtagccgtcgatcctggcggcgcgcgacgccgccgccgccgcctgctccttcttcacgtcctccaccagcgccgccgcaacggcgatctgcttggacagctcctcgaggcgatgttggtgcccctcgaccacctggctgagcaagggcagcgccttcagctgctccgcgatgcggtccagcttcgcctccatcttgccgtcggggagaaccgtaggttgctgcggcccagaaatttcgagacaaatcaggtccgatgaggtcggaggcgtccgcgaacgagacaaataattaggttttcaaagatcaaataaaccatgaagaagacgaataaataaagaacactaaaagagaaaaagaaaatcatggcgcgggtcgagaaggggtggttgctacgacctcaccttggccttcgttcgatcgtctcgtctcgtcggcgtcgccggttgcgctgcaacctgctgcggcggagcacgcggaagcggtgggcacttctccatctcctcggggagaggcgccagcttaagatggtgtttggttgttggggataaaatggagctaaattttagtccctcttaaaaaaatataagtccctattatagggacttataattttcccaaacagcccctaagtgcttccttctctactaagctgggccaagagaataggcccatgaagattagggctttctatccttctactgtactttttttttccaaattagatttcttttctggttttacaggcttcctatatattttaggctgcctatattttaagggtagagaattacaaagttgacaaatacttatacaattatcctcaccaataatgttattgctaatatgttttggtcttacttccttcgataataaatctttgacgttgatgataaattttgaattggaaatcttattatgttgcgttcgatattttgcacaaatttatcaaactaataaaataactaggggattttcccttaaaattttgtgcaagtatatataattgaaatataattatggatacagtatttgtaatttctactccagcggtccctaagtcaagatgcatggccaaaaataaggtgttttagggggggtggaggtagtacaatagtagatttacaaagtaaatttgaatcatatacaactcctatacaactcctagcacaccggcgagctggcgcccggctagtggccaaaacgacccggtgtgctagcggccaaaaatccaataatcttataaattcaatatcttcccaaccgtaaatccgtttgactccgttcaacttccaaaattcctcaaatctcgagatctatctaatggcacgcttagaggtcattaatagggctttattttcgccgtttgttgagttgtcccattttgcgtgtagtttcggagcccgaagacccgcagtgcgaggatttcgaggatcaagctcaagatctcgagcgaggcaagccacctttgaatatcttgagcctatatttgaacttaattatgttgcttgaaaaatattatgcattgataggatcacacttaatctgcttgtcccgtctgcaaggcagattggaggacctacctatttgttgcatttgatccttcctctgttaattgttataccatgtttccttgtaaccacctagtcacgcctcggaaatcgtgcactctgcacaagtatcgacggtcgccttcaaacctaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacttaagacaagtacgaccacatgggtggaatgggacacccctggctgagtaactagcttatcaggggagccttgatgccgagagacatgtggattcgccggggtggtgtcggggaggacccccgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctgggtgatccgggttagtaatatcgtgtgggtaaagtgtaccccctctgcagaggtgaacaaactgttcgaacagccgtgcccacggtcatgggcggatgtgaggtgattcctagcgtagttttgtttgactactgccttatgaaattgctgttgtggaaaggggatcgatgtttggaaaatctgcagctgatgggatcagctaggcccgggtggccgtttgaaagttgttggcccgggtggccgtttgaaagttgttggccgggtgccaaccttgaatcaattcaaaagactgatacattgcacatactccgaccggacgagacgcattgtctcatccgtgtcgtttgagaagcactcacttagttgatttcagaaaagagttcaaataaaatcaattgcaaaaacaacagcctttccttgaagcctgcattaaacacttatttcccgtggcttgcagagtactcccgtactcacccttgctctatataaataatccccccagttgctgaagaagatgaagcggatcccgctgacgaggagttcttccaggagcaagccggctacgatgagttttagggtttcggcctagttcccaagtcgcgcctgtcggtgacatggggccgggggtatcgtgactagaggcttgggtagccgcggtcacccacgtggcctgaccccctcgggggggggggggtcgggcccgacggtcgtggccacccctccctctgtctccccgaggggtcgggccgctcccgtttcggccccgagggctggggtgccccgaccccttgtggttttggcgccacgtgtgtgggttaggtgagcacagcgggctcacctaaccgcatttatagcaggttggacgagcgcgccacgccgcatttaatgcggcgcagcgcacgcttatccggtccgtgaccagtcgcggtgtgtgaccggtcacataccggtcagatcgcgggttaggtggcaacaggcggcctgtcacacgcctcgccctgtcccgtcggaatgatgagagcttcctggctctcgtccctagccggagccggcgtgctaactcctggagttggtatgtcagtcccggtcagatccattccaggcttcagcgcaagtatggcaaggaagtcgctggccattaaatgaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccttgaccagaaaaaaaggaggcccaggcctaggaagaaaagggagaggaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtcttgcgcatttcttctctcgctgacgttcctcagatcgagggcgaagaacctcacttagcgcccccggccgaaccggtaaaggggggcctgcgcggtctcctggtgaggagccccacgctccgtcagcgcctgtgatgtttggtccaagtcttggcttccgcttcccttttgtaatgcagttgtgagctcgggatctgtccgcagcccaacatgactgtactcctactctataataaacaaacctctattgctgtgatattctgtcttcctgtgataccagcactgtttcctgggaccggtatcgattaacaggttaatttggagcgtcacgggctagttccggtcgggactagttcggggcgtgacaatacgacatataaaaattgttaataaaacaccaaatagaatcctaatgacgattaaaatgagggacgacgggcaggccgtaaagcaaacgggcaaggcggttgccgggacttctagaaagtaaaaaaataaaccccattgataatcatatttgatttttaaaatctcaatgacaataaaaaggagaagtagcgggcggggtgaataggagtatagttgcagagccgccgatggttggcgggacttctagaaaataaaaaatgaattccaacgatagttatgttcgatttccaatgaacaggtcgtagaagagtataatggcagcgtttgacaggacttctacaaattataaaaacgaaacccaatgagacaataaactctaaaaactataagatccaagttttaaaggttgcaaggagaataaatagaaatagtggtagatcgagtaagaaaaaaaagaaggatatgacagaagtaaggggtagcagctggtgtgacttttaaaaactatataattagaaatacaaggataataaggtttggtctttcaaagttttaaaataacgagatagtttttaataaattttaagtaaaatcatattgaaaaatatatgatttcgtttgggtgctagccgcgcaattacgcgggccaccagctagtttatttagatgttcacgtttgcatctcgcaaatgctgccgtatcaaccacgtggtgacgactgacgagggcgggctagctttccagtgggccacaactgggttgggaaatgagttccatcccgaatttggtttaatggacggtgagggttaggctgggctggattagctaaagctaaagggagtttgactgggccaacaattttgtttcagtttcttggtcaccgatatcgccattggctcaacccgcattgccctcgacgacttttgcgacatgccatcgcgaaaaaccctaaaaccagttccgatcttaagattctgatacaggcatggaatccatgccatggattgagaggctggtcacaaatcaccacgaagaaaaggggaaggggctttttgggcaaacgtgctcctattctgacggcagtagtcggcgagtgcggagaagacgacgacgacgatgcctgtttggatgaggacgaggcaaattctgtgtggctccgagtagaagcagtggatcaccaaatgaggcccagccctcaagcacacgtttatcaaccaagtgatatttgacaaccccttgaccaaattaaaaaggcccattaaagttttccgtataaacaacattttccgccgtcaagttttcaatgattgaaggaaagcagaagcacaacgagcccggaaggagtatatttttcagagaacacaaatcagtaagatgctcaggatttcgcatctacgttttcaggaaaaacaaagcatctcgccatgcagtttttctttagctgaaaggcaagaccagctaattgccaagtagaatcgtgctactcctgcatgtttttttcttttggttgtttggcaatctaggagaccggagctgctgcctccccaatgccaaaggatatgtacctacctttgcacccaagaactcaccatgtgcacgcacaccctgttgctttattcctgggcataccactgctgatctcaacgagtgctctgccagcctctgcttttcatttctccctcagcccaatcatcaattagatgaacagaatatgaaattatatgctagtactcctactaattaagtgagctttgcaaattgccttgcgtaaagtcaagggatcatttgcagagttgaacagctcaaaacctcgcctcaaggtcaagggtcctcaggacctcaaggaccatgtaaatggatgagctcctgcgtgaaaccaatcagggccaccacatggaaggttgttggattcagacattcagttggtgcaatgaactgaaagtctgaaactctgtccgagccgatgccaattactagtaatcctatcagttgtcattgccaattaggagtagttagtgctgccatcatcatggccttatgatcaaaacggaccggataaggctgtatacttagaagcatcatgatcgtaggcctaccaaaaaaattctgcttgcacatattacaagcggaaatatttgggggtttcgatcgtagaaaagacaaggccctgtcaaaaaaaatcgttcgtggcagctttgcaaccctagagcgacaggtaatggcgttgtcgaagccagctgtagtgcagattgcagaagcctactgtctttgaattctccatcctttttttctcttcttctatgattctatccgtagcacaattcaatgcccccgtagatacaagtatacaacacggaaagacaatctagcacgtcgcagcagagagagagaggaatcaatcaatgaacaaaaagctcaccctgtggacacgtgtcgggctctggaggcccccaagcgtccgcgtcaccaatctcgaggcggccaccgcggagcccatgcttacagcctggcaccggtagtgacgccagccaccagcgcagcgcgcgccgctcgctcgctctgcggcgcaatctgtgaccccacctggcagtgacacggcgcctccgcgaaacgcaacggctaaaacgtggaaggccgcggcggcgtcgcgcgcgcgcgcacgttgggacgtcggggagggaagcggccaaggccaaagacgtcgtcgtgggcagcagctggtgaaaaaaaaaatggccttcaaaattcgaagcggcgacgttatcgctctctcgtcgtgagcggggcgtcgtcggctccggtggatagtcaacggtcgacgcgaggatagttcaggagcggataatagttaagaaatcgttgagattttaccggcgttttttctcccagagatggttgcaaacgcagttgatttattaggactttaggtatatatatgtaagcttttcctttttctcgcgacatgtggccttgtttctgttggccgatcgtgatcagcgtgcacttaccttaggaacgggtttttgattttgggattaaaaatgtccttgatcagtactacacatgttctcacctttttagttctcatttctgcacgagttaaggatagtcaagatggttacgatcgcaaggtgagtggatcaaccacactctctgtcatgttaacatcttgctctctctctcttttatttactgtcaaggcgccgtttactttgtaggggtcgtactgttcatatttttcctttcgtgcatttgacgacgacttctcagcaataactcgctgcctgaacgtgtagtgttaatcatgttactcgcctacaaatggaaccggaactctggaagagaaaaaaagaagtatttgcgagaaagaagagtagctggaaatttgatacggtcgttttagggttgaattgatatcagatcctaaattctctctccaaaccccatactaattcggcaggatatctttcacgataagtactttcctgattcatctccttatctcaattaaacgataaatatctcaaagaaaacgtgttgagcggaaccagattaaaccgaaattcacaacaactcccaaatgtcgcgcgaaatatactccattttttcttgttagtacggaacaaaaacaaacacgaaactggagctgactgagctaaagagcagtaaaagaagcgatccgcttgacggtgactattacggccgctgccgcccagaggcaccacctcacctctccccttccacttcgctagcccgcttggcttctcagagcctggaggaaaaaaggaaggtgggagaggcagcagaggcgaggcgagggagcgagcgagcgagcgcccgaatccccaaaatcgcagcgcgagaataaacaaaaccgaagcggcagcgggagcagcagcatcggcggatacaataagcaaggggagcagcagccacgggcaggagaggagagtgcgcaggcgtgcgggagggaggaggggggaagaagaaaatcgcctgcctgccgccgcggtggtgggttggtgggtgccgcctcctcctgctgctgctgctgttcccccattacctcgccccgcttcgcatggattccccctcgcttctcccccactccacccgccgatccaccggccggggcagcgcgaggcgatgcaattgaggtgaggtgagaccgccgcttcttccgtcgtcgtcgcgtgggttttttttttctctctttggtgctgggggatacaacaacctggcggccgcgctgccgctggacgacgccatcgcgcgcctgcacggcgtcttggggtggacgaggcccagcagccgcggcggcggcggtgggaggaagaggtggccgcgcgggggaaaggggagcgccatgctgtgggcggcgcgggtgtccgggttcttctccgccgccatggtgatggtggtgctgtccccgtcgctgcagtccttcccgcccgccgaggccatccggtcgtcgcagtttgacagccacgtccgcttccctggccagatcgcggggggcgccaggggcctcgccttccgtcgcgcccccgcgttccgcaatgccgctgactgcggcaacgccaccggcaatgtctgcgacccatcgctcgtccacatcgcgattacgctggacgaggagtacctcaggggctccgtcgccgcggtccactccgtcgtgcagcacgccacgtgccccgagagcgtcttcttccacttcctcgtctccgacccggcgctcggcgacctcgtccgcgccgtgttcccgcagctccagttcaaggtctactacttcgaccccgaccgcgtccgcggcctcatctccacgtcggtgaggcaggccctggagcagccgctcaactacgcccgcaactatctggccgatctcctcgagccctgcgtgcgccgggtcatctacctcgactccgacctcgtcgtcgtcgacgatgtcgccaagctctggcgcaccgacctcggcggccgcaccgtcggcgcgccggagtactgccacgcgaacttcaccaagtacttcaccgacaggttctggtcggacaagcagttcgccgggacgttcgcggggcgccggccgtgctacttcaacacgggcgtcatggtgctcgacctcgccaggtggcggcggacgggctacacgcggcgcatcgagcggtggatggagatacagaagtcgccggcggggcgcatctacgagctcgggtcgttgccgcccttcctgctggtgttcgcggggcacgtggcgccgatcgagcaccggtggaaccagcacggcctcggcggcgacaacgtgttcggcagctgccgcgacctccacccggggccggtgagcctgctgcattggtccggatccggcaagccgtgggcgcggctcggcgccgggcggccgtgcccgctcgacgcgctctgggcgccgttcgacctgtacggcccggccgactccgccgcggaagggtcccggtaaccgcaacactaaagatgattcttttccttctttcgccgaccccgtacaaatttctgagttctcaattcttctccaccattacctgttcaaacacctacatgtttattttttcttcatttcttctttcttttgttctgttcgattaaatgccttgtgttagattgttcttgttggtattagtgatctcttcttccactttttttgatcgttttgttactaaaaaaagaggtcatttgtatcctactctacaggtttggaaggcttgcagcctcagcatcatcataaataaaaagcacagaaaaatagacattgcagcagcatgtgttcttcttcagtcgctcctctttctcccctctcaatctgtttgttggcttcagcttcagcttcactctcgcaattgatccacccatccatcaccaagaagggtcagccgatccaatgcagcaccgcacaccatcactgccgccattgacaggttttacactaacaaagtctaagtcgcaaagacgatcctaaatcgcaatcgcggacaagagtaacttggaatccacgtctttgtggccgtgcacgaactgacactaacaagcatttcgacattaagcacttgcaggtgataattatagaggggggcgttgccgttaagctctcgaggattaaaggggaggaggggagagacggagatagatggccggtgggggcggccaacacgggacctgtgagctaccgcccaagatcatttctttttctggggtcctttccggcggggcctcaccacttcggcacactcacacaccctctctcgccgctttattcttttgcaaaatcattattgtgctcctcctctcacattgccaatgccatatgccatcaaagatttcttttctttaatgttcttttctcctccttttcttttcgcacaaacaaaacaccccctcaggctcatctcacctcatcttcaccacaactctatagtagaggcgtcaagaaccttttgttttttttttattgatcatctcactttccttgccagctcgcacttagcatcgacttgtcgccctccgctaaatgcgtccaaccaaaaaatataaatatatatctccccccgcgaccgcgaggctgcgaagattgtagaagaaacatttcgtgtcatttggtacatggaatcgtcctcgtcgctggcaggtggggccatggtgaagggcacgtcccagctcggcgcgcccgccacacgcgtcggtctccgcccgtgccaggccgcgggcgagccgggccgggcgcgggtgtggctcgcgcgaaagtgatggtctaaccgacggggttcttttctgactttacccgtggcttaatcgcctgcttggattcttgctgtgcttggagttggaattggagtctgttcgtaaatcggattcgctgtgatgaatctactccgttgcgtgccttgcgatcgaggtgttgtgccgtataaatgtttttttctttcctttggtgggggttctgacaggtacgtgcttctgctgctgattactactcgattttattcgtaaagctaaagctaatcagcacctgattgactagttgtgtgtgtgtgtgttttcgtactagagagtccgtcgcgcctaatgtccttgtcgttccattcatgctcttcaatcaagctcattcttaattgcagacgatgctgatttctgttggtagtaatattgttagagaagaggggagccgtatttctttctttgtttctgtcttttgtacactttaggttaacaatgccagttgctgtattgtagtatcatcaccgaaaaagccacaccacctttatgccgtacctccggcgaaactgtgtctctttctcctctcggtagaaaaaggccctcaacaaaatgttgtgtcctttccgcggaaaccctaaaaatgtactactgcgcagtacagaataccggtgctgtctttctcctgacccctgtggactgtggagtgccgtattgtgatacgctattgctcgcccacgatggacgacggaacggatggagacggccatggagggggcggccgcccttgattgagagcgaactgcgcgccgtggtcctctcgctagtagtctctcctcgccgcctgatgccattggcattggcatgtcacgcggcggcagctcacatcatgggacgcgcggtcttctctcccgcctcgttccccgtcggttggcatgtccgcgtcgccgtgcccggtcgcctccgcgaccgcgagtgaaaaggaggttcacgatctagtagtttttgttgccgctgccgccgaagcgtaatactccaacgtgatgcgtcgtgacgcgcgtgctggtagtggtaggtaggtgcgcgcgcgcgcggccgccgtgccgtttgtttctgtcgtcgaggaggccgcggcggcgcggccggctcggtgaggggtgttcggttttttgcctagattttaccatcatttagcatgatgtgcagttgcatcaacgtatggacggaaggacctggaccacgggggaagtatgacctttggagtttggatagttgacccttcttcattagccgggctaggttggttgcccacaagagagggattccaaaatgtggggataggaacacatgctgttgcgttgggtggatctgccaggaaagaacggtcgatgctgtttcagggttcgcgcgcggtagccatgttccgtggctggggggtacattcctgtttatcgatctgtggctgttaaagattttccatcctgggctgcttggtcgctttggatcgaatgtcgctgctgaattatgcctggaggtgtacggtgaacaatggcaaggacattcccaactattgtaaaacgtgcaatcatgctgcctataggtcgggtgacgaggcatgcagcaatatgtttgggtaaattccagcgtattccctgtgcaatattgcaacgtaatccgcatgctttgcttgtccttgccgtccatcagccatccattcttttgctccaaaaaaggtcgaatatattgccatcatagatgcaacaggcaccttccatgctccaatgattccatccaaggcttatcatcaccctcgtccttagcaatggtcgccatttgtaattcacccaaatctgtgattgcaatctaatggagagaaaatctcttgttcatatcaaaggtatcatcaatccgcccccacgcattagcataccgccattcatgtcccgtttatgccatggaccgctgataagaaggacgtagatacatccaggacaagttaggttaggcccctgctacatgatctgcattgcacgtatgcggataaggctggaacattttggtgtacctgctctccacagaactaaacatgacaaagccagaactcttatctaggtctccctaccaaccatcactggaattttgttagcgagtacaaaccgaaaagaaaaaaaatcttaaatcgtttattatactatagatattagcctgtgttctatgaaatttatgacattatgtgatacaaatgagcctgaaatattggtgagcttgtcagagcaggtaatagcaggttataagccatctataaatatattttaaagagataaataaagagagagaagagcagcgggctacagatttgtagccagctgcagcacagactccaaacgtaatgtgtatatgacaggtgggaccagatattaatagtatagtaagcaactattgtatgaattggctattacattggctatagatgatttagagctagtagtgagctgtaatattgaccttgctcttagagcaagtttaatagtatagctcactgcttattattagtcaatgttaaagctaacatgtatagtaggttggctataagatcatttttattttcttcatcctctctctttctctcagtatgaatttaatgcatatttcttgtagcttgtgtatagtgagctcttacatgagagccaatacaccctacttttgtttatctctctcttccacataagcatatagcttgcttatagcccactattatcttgctcttatacgtggtcgtccctacgtactctgcctcgggaaggggggctcctactccaagtcacttgcagtggcagcaggagtcctccagggttccaggctgtgaagccagcttatccaaggctgtatcgctttgccgccgcggtctccgccatcttccactgcgctgccgcttgcacatgcaaatatgcaatgcaatgcaacgtctcttatcctaatcgctttgattgcctcacactcccctaatccccttcgtaaatcccaatccttccccaaatgcaagtggatattggcttaattcctacgtgtctcaaatgtcaatactatacactaaagcattctctcgagccaagggggaccctttggccgctttggactaactgcaggggaccatgacacacatacgaccctgcagtatggtcgtgtatatcctagccgaaaatggttggtatgtgacaaactatacaggatcagagaggatgagaattgcgtgttgcaagatttgacagatatttctggaagaacaaatggatcaaaggccacctactcacctgataacggcttaattagtccatggggatcgaactcatacgcctggcagctgcaagagaacagtagtagggtccatgtatcgactctatcatctctgtgttgatgctgagattgctggattgcagttgaaggggacccatttcctctcgctgtccatttcttttgtgtacggctatatcaccatctgcatctatcgcgaccgtcgatgatgagatcatcggctgcgagttgtaaatggacccagaactgttgatcgctaaacaggacgacgtgtgtgtatccaccagggtttacaatctcgtttggcgattgaaatgtgagccctagcaagttgacgagtcttgtgaaatatttgagcaaaaattaagaatttcaatgtaagttgaaaagaaacaaaatgtgaatataaattttcagcgactgtgaatcaagtaatcaggtatgaaattcgattaaaatcctagaaatttggaagtattagttagaaaaaaataaacatgaggcgataaacgaggggatcaatagcccaaattaaattcaattatgttttcctacaaacagacatatcgcccaaaaaatgtgagaaaaaaaattagaaaatgcaggagaaatgaggagaactttaaaatatgtggcaaaaatatagtacaaaattaggaaaagggatggggaaaggtggaaaattatgggaatgcgtagagaaatgtagaaaaatattaaaccaaatattaccagttccaaagtataaggaattttacataaacaactactttttgatgaaggtagtatcattttttgggggtggttggtagtatcattttttttattgaactgatttaattccacttgatatcaaactgtttataggatttaaaaaaacatatttctcatttttcgaaagggtagatttaccgtccttgataatgtaccgagaagtaccacattttctagtgtaaaatttggtacctctagctactaagtatcatatgtaccaaaatttctagtgtaaaatcttgttatctctaagtactaagtatcttatcttaatgtatccgaatttctagtgtaaaatattaatacctttagatattttctcaagaactgtaaaatttctctatttgaaatggccgtagtccattcgaaattctagcgaaatgttgtttctatgtggatcgagaagttcatttttgcgaaatgtgagaaaagtttcagcaaaattacaaactcttatagcatctccaacaacatctccaaatctcactctccaaatatgcatttagccaccttgacaaaaatttggatagtcaaatctgcctttcactccaacagcctctctattacagttctccactgtaactgtgggtcccacgtgtcagttttttcacccttcttctccacccccctctctctctctctctcttcttcttcttgttcttcttcttcttcttcttctcctctcatctccgccggctgaacccgtgcggtggcggaggtgctgtggagcccgcgtggcggagaagggaaggcggcagcgagggaggcggtctgccggcgggagcggcgcacgcgtcggaggcgttgtggagccgcgcgtggtggagaagggaaggcggcgaggggggcggtcggccagcgaaggcgctgtggagcctatgcggcggagatgggaaggcggcggcgagggagacggtcggccggcgggagcggctgtgtggcgatgggaaggcagcgacgagggaggcggtcggccggcgggtgcggcgcatgcagcgatgggaaggtagcagcgagggaggtggtcggctggcgggaacggcgcttgcgcggaggccgatggcaacgacgagggaggtggtcggccgacgggagcggcgcttgcggcagaggccggtggcaatgacggcgcggcggaggaacggtgttggcggcgcgcagaagggcggcacgcttgaggagaggcggacggagtgagaaatgggtgggcccatgcgtggggcccatgattagcaaggcaattttggctggccatctttggccaatgaggggagccgaccattatattgaagaccgagtgagccgaccaaggcagtcttaaagaaataggagtactaattagggcgtatggtttaagttgaggcgttcctttcaccatttcatactcgtgataacattgctggccatagcaggggttttcctgagcaagattcgtacagctgatcgctctctcacttactagaaaaatagagaaaaataaaaaggtgacgcgcgatgtcatggcacatctgtgcaagcgatcaagttaatattaccgagcaatcacaggcaggttgtcgacgccgacgccgacgggccaggcccggccacctacttcgttttgtagcaaccaagcgaagtgtttaagcctttttgtcacgcaatgcagtctcgacgacacagctgcgacgttcgtgtcacggctcaccgcgcccctcgctaaattgttgttgagcgtcacatgaagccggcagggccggccggtggtgaatgcttggaggcactcacgagccatgcagaagccaacattttgcgtacgctaacccatcattaccaacatgtacgttgtacagctagtcaggagtcagccactagctactcctgtgcatatatatagtaggaaaaagtatactagctgggaacaaaccttaataaaactgcgtgatcggtgaccgatcaaccgacagcgtgacagcgccatcccgactgatgaagagcgcggaacagaggcgaggaggcgagctgctgcatgcaggccagatcttgtgttgatactggcaacgtgcagcgcgtagcgcacctattagtgtccagcccacgccgaggcaattaatcaggcaaccgacactgccggcgagacggaagtgaaacccgtgtggcaccgtggcgcgtcgtcaggggacggaggctgcgagtgcgagacgatttgtgtcccctcgcgtgcgtcgtgcgcgcggttgagaagggggcccttgctggctgctgctgctgttgcaacagcgagcagccccgcgtgcgcgatcaccgacagggggatgcgcggatccaaggcgcgggaggacaaatgccgggcggcgaggcgtacgcctgcctgtacgggtgcggccggcgacgaaccgcgcgcgtctgcagtgcagcggcaaattattttagctaaattattttagctgccacgacaaacgtactccctccatctcaaaaatataagtatttttaactatgaatttagataactttatatccagatttataatcaaaagttattatattttgcgatgaaggtgttagcatcaagcattcattcggtaggttcagttgcttgttggaccgggctcgctaaccgaaataataatgtgcattgcttgaaacagcaaaatttgagtggattttgagttgtaggaaaaacaagcgtcaaatattgagaatagaaaggcaaacattggttctggcagtgagctttctttttgtacgatcagcttcaccatttttctgtaggagctggggtatataggatggatgacgagggatggttgactggtcaacttcttcggttggagcagtactaggcatcagtacgaccataaatatagtaacccaacaagcaacaggtccatgtgcagtttgttcagattgcatagtttgagagtagcagccagccagccagcaagcgtcccagtgtcagcaacgtgaaggtccaggaaaaacggaatggaacatgtacacaacaaaaggacgtagacagaaagggctaattcctgaacgttcgtgcttgttgtttttcaccgtgttctaccttttcactgatcgaaaattatgcactagaagtttacaaaccaaaagtttgtacgtccaacttcgagtttgattcaaatgttgctacatcaaaagtttctacatgtaaataaattttcttgtagaacagaactcacaatgaaccaagcacacgtgaaccgagaatatttaactatttaccactcttagatttagcgtttaactatttgaaaataatgtgtttatgacatgcatgttgcaagtatagttaagtaccacacttagagcagatacaatagcagactataattcaactataaccacatatcgagaagaaaagagaagagagagaagaaagggggctacagatttgtagccagctgcaacacggactccgaaatgttacgtgtgtatgagaggtgggaccgagtattaatggtgtagtatatttttatagttaactattttatgaatgagctattagattagctatagttgatttggagccagtagttagctatactatctaagagcaaggctaataatacagccgacctattgtctataaggttctttgtagtcctctcttggcctacccatataatagttagctctttacaattaatacatgatccacttgtctctctcatagtgtttcttggttcttatgtccaagccggctgtaagtttacagcccgcttcttctctctctcctctcttttctcctcaactcagcatttagccggtttatagcctactattatacttgctcttaaacttgctcactccccggcacacaaaacgaagcaacgtttagcgcgagattaattaagttgtagctttttttagaaaaaaggattaatatgatttttaagcaacttttgtatataatttttttttaaaaaaaacacaccgtttagcagtttgaaaagtgtgcgcgcggaaaacgaggaggggagttgagaacggcgggaactaacgcaggctaaaagtgccaaatagttaaatattctcgtgaattgagccttttgtgtccttgcaaaatcgtacaagaacatatccatctcgaggaacaggaatatcgccgaggcccatgagtttcagccgttggcagtggcggcaaggtctaggcttatggaagtatacgacttatggatgagtagcccaaattggttgaacagcccatataagatgcatacgtggagatgactgggcctgctacgaactgggccttgtaaaaagctggccctttctgaacataacttttggcccacgtatatttcctatccgcatatctttccggaataagtctaattttccatcctggaaatcttatacttgatcaaatcacatccctcatccgtaaaaccgggtataatacctctcccgacataaaaaaccaatacagattgactcctttaatggtttgtaaagtagtttatgctgacttggtccaagtatactgttgtggcagcctaggcactaaaggaattgaaaatagaaagtctccccacatatatgtgagaaagggtaaaaaaatggagggacccacttattagcctcacaactcctctcttagtcttgacacgtcgccctggtgtcgcaatcaccacagaagagtgagtggttggtgggcagaagcggacggtgatagtggggacacgtagcgcttgtgatgatgatggtcctcgctaccacgcgtgccgccccgtcatctttcccccgaggctgtccgcacaaatcttgccatgctacgtgtcgccgatggccgtccacaacttacaacgttgagcctaggggcgcggtgtgcatagcactattgcccgctgtagaaataggcacgaagcgatgtgaggttcttgtgatggagagtggtgatcgcgactaccttgttgcgaaactcccgttatggaataggcgcctagcagagttgcttgacaaccatgatgttgatgccacccttgagccgccaatcaccacctgatgcataataacccgccctctagaaccacaacccgacccttccgacagcgcgggaccacttacgcatatcaacccatttgcacttcatgatcacttcgtgtaaaaggttaatttgggaataatatggttgaagggataagttgattcactattgctcaattagcaaggtgatactaatttgagccttgttattctcttgtcccaacttatgcggggtttgaatttgtcgagttgtaccagtgccctaaacctaagtattttattgatcaggcaccacccatatttgaattggattcaactcgctctactagcaaggtgctactaatcaagtgcatagaggattcatggaccacacatgtcacatcccaattaggccggtatgtcaagtacatctcttgcaaaggagcctacatttctgatggttcaacttacctacatagccacacaggtatatatacaaatgtccaggaacgtgccccctctcagcggatgttcgtgcgtccagcgtcggcgccatatgtctcgcacagaggtcacatgcgccatgcatcatatactcatatgctcgcacattaacccatatgcacaaccgctagggtcggctataatatcatttgtaacaaccctgtcctcaacaaccacgtagcccaatccatctgacagacaagtcccacttacacataccaccccacttacgctttcgtcatcgcttcctataaaagagttaattcaggagtaatatggttgaagaaataagcctttataagttggttccactcttgctcaattagtaagtagatactaatcaattgcacacaacagtcatgggccatatatgccacatcccaattagcctaggatgtcacatgatgcagacgaccaacaccacagcgagagcactccattgagctcatggttagtgaccatgacaggtcattggcgagctgactagatgggttgcatctatggagtatttttaagttctcatctcgaaagaccagaaaacaaaaggatttgagacaaattgacaagaaagaagagcaaacaaaggctcacgagctcgtgtttagcgtgacgcccagcgagactacccatgtcggcaagggaagagggaagtgaggagagagagaggggtgacaaagaagatgggatgaggtgtaaatcattaacatgtgggactcacctactgattcaagtatgtcaaccgtgattaacctatcaagttagcataatccgctttcaaaaaccatcaaaagagataatttgtaccaattttcaaaaattaatgagacgttatggtaattttatgattgagggagacgatttaatcaaagagtaaaagataaggaagagggagacggaacctttgctttccttgctcatttcggggctaagggcagtcccaaccctccacctaggatggtgtctacagtattaactacattgtcatgtagaacttttagcttatgttgcactatattaattaagagagagagtgaagagaggaagaaactgggtctcatgcaaggcacaacttcaacacgagaacctgtgcactagactgggagagaatagtgttttcataatagatgaagaataaatatgattggtagagaagagagatgatgtatttattagtagcctactttaataaaccatgggttatagagtgtagtttctattgtgatgtcttattaacatggcatcatagacactgtttatggacgctatgggttgggaccgacctaatttggcctgatacacttgtcctacctaggttgcgacgaccacggagacaagcaccctctgcatgttgcacacagagacggaatcaacggcaatcacggcgatgaacgtgagaccacgtccacatgtcgcggcaaactagcggaatgaaccaataaactattgacggtacaaaagtgaagggatcgcggcacctgttcgggccgggattcagctcatcagctggctccgccgagtgctcggctgctcgctgagctgaggcatcatcgagacgtacgggtacaaaccgcgacaggtcctcacatctggctgggtcacaggcagaccggttcgacttcgtacgtgcacgccgcacgcgacgttcctgcttggctccggtacgaggagaaaatctcacgtcaactcgatcaacgtcgagccaccgacccccgtgcgaacacgtcgttattagcaggcgtgcatagataatactcctactatggacttgttctccgtgttgcttatttatgttagtcaattactctttagcttttttattcaccgcaatagatggaagcctggacgagtaacaactaacaactcatgcgcaataatcctcatcgatttgttagcaaaaactgcttgattagctacgcattttgcttcgttttcgaccccacatcaattttccatttttccttcacaccggaaccatcgcgaaatgccgaaatcctcatgaaccctctgctctgcttgattcaccgagtcatcaaccgaccttgcgcagttgtgctagctagcaggagagcaccctgcacgaacctcacatgtgtgggcggtggggtcacccgaccttgccaaacaaaacgtctcatcggcacatgcgtgggcccacccatccatcccaagatcaaacgccagcctgatatctgaccgtccgttcctgccctagctagcatcggacggctcaccccgtgtctcgccacgcggcccgaagaagaaaaaccctaccgtttgagcagtctccgctccacgggcccactcgtcagtgagaagtcgcccagttaatcatcgcctcatcggctccacgctcctcgtctctctcggccggcgtcgctttccacgcccttttgttcaaaaaccacacagttttttttttctttttgagtttttattagcaaggggaaaacacggagacgaaggaagcagccagcaagctgctgacgcacgcggcgccgctcccccagttcaaacccaccaggccaccaccaccttcccccaaatccccagctgtgtgtgtgcacgcggttttccaatcgattcttcttcttcttctacctcgcatccctccccccaaattcccgcattcgctagctcctgattcggccatggcggggtgtattgttgttgtatttggggttctggtgctggtcgcggggatggcggcggcgcaggggcaggtgccgtcgccgacccccgcggcggcggcggcggcaccggcgcccacgccggactgcaacggcatcctgctcacctacaacttcgagggccgcgccaagatccggccctacgtggcggacaggaacaagcagccctactcgttcagggccaacgccaccgtgctcaactccgggacgcgcccgctcaagtcgtgggcgatgctcgtgacgttcgggtacggggagatcctcgtcggcgtcgatggcgccgtgctcaccggcggcggcgagatgccgtacaacaccacccaggacgccggcaacgcgacgtcgttctccggctacccgcagaccgacctcctcaccccgatcgccaccgcgggggacatctcgcagatccaggccaaggtcggcatcgtcggcacgctcttcgccgggccagggccgttcgtgccgctccccacggcgctgtcgctcgacgacccggcgtacaggtgcccccaggagaccaatgtttcctccggggtgctctccacctgctgcgtcctcaccccggaggcggaggccaacgccaccgtcatcaacgccaacgccaccgacccgaccaagaacttcctcccccgcggcaccggcgacctcgtcatcacctacgacgtgctccaggcctacccctcgagctacctcgcgctcgtcacgctcgacaacaacgccaagctcggccgcctcgacaactggcggctttcctgggagtggcggcgcggcgagttcatctactcgatgaagggtgcgtacccatcggagaaggacacgaccggctgcatctatggggcggcagggcagtactatcagagccttgatttctcccaggtgctcaactgcgacaagaagccggtgatccttgacctgcctctgtccaggtacaatgacactcagattgggaagattgaccattgctgcaggaatggcacaatcctgccgaagtccatggatgagacgcagtcaaaatcagccttccaattgcaggtgttcaagatgccaccggacctgaaccggacaaagctcttcccaccggccaatttcaagatcgccggtgcatcatcactgaacccagactacacctgtggccagccggtgcccgtcagtcccacagagttccctgatccaagcgggcttgattcaacgactctggcgatcgcgacatggcaggtggtttgcaacattaccacgagtaagggggcgaagccgaagtgctgtgtaaccttctcggcatactacaatgattcagtgatcccctgcaacacctgcgcctgtgggtgtccgtcgaaccagcggggtcctacttgcagcacgactgctcaatccatgctcctgccacccgaggcgctgcttgtgccattcgacaatcgcacacagaaggcattggcatgggccgagttgaagcactacaatgtgcctaagccaatgccttgtggtgattactgtggcgtgagcatcaattggcacatatctacagactacaacaagggctggagcgctcggatgacattgttcaattgggacaatgtcgacttggcaaactggtttgctgctattgtcatggacaaggcttatgatggttttgagaaggcgtactctttcaatagcacatcagttggcaagaacaccatcttcatgcaaggtcttgaggggctcaattacctggtgaagcagaccaacatgagtggatcagactaccttgtgcctgggaagcagcagtcagtgctctcattcaccaagaagctgactcctggcatcaatgttgttgctggagatggtttcccttcaaaggtcttcttcaacggcgacgagtgtgcaatgcctcagaggattccaatgagcaatagtggattcaggacccatctcagcagtgtcctctcactggttttggtcctggctgcttcggccttcgtattgcttcagcaataatcctggccgttgctccgattctttcattctttcaggtggttggatcgacgccatttgtaagaaacctttttgtttctggcggtttactagatgcgtaatggttgctatgtagcagaatctggcagcaattgtgcggcgagatgaacacatagggggaggaaacattgttgcagacttgcaacatagcatcaggatcactttcctgaatcctgatgatatttattactacatgtttacatcaagatgagtgatattgtacatctctgatttaagttggtgtagttgccaggaatgtcttatgtttagttatgttatatacaaaatacattttgccatcaaaccgtatgtctgctcattttctgtctgcttttctgaagctaagctgctctcttcagtttattgtcataccatacgatacatggtactagtaattctgaaactgttgctcttgcaagtgggagcaacattggatgcttcttaatcagatctctacagtattaaatacgaactaaatgaatgttcgtatgcttcttgtatacaaacttcaaaacatgtttggaggataacgctcgaaatggccgttgggttagctggggaccacagcttcagtgccaatgtaatttcaaaccatttggcaactttgcaagcctatagtttttttgcaacgttcaggtttcaaacagcaagaagcctttcgctttcttgaaagcaacttgcagctgacaatcttatgcccttctttatgagcattgaccgaatcaaagaaacggacgatactggtatacaggatagatattgttttctctagtaatcttatgacatcgcacacttcagttaacagcaacgtccttttggttctgaccatctcctccatccagagagtccagacttgttccgagttgcagctgaggaggagtagcgtattatcatctctgcacgcaatatcaatgtgttatatgtccatgtcaaacctgagataacataactggcacgcacgatcatgtgtttgttttatgcttatatgcatgcaggattggggtggtttgttcgtgccaggtggtggaacgcaacaaacaccgtgttttagatatagactgcgttaaccctggggactaccgattgctgacattttctaactgtacaggctgttgatgttgtcaaaagctgatgtgttcaaaacctactatgattcttcacgtgagagcttgtccacacggtaccactgtttcatgttttagtcatctactagttgtgaaaacaggaggcaatgtaattgggtggattgacaaaatgatgtagctgcattgctcagcaatatggaaatcgaaggtccagcaaccaaaatgatctggcatgacggtacgaatttgacgaagtgatgtactgctagatgtagccaggactgatggcactaacatgctgaaaagtgatttgaggaataaatattttttttattgattcattcatgcggagcatgatgctgcaaatcctgcgctaccgttggtgcaagctgagcatcatttggttgactttcttttaacacatgcgggatgttctggttctagctgatctttctccttaagaactcagacgtcctggcgttaatgctacgagtaaacatagacttcttgatggagtcaaaacccagaacatcctccccaaaaaaaaagtcccctatgccgcgagttagagtctcatcgggtgctcatacaaagtatttcccaataagccgttttggcttattagaaaataaaaaataatatatttgttcgtagcgatttaaaaaccaatattaaaaaaatacgttgaaaatatcttaaaatcaattttaaaatttagtttgaaaatttaaattttagcttttactttgacttattaggtcaagtgatggggttcacactggccagtgatcacaaatcaaagtgacggtgatgtaaacgtgctaggggcaatattccactggaaacttctgaaagtagctgattatggtcgttttgaaaagtacagtgtttgttagcttctgcttttctcgttgatctttccttcagcgagaacggtatttgattcttgatttctaagtggacgcaaagagaaccaaactagagcaaatctcaagtcaatgcgatctttgctatgcctcagcttttccaacaacgaggagtcccacaattgcaaatcggcagtctccagttctccaccaaggtttatcttaccagcagcggaaactgccggtaaaatttggtaaattagttcgaatttagatttgaaaaaaaaataaaaaaataaaaaaaatcatataagtaataccgagtttgtagttctatctgataataaggttctatgaaatgtactaagttaactccatgtattgcagccgaactgaaactgagactaaaattagaaaaaatagacagatgggctaggccaatagtgaacactattcatgaagcccattaaagtccgcttgagggaaaaatgtgattcctactttatttcaagacgagcacatgataccattcgaacgagatacttttatggaggctaacgtcatcctgcccctactcctcgtgcttgcgtcctcgcgccttgagccagcgcgacagcagtagtaaggaacaagggtcaagtcgagaaaaaaggagaatatgagaggagacgctgatgcttggtacttgctacctcgcaagtactaatcctgccatcctggtacctagggtactatgtatgatacctattgtaccgctacgaacgatatatcatgtaacgtacctgcacaaactccaacgagaagcatgatggctcaccgtcatgtcgctgccaatgaaaacaccatatctagaagcttcattggtcacacccttccatcactctcgacaacatgcctagaaggaggaggttgagaagcccacgccaatcaacgtccttcctaatggcttcacttcttctgattgcccctggttaccatgagagctagattccaatgggtgtcgccatgcctcaaaagcatgagatggaggaggccacgagattggtgccgtccactatccttgttgccgacatgcgctcggactggatcaaagcagtgaagagggcccatgcctctagatccgttcttgggggcttgctccaccattgccatgtctacatagggaagctctttgtggagaggaggagaggggaaaaaaggggaaggaggggaggataacgaaggctcgaataagactgaatcgttatctacttatcccatttccatgggattttgtagagtagttttttatgttattttaattttcaaagcatagcaaaggtcatgccaaaatatcacgcatggctcctaacatcctgttatcttttctattttctattttttccctacaatttcttagttttctacaatttatagttttccaaatagtatatccgtcccaaaatatgttcatttttcacccatcaaacacatatcaataaaaaaagattagaaaaccactactttatcaaatcacaatgcaaccattcatcactttatctattctcaatataattattccctactttcacaacttcaatgcaatgattacttaacaaataaagttattttatgataatgaaagaagctaaaacaaatttaatatgggatgcataaagtattgcgtagaagctcagaaacctagtcaagactcgagaggcggtggcgcgtcgacttagccgttgggtaccagccggcagccgctactatgcggttgttctgtgcaacaccaatccttattattgccgcagagaaagaattagagacgaaacgagatgaattcggcgtccacccaaaggaataagttcactttaggtccctctatttgtcgctcagtctcattttcgtccctgcagcacaaaaccagatacaacacatcccccaacttacaaaaaccgtgcaaacaagatctctcgcgcggtatagtccctggttttagctgacgtgacgcctacgtggcgtttgacatggcaaaaaaacctaggacccccatgcaagtgattgttcgattaaaaataaattatttacggtgggacccacgtctcctccagtcctcctccccaatctcgctgtctcctccccaatgcggcgacccagcggtggcctccccatctcctcctcctccgggatccatgcggcggcggctggaagggtgggaggacgagtagtggccggcgaggaaaaagggcagagcttgccgacctgtagacgctaggaggggtcttctcctcagccgacgttgtcctcctcacagtcggcgccgtcctggttggcttcctctcagtgtccgtagcaaccgtcttcgcctcaccggccgccattctttcctccatggcgccgcctgctgccaccttcctggacttcgagacgatggaaggggcctttcgttggccggctcaaaggagcccatcatctcctcgaggtttagcgagctgatccggatgacgtcctcggtccatccccatgaggtggtcgacggtgagcggcatcttcttggccatgacgaggtcgaagaagttgggattgacgaggttgggggtgatgggatcaagtgggacggctcccatgtagccgtcctagccgttgcagaaggcggtgatgttggatcagtaggtcatgtcaatggggccatgtcgacctcgatgaagaagcacttggccttgccgatggagtggccgccggtgaggacaaccatctcagcagtgggcggagctgagggcggagcagcgacgggccgcgggcggctcctctcctctcgccggtggtgccccgcgtccctccggccatcgctgtgacttcgcctgctccggttgccgcccaccacgctccgccggctggagagagagaagagggagagagaggatagacatagaagatagagagaagatggtagtgagagcaaccacagtgtttggttcgaccattgtattgatcgaagtcgaatggagagtgaaatcgatagctgcagtgtgaaatcaatttgtggggccataaaaagaatccatcaatcaatcagtgtgtctaatttctatgtatgtatggacaacaaatattttttctccctagagttcgacttcaacttagagttcgatttttttttctgacaccatgagtcggctgccacaatgtgtatggttcgcttttctccgccttaaatcgattttactttcacgctggagatgctctgaggatgatgtgtgggtccacatagggcccaccttttttattttttgtgtgaaactgacatatgggtcccacgggttttattattttttttatctaattatcacgtaagcactacatcaatgatacgttggacaaagacatagtcaaaaggagcctcataggcgccacctcagctaaaaccggacacaatactactgagggacctcatttaaacggtttcgtaagttggggacccgtcgttttgtgaccagggtccgtaaatcggactggacgacaaatagaagtacccaaagtgaacttattccccacccaaatcccccaacctcaaaagcccagcccaacaagaagcccacatctggagagagaaccaaaacggcacggaccacgtgcagagcgccgtgccttgaagcaaaccgaaaaccagccaaccatttcgaagccagaaaaacctctctccattttctgaagcgcacacacgccgtattcgctttgccacttgcggcggaagcgccactctctcctctcctctcctccctcccccccacccatcccccgcgccccacgcgcccacgttggcggtgcggttgatccggcaacagcgggcgcctcctcctcctccgcccccaaccaccacccccacccctgcggcgcccatgggtgtccgttcctgagcacaccccacgcttccgctccgcgcatctccgtgggtgggttgggcatataccttgcttcagtcgctttcccatctcttgcttcgtcctgccttcttctttcttccgtgatcccggaacccggtggtcgccgccgcctcggtggatcttgctcggccctgcggggtgctcaggtgcgtcatcccttcgctgccggtgggcattggcttgtgttgctttggttagtctctgttcaggcattccgtcgagcacctgtgctgcgttggggcattggaggccttcttgtttgtttgatctgtaattagctctggtggtgctccttttttttttcgtgcattttgattgttgtgtgtatcttcccttttcctagttttagcggtcctgaaaaattctgggttttttttttctgtgtttctttcagcatgtccccttcatagcaatgtacgctggtcatgatctagatccggggttggctacttgatgtgtgaaccgtgaataagtttggtaatcaagtgttgtgagttgtgatttggaatgggtttgcaatcatcttgtgtgaaccaagcatgttcactactcaaagcagggtgaattttcagcatgatgtttgaatttcatcttatccatgttgcctggttatcgttgtctcgttgatggtattctgtgaattacattaggttgcagaaaatgtttatacacttacctgcctggtgaaattgcctattttgtgtctgcattgtagtgatcgcatttgagaagcttatttgcacaatgtcctacacaaactgtttgaggagatatccagttagagccatctttccatacactaatgccatcctccgagcttctttggagaaaggatctccggaaaagtcactgacagattacaacagtatgcttcgtttcactgctttctgccctgattacagaacatatgtgctccttctcaaggcttgtgcaaaatgttcaaatatctatgctatcatggaaatccattcccatctcgttaaacttggcctgctatctaatcaacgtatagtaactcatctcttcaaattatacattgatcatggtcgcgtgatggaagcttgcaaactattttggctaatgctggagtggagtgccgaacccttttatggaaatttgatgctcatgggattcttgaagtgtggacagatagacaaggcatatcagattttcaagaggatgcctgtcaaggatttggtctcatggaattcaatgattgcaggtacagcaaggaactcgtgcctgaaagatgcaatgaatattttcagcaagttggtcaattcaggtctagtgcctgatggcttctcattctcctcagtcctatcagcttgtgctcaagctggtgcccgttgttatggtatgtgggttcatcaactaatggctgaactgggattggaaatgaaccatattttaagttcatcacttgttgatatgtatgcaaaatgtggaagaattgacgtggcaattgggatattcatgacaattaagagaaaccatgtctctgtatggaacacaatgattggtggcctggcagcacatggtcttggatctgatgcggtgatgttcttccgtgagatggaaagtgaaggtcttgttcctgatggggttacatttgttgcactcttgacagcatgcagccattccggcatggttgaagaggctcgtcaatactttgaagcaatgactacaaagtattctatcactccgaggattgaacattatggtgcaatggtggatactttgtcacgagctgggctactggatgaagcatatgacttggtaaagacaatgaatgtgaaacctgatgctgtgatatggagggcattactcagtgcttgttgcaggtaccggcaaactaaactaggtgagatcaccgtcaaggagatagcgttccagggcagtggtgactatacccttctttcaaacatctactcatctgcgaatagatgggaagattcagaggaagtatggaaagagaggaagaaaaagggaattaggaagagcaagggcttgagttgggttgagttagggaggagcacccatgaatttaaagctggtgaccgatctcatcctgacactgatggcatttataaagtgttgcatcggttatcaaacaaggccaagagtgaaggatatattccattgactgaactagtgtccaaagatgtctctgaggaggaaagagaagaaaaccttaccgtccacagtgagaagctagcggtggcatatagtatccttaagacaatgccaaggacagagataatggtgtcaaagaatctgcagacttgcagtgattgtcatgaatggatgaagatagtctcgaaggtactttgtcgtgttataattatgagggatagagttcgatttcaccgttttgaaggtggatgctgctcctgtaaagattattggtaattcctgttttggagacagatgctgctcctgtaaagactgttggtcagtactgtttggagaactacagaattgatttgtttagcatcatatcaacagttctgacaggaggtacaagtagaaccagtggatataactacattcccttgtggagtcatgggtggtctatgtgactatgccaatatatgacccctataatacatggtattatcattttgtctgcacagcaggtgacatgaaacaatggaaatatgggtaaaccagcgcacacatacatgaaattgtgtactatacacgcacccaccaagtatgtacaagtatcctacagacttgaagcctgtcacccacaatagaaagatcaaaatattatcttctggatttttttgtattttctaattgactttgatgctcttatggctttccatgtgtgtcatggaaaatttttactggagtatggcattttctgcacttctgccatcttcgcacttttttggttgctttcgtggagttgatgtgtcacaggctcacagcatatgatggctgctttcttttctgtttggttgtattcttgtacatctcttctccgactagtttaatttttccaactaaagttattctttgtttattgtttcaggattaacagtgaggggacattctgtattcagtaatatcaagtttctacaaataaataggtgtaggaatacctttgatgccccatttacactgtttgtgcaatgtctttatattatattttctgtgggaacttccatcaactaaggaattcaataggaagctgttctagtaccggtttgcttaaatgcggattaatctatagaactgtacttcagaacagaggaaataaaactcgaccaatcagtacgacaatactagcaagaagtacaagaaaagaaagtaagcagtcattcaaaaccagccgtcatttgcatagtgaatcggttgagtcatcgattgaagtgctcaaacagtcagatcttgagcatcttaaatcacttcaatgctacaatattccacaaaaggtttccggagtgaagaccgattggcctgcaactatccttgtttttgatattgaaactacaggcttctcacgccgctatgaaagaatcattgagtttgctgttcgggatcttatgggaggaaagaatagcactatccagacactcataaatcctgagagagagataaaaaatgcatatgttcatggtattagcagcagcatggtctgcaaacctgatataccaaggtatgacattttcaacagatgctcagctgatattgttaaattatttcttcttatgcaaactgtacttttcatgcaataaggaaagtatggaagtaaaactgtaaaagggcatccgagagaacagtggactagttgcaaactagatattgtatctttccttgcttgcaaccattgacctgccatttttttattgtgatgctgtcttctgaaaaaaaggttccctcttctagatattccgaaaattcggtgctagaagaaatgtgaactgatatcaaaattccatttcctttttctgggataggtgcctcttttaatcatctccctttagtataagcttcagtcattgagcactaggatgccaaaacttgattacgttggactttttatgttctgtaataattatagaagttcttttttctggctatgcagatttcgggagtttatccctcttctattacagtatgttttgagtcgtcaaatggctgataaaccagttctgtgggtcgctcataatggacgtagctttgatgtaccatttctcatgtatgaattccaacggagtaaaatagagatgcctggtgactggctatttgtagatacacttccaattgcaaggcaattgattggttctgatggtacgttcttttgtcaagtgttctgtttacttgcatgaacttaacttttctgactaatttgcactgctagagattagagctatatacagttcaccctgatattacagtgtaactagcaaaacaaactagttttgctattcaacttccaacttttcataagcattcatgtgattttaattgttatgttgaatcctgaggcaaaaataaagttaagttagcaatattaggtcttctctaaagaaagttcagtttttatcactggattctttttctttttttcttttttactgcaagagagaaggcataatatgggagcaaagcaggtgactgaaagtaaaaccttcctgttattttatttgcaggggaaaaactgaaatctgtatctttagacaatctgagggagcactacaagatcccattggcagggagcgctcatcgagcaatgcaggatgtgatcaccctctgctatgttctccagaagttgaccttcgagctgaaactaactgttcctcagctccttgagaggtcattccgggtttccgatctttcaatccctcgccctggaaaatgactgcagttgcctcgccgaaaggatcacacagaaacctggattgtttcattgtccttgtatccagtgctgttgtttcagatcccagctcatatgttattccgacaacagaataaggcaggcctgatcgttaccgtgatattaatcatttttagtttagtactgatacttgttgccccttgaaacattgattagacgtacatttattcaaagttgtaaagaccaaaacatgtcctggtttccaacctggaagaaatgaaacgttcttgactatctgtagtcactgtggtactcctgttccagacaattttatgagctcctgtgtgatagactgacatgtagaagtaacaaagagaaatttattctgcccttgttgagtaggagtactagcggagtaatctccgcaagcggactagcggagtcaggagctcagtgatttgtcaattcattttcatccatgctgggctgtaagcagagtggcgtatctagaaattttatgggactgggcaagcctaacaataaattataaaatgtacctaattatatacaaatctatagattattttggggtgagcatttgctttgttagttgtagtttgttctaagcatgttaattatgtatgtacactatactactgcttctgtcagtgacttagtaattaaaatgattagcaatagcaaggtaattaggattaatttactgggacatagctgggcgtttgctccgccactggctgtaagcgaaaacctttgctattgggtgaatagccagttcagtccttcaacttttgttcatgggtcgaattagtccttcatgttttataatgtccaaccaagactctaaagattatcatgcggcttaatatagtccttagagccacttaaaacgctacgtggacatgccacgtcattcgtgcatgtaagataacatttaaatgtccattttaaccttcaattttctatcaaataaagaaaagtaaaataagaagaagcaatcataaaacaaagaaaaatgttaatttttttatctatcaatgctatatatttttgccaatggtcaaaagcttttttttttgtgtgttttctcaatagttttcctttatttcctatgaaaacataagggtgtaaaggacatttaaatattgaatttgcatgcatagatgatgtggcatgtacacatggcatgtttagagggtcaaaggactatattgaatcacacaatgaacttaaggtacttgtttggacaatacaaaatgtcagggactaaattgatccttaagcgaaagttcaaggatcatattgggtattcaccctttgctattaattaatagcatgcttattcagagttaaaatatactatgacaataccacaacaagggttttaactgcaaacaaacatttttatctcattacagatcattgcgatggtcaattgcaaagtttccgcggtgaagcgtgttctgaacttctatataaggcgggggcaatcgagtcacttcccccgagtctcaaaccgcagctagcctcccgcttccctccaattccccaacccaacgaccacatgaaggtaaccgccgcgagctcgtcgtctccctctcgatgaatcgatccaaaccctagcctcatctctcttctgctgctccatttgcagcttgggatctcgggtggcgcgggcgaggcgatggagggggagctcagcttcgtctcgccggcgaggtcgtcctgcttctccttcgagggcggcggttctggatccccgacgtgggtgtcgacggtggaggcgctgctccgctcgcctacatcgagcgtctccgatggcggcggaggtggtggtggtggctacaactcaccggcacgggcgtcgtccccgctgcagaagcagatcccctactgccgcgacgctggcgacttcagctctctgacatgggcgtcaactctggagaagccgctcgagtcgccctcctcgtgcatctccgacggccgcggcggtggcttcggctcgccgacaagcgcgttcccgcctgagaagctgctcatctcgcccccaacgtgcgtctccgacaaccgcggcgtcggcaacgttggcggcttcccctctctgccatgggcgtcgtctctggagaggctactcacgtcgccctcatcgtgcgtctccgacagccgcggcgtcggcaacgctgacggcttcccttctctgccatgggcatcatctctggagaagccactcacgtcgccctcatcctgcgtctccgacggccggagcggtggctacagctcgcctctcggggcctcggcggagcgagagcgcgaggtgcgcgaggcggagatgctcctgcgcgcgatcgccgagcgctacgacgactgcttcctccgcctgcgcgacgccgcggccgagctctcagacctccaccgcgagcgcctccgtctcgccgccgagaacctccacctctccctccttctcgaggagctcgagtccgagcagcggaagcaggcatccgccatggctccgccgaagctagaggaggacgaagcagcacaggggggcgcaccgaagagcatctccattcgttcgccgggctacctctctcagaagccgccgcaggggcaggccaggccacagcgcctccgtgttcgcgcttctcaggcgatggaggtgagcccccaattccttgcttgttaagctcgtcagacatttgcacacgaaccctcacagataattcagagttggttcatatgtgattagatggtgagaatgccagcattaatcctcacagataatttagagttggttcatatgtgattagatggtgacattgtcagcattaaactttgcaaaccacacatgctttggtaatttgatgccttgtttgtgatttagcaatgataggaagcaatgttgaattggatatgctcgattctagatttgcaaatgcggtagcagtcaatctcttaattctgaaagtctagttagtgaatctcgttggatatttgcacacgaaccctcacagataattcagatttctaataattcctgcaaattggttcatccctgtgattactgattagatggtaacaatgtcaacatttaacttgcaaaactacacgtgttctggcaatctgtgttagcaatgatacaaagcatcaaagtgtgttgaattcaattctaagttgcatttgcaataactttcagccttgtcaatatttctgaaagtctaattactgaatctggagaaacttctttaagatttcgcaccccaactgtttgatttttgtgatggggaatcaatgttcaccgaaggaggcagcggcagcaggggatgaggaggatgaggaggacaagggcggcggcgaggtggaggtggaggcgtacaggcagggcgcggcgaagacggagctgtgcaacaagtgggagcgcggcgcgtgcccctacggcgcgcgctgccggttcgcgcacggcctgcaggagctgcgccccgtcatccgccacccgcgctacaagaccctcccctgccagatgttcgccgccgcctccggctgcccctacggccaccgctgccacttccgccactccccgctccgcgccgccgccgccgagtccttctgctactaggccgcgttcaaggtaaacacgccttgccgcctccctgagcccataagctgttcatgtttaagcctcgttgcttgtagctcgtttgggccgtggtagtgtctagccacgtgatgggccaaatgggccgtatgtgatatgctttgcctatatagccctgggcttcttatcatcccatcacatggatactgccatactgggttgggctctatgtaaagcctggatccttcctgtttttatcctgcgcgtgcccctgcatgtttcgatgcttctgccaccatggggagtaggttagcagcgttgctgcatctgcatgtgccggatcaggtcgaccggaaagctgtttgcatagcaaattcagtagcctatagccacctctttgcccgtgtctgtacatgtaaaaggatcaactcgatgcacgaagctggcgaatcataaacagtaaaaaaaacaaagggaagtaagcaacacagtaattctacagacctccagggctccctccagtttgctaggaacatcagggtatagcacttagcattctttgtgcacacctgtgtgtcggccatgtctcctagccggcttagctcatgacgacaccgagtcagcagcatcagcatcagcagcagcctcggataccaagcgcgagcccagggacagcaaagggccgagcgcgcgcccaaagcgggcgaggggagaatcagcatcgtgtgcttaaagacctgccctttcttcccacatggacgaggggagagctaggatgcctcgcctttgtttgaattgctttcctggagatttgaagacagcaatggcagtgtgtggcaagagaaaaaaaaaggaaagccctagaggaggaggagcatgatgtaagccgcttttcagtttttaggggcaaaggcgacggtagaggcggatgagaggctctcccctctgccgccatgtcgtctgcttcgttatcctggggaagtgtgtgtgagtctgtgtgtgcctgcctgcagatgccctggtttcgcactttctaggattccttttcgggaatttggggggatgatagaaatgagaaatccatttggatgcctgcgcctgcacgtctgcatggccagtcggccactgcatacctgcagacttcacatcaggaaatctgcagagaagaagactagaagaggcagataggcagtgcctagatagaggatcagattagtgatgctgatactctgttgctcaggacaaaacaaattactaagacaatacacgccctgatcgttgaactgacttactgaactcgcaccattcttcttccgttccaagttccaacacagcaattttcagtagaaccaatcatgaactgatcaacagtgttcgttcgattttattctcacatttccaccgctgaatggagcaaaggagagataaagtggaaaagaaaaaaaaaagtaaacgcaaaggctcctatcacctcatctcctccatattctcgccatgcaaaaccagcacacgtacgaacgcacacgaacgcccgagagatggaggagaagaatcgcaaccccgcactctgtttttttcatcctctgctttgcgctttctcctcctcaaatctcctttcttccctctctacggtgttgcaccgcgcgcgcgaggccgcgaaaagctcccctttgtacccatctttcatccccccacgaaagcctactaccacccatcctccccgtagtagccaccaccaccaccaccaccatggccgttctctgcttcctcgaagcttctccaaatccagccgtgcaccagcacggcccgcaccccgatggcccgggcgtatgcccattccatcgaacaactccggggcgctctgacctcgcccccccgctttgccgctttctgacaaaattccgcgccctttttggtggcggcactgaaagagaggagccgaggtgagggggaggaggagaaaaggcggggaggagggagggtgggtgtggccgaatcttggcatttctagggattctgatgaggagctcgccgctttgcgatctttttgccggggaggcctagctcgtcatctcctcctaccgggagcgtgtccgtgacgagaccgaccccccctctcctgccgccgcccgtggggagaagcttccacgctgcttcctctcctcttgcccccgctatttatagccgacgtggtttctccccagggttttacggcggttttgttcatctcaggtgaactcaactcaactgaagtctggtgcagtgcagggtagtgtagtgtagtgtagtgtagcttgttgattcgagctgcattgcgctgatggacttgaagagggttttggaggtggaggaagaggtggtcgacggcgacgaggacgagctcgcctccccggaggccaagcgccggcgaactttcatcaagtgagtgaaaatggcattgcatttgggcatttcggttaagttcttgggattcatgagttgggttctgactgactgactgacgttttgtcccttgtcgttttcattgtgcagtaatagctcgatgcaggaggccattggcgcgcagtacatgcagaggcatctgcccaagctggagccgtttctgcgcagagttgtaagcaacattctgtagcagctactatacggttagctgcctgtcgagttagattctgctgaattctaaattctcatggtgtcactctcctgaattcaggtgcaggaagaggtgcagaatgttcttatccgccacattgattcggcacacaggttggcctctacattctatttgcattcagtgtttcatagtactagtagactagtagtacttcctttttgtttccatttacagaagtttattgctgtggcactactaatgacaacatagagcatctacgagttcaagaccctgtttatattttctccatgttatctctgaaatttaattcttctggaacttccaatgtcactatcgtatgaaacattctgaacctcaattctcagctcatgctaaaattccttcaagctgtcgcttatactaatttctgaatgcatgctgtcagttcagtgctgtccttcaccttttgactgctatatcagttttaccaaaaatgcccactcagatgttcctgtttttgtggttggaatgtgtcctgacttgatgtttgtcctgcattcgtcaggcttccccttcagctaaagacaagcagtaaacgatacaagctgcagttccagggcaacctgcctctgaccctcttcacaggcaacagagtggaaggggagaacaagcagcctctccgaattgttctcaccgacgctgtcagtaaccagacgatcacctccggcccgctgtcctccatgaaggttgagctcctcgttcttgatggcgatttcaacgctgacgagcgcttggagtacaccgagaaggagttcagcgagagcatagtctttgaaagggaaggcaagaggccactgttatccggcgaggtgatcattgtgcttgagaaaggtgttgcatctatccgcgacatttctttcacggacaactctagctggataaggagcaggaagttcagacttggtgcgaggatctctcgggccagctccatcgaagaaagagtgcaggaagctgtcagcaatccttttctcgtgaaggatcaccgtggggaaggtatgtccttattggtattcatttcatgctcaacctgttcgtcagttctatccttgcagtgttaaagaagaaattaatgataaaattttcatgtttcagtttacaagaagcatcatcctcctgcactagctgatgacgtttggcgtttggagaaaattgggaaagacggcgttttccacaagaagcttgcagactttggaattcacactgttcaagacttcctccggaacttggtgatggatcaatatggactacgtagtgtaagaaattaatcatcccttttacaataaaaacttctatttttttagataaacttctctgtccaactttaatgtagcttccatgcatatattctcatcctgaactgcatgtccatttttcagttacttggcagtggaatgtcaaacaagatgtgggaagcaaccgttgagcatgcacgggagtgcgttctggacgacaagctttactcctactgcagcgggcatgggataatccttctcttcaactgcatccatgaggttgtcggtgtgatcgttggaagccactgcttcactctgaatgctcttactccaacacagaaggtaaacacctgaaattctgagaaagacttgcaagttgccatcaatggcatcgaaagatgcctgatgcacagatgaaaggacatcctcattatgagcagcacctggacagcgtccaaaagtagttactaattgattcagatgcatggcagtataattgtcttgtcacccaattaatattgctaattaatttgcaggcgctggtggtgaagttgcagcaagacgcctacaagttccccaaccgcatagtggaattcaaggtgcagtcccagtgcaccagccagtcatcaccaaccaccatccagtcccagtccgtgcagatgccggcttcagagaacgcacagattctgaacctacctcaaggtgcccattgctttccatcaggtgtcttagctaggtcaaagccctcatagatcatccaacactgacagagaaagaactcgccactgtttggtgtacaggtgagctgccgagctcttcacaggactgcttgctgaatccgctccagtaccagccgctcaacgaggcgctggaagacgtcctccagacagccggcggcagccaccaccaacaccagggtggtagcggcgagctgccatggatagcgtcgtcgttcggagcgggcggcttcgtcgacgcgagggaccctttcgacgtgcagttcagcggctcccagccgtgcgggctgctgctctccagcagcggcgccagattgtgaggacgagacgcgtgcgtgtgcagcaatgtgcaatgcaagcctccgtctctttgcatggagccgagtaatggcgccgccattgtagctaagctaagctcgagggtagtggcgtggggtccatctaactgtttgtctgctaacactcacaaagttgttttgggtgggatatatagagagagagatgatgatgcagagaagacaataagtgggtataatttggtagggtatgtgatctaatctgtgctgttttgtggcatgtaaaatgacaagaaagcactggtctggagattttttttagtgctaaaccctggatctcctttgtgtaaaaggtgcttctttgtctcatcgtcttttctttagtgctctctcagttttttttttccaattcatttgcaagaacagcaaaatgaaataggctcgtcggtggatagatatgctatgtggtgtaatgagtttggatgggtccatagctggcagtacttggattatgtaagcacctactttggcgtttcagctatttatagaccatggcaattggccggcatgatgagtccccaacccacccttgtatcttgtacagtacttgccaaccgaaaatgctgtgccatataaatgcattcatcaatcattcgcagtgaaccagcaaggcgtcctccttcgtaagggaacatatcctgtacatatacaaggtattttcagttagtgtgcagggccagtgcaccttgtgcgcacataatacactccccttttgtaaagcagtaataattcatttgttgacaattctgcagagagagagagagagagagagagagagagagagacgttcaaggcttcaaggagaggtgcaattgatcaatatcaatgacagcgaaaatgccgtagttctagaatcagaagtccggaatccaacgtagatttttttctcgattacacgatagatttctcgattacacgatagatgcacatgtacatagttacacacaacatcacattcacatccccgtgaatgcgttcctcgacacatgctaaagagaaaccagcaacatgccggcatatccctaatatcataatccaacacagattagggatatgccatgcccgttcatagtggataaattccacaggaacttagaaggtaaaggaaacaccagatgcccaaaagcctaatacaatgaaaatcagtccacgtagaacaccgaaagacattaccattgattaggatagcatgagataaataaattagtctgttcggctccacaagcatatacattccaaggtagaacaaggagccttgccaattgccatctcttacaaacattgttaagctagacatttcactttacatactaaggttcaaaaaaaaaaaaaactacggggttgaaatcctgtgagctatcttcccagtgcaaacagaaattttcatctgcgctgttgatagactcccaagattgttagtagcccaatttgttcagttcaggctagattgcagttagtttcaccaataatacttggatccagcagcaaacagattattatcctctttttacatgtggcagacaaccgaaccaggagaccagtttgcacgaacaaggaccagttagtcctattggcaatttcacctgcacgctgttgagcgactagatcttttaccttccattgcatccttctttttcctacaatctgaacaaagataagggccaacccatggtgtcgatggggcagaacagcaaccacctccattatctgtcactaaatcttcaaaaggtgcttgatccacttggcagattgcacagcgagatggggacgagtttgcttttgatggaaaattcctacccaacctgcaaaagtataaataggctgttaaggttctgttcaatagcctcaaatgcagagacgaggtaacaacagagtgggcttcctcgacaaacagaacatcaatcagtaatatatcttagttatcaacagttaattggacaatgtgataaagaagcgtgtgataatgaggaaaacaattcaacagaaaacatattatccatggcatagctcaagtaaaattcttctaactactggtgcaatatgttcattcaagcactatccaacctggggaacttggaccatcaattgagaagataaaatagtaggatggtgctgtatagtctaggactctagtagcatacaactcaaatatgacatagtaacttaggctgcaacataaacgcaaactaacagaagtgatatttcattcttgaaggtcacaaaagttctggaactgcatgaagcaaagtagaagttacatgacttctgcattgaaagagaggttgtctccaaatcatatcaaccatatcaaggtatgccaatctatccttaccaagctagctactcaatcccttttgctttggtctaactacaatatcataaatatttatgccatgcaacataataacaaaaaaaatgtttcaaaagttaattcgtcagcaatttccttatgtgccataagccacacaaaggaacaacagaaaccaaagaagtggcaatagcaacagggaggtcttagtatgagtacatattatcatgttgccaagcccacaagatataattgacaagccaggattctattgcattgagttcaactaatgagccacaatcgggagtggaaacacaccactaactaaagaaaattatgaagtattcatgtagttttactatactgttttttcatgaaaaaaaagccacaaatgatattggacaactgatcaagaaaaagacaaccatgcatcaggaacttaggatggaaaagttcaattagtggttagtggaggctggggacccccaattgttccccatttcaaaaatatatcatatgttataaaaccaagccagggacatgtgataagggaaaaatcataaaggaatcaatgacgataacaaatacacagatgacaatcaaccgagtgattaataatgcatagtaaggtactaaacaggggataacaaaatgaactgcaacaggaaaatgatgcatgcctttcatccaacattgcggaaccctcttcaaataattcctccacagagtcaaatgaagcagacttgtttccaagctttccaacagaactatgtgacctcctaccaaaaagaagagatctcaacttgttctggtttttctttggagatagtgatggaggtgttgaagaatgatcagatgggatgatatcaacaaccacacaggtggtgtcatctttcagcccacttgtcttcagtgcttgctgtacaatatgaatggatctcagttggatgatcaagatagtgaagcattccatataaagtaagatataaacaagaaactgaaaccacacgtgaaactaccttcacgacaagctttgcagccagctctgcaggcaatcctcggcatgcctgagcagcagcttctgaggacagtgcatcccaaattccatctgatgcaattattagcctccctccagcatttgatagctacaatttcccagaatgaaaagcatacacagttaagttcattgcgataagctactccttgcatttgatcaaactcttaaaatttcaccttcacttgcttgacatgtggaattggcacaatgaactccccaacgtcagtatccccaatcgatcttgaaaggcacaatccacctggccagcatctgagaggtcccacctaaaacaacagcaagatttcacatcaaaacccataatgagaaatgctttgacagcattgaatgtatccttgaagttctttccaagaatatttactagcagcttacctcctgtccaccacacaggttgagccggctgacctcccctccactcgcggtgacgcgctcccgctcctctacattctcctcgagacgatggtccacggttagcagcgagatcacaccgccctgcgtgtccaatatgcacctggagtccccaacagacgccaccgtgaccgtgaacccatcgacgacgaccagcgtcgctgtcgtccctgatgcctcccctgcaatcacactcacacaacatcccccaaagttaacatcttcacagcggcgatggtccaggctttcaagtttcaacggcattgcgaggatctctctcacccttgcgttggaagtcgatgtccgtcttcacgaagcccgcgaccagcgcgcgcggcagcgcctgcagccagtcgtcgcggccgatgccctgcggcacggcgctcatcacgtgctccagcaggtgctccttgctgaacaccgccgccgacacgccattgtgtccgtcgaacacctgccaaaccgcagatccaagaacaagaacaaaacccgacacgccatcagcatcacggaatcccgagacgagaccagaaacgcgacacggggggagggcacgtacggcgaagacggagaaggcggaggaagggtcgcccgggacgcggaggcagtcgggcttgacgaggaagtagtcctcgccgcgcttggcgaagccgaagtggccgtaccggacgagcggccgctcggagccgccgccgcggagctcgcggccgatcagggtcgccaggggaagcgacggggcagccttcccctcctccccggcggcgctctccatcgcagcctctccccgagccgccgcactcctagtcctcctacccaccaagcatcatcccaaactgccaagaactcaccgaaacggcgccatttcttccgcggaaaaaagctccggctgctgccaacggcgggaggaacccgagatggatctgagattactcaaggagtactcggatttggaggcaatggcggcgcaatgcgggtggcgaacagctgcgatttgggggaatttggtggggagagtgaaggaagaagaagtaccgaactgaggaacaacgatttaattagctgacgatagtagaagaggtgggatctttttgtaattcgtaggtgaaatagggggcctcggtgcaaatgtgcttgccaaatgcctgcatttctgcaagcttgcagcagcagcgaggccagctggtcgatagtggttagcaacttttggattaagaaatctgagttggattaaagaaaagtgtgttcatattgtggatttagccgcaggttgtccggttctgaggactactagtaatgtttttaagattttttaagcatgtttgaatgtatggttgccagctgctaaaatggatatgtttgactgaccacaggtggttttggtgtcaggtgttatggacccatgtgctattgcttgcaagtccacaactccacatatgagtacaagaatagtagtaccagtagtaagcttttccaaaaatgcatttaaaaacttaagatttggtgcaattattttatttagtctttacattcatatgcagctgtttagttttatgccgttatgtggatatcattttttggcacgtctcgttataagtaaaattaaatgcctcgtcctatgcatgctaggtggtgtttggatccaagaactttagcattagagaatgtttacggtagcatcacataggctaatcatggattaattaggctcaatagattcgtctcacgaattagttcaagattatggatgggtt

SEQ ID NO: 59581 - DNA, 3325 bp, Oryza sativa
cctgaggcttgcgtggcctattaccggtccttgaatttctgaatgtcattactgtgagctagtggaagtaaaattgtgtgtgaagctgaatatccttttggtgttcaggcctaagcttcgggggccaaatcacctgtagtgtctgcagatcaaggtttttgcttgtgattgtacatgtgtgctccctggaaattttatcgtactagatgcatatgctagtttgtccaccattttcctgatgcttcttattcataccactcttggatacacagtggaactcaatctattgttcacgccttctgtaatcgtattcagctccatcctttttctgttgcatggcttgcaattttgtgatggatactaagtgagcagtgacattgtctttcaatggtaaagttacactcatcgatcaaaagatgggatgatggatatacataaggatattatccatttcacaaccatgtctttttccacattccgagatcaacccaaaacaacaaaataagacatgcgtgttacagtaacaacttcgacttcaaaacgttactttataccttgcacatcaaaaccacttagtgtaaaagaagagacttgaatattttttttaaaaaaaagtaaaaaacatacaaaaaaacagttagaaatatatatatactgtctggagttagaatatcttttgagttgagggtaaaaattatttacgcatcatcccatcttcgtactagatttttgaagttgtagctagctgttgatctctatgcttcacaaactatactatcttgtactatgttgtaactgcatagttttattcttttatttcaacttgtggtgttaaatgtaggtaaatcgtgaattttgcagcttaaaagaaacatattttttttgcatttaacgaaaattagtacatgaagtattccacagtttgggtgagttcctttcactcaaacagagccaagagtagagattcagatcagctgcaagactaacattgctgaaagttagcacacatgtactgttcactacttaaaaaataatttttcccgacacttggattttattttttcaagtggactaaaaatattctcgcttgtgaaaatatcagaagttctataggtctagccccaactgaaaaaaataatcaatttatacaagtgggatctaaagaagtttgcctgtgaaaatacccttcattttcgcaggtagacctccttagcctccacgtgcaaaaatcaatggcagtcgggacctaaagaggcccgccagcaaagcgtggaggcacttttttatccagcatcgccagccaccgacaagcaatccttctccctcacctacgccctccctcactcaatctccctcacacctctactagggcttcgatccccatccctctccgtccagcctccaggccacttggcgatagcgggcaaggcactacgttcagcggcattagcggaagcagggaagggatgacgttcggtggcatcagcggcggctacaagcgcggttggcggcaacgggctggaggagatgagaggtcgctagtggaagctggcaggctcgggatgcaacagcgacatcgacggcgatgatggcgaccccaccattgacgacgactacgtacgagctcgggggaggcggatccactcagtggccagcttgggagaggggtgtatgactatagcaaggttggaagaggcagatccatcgccgacggccttggatccgccattgccgagctatgtagtgtcggacccaccgttgccgagctcgggagggggtggatccaccaccagcagctcgggagttggggtgcatcgtctacagcgaaggggagtggcgatggctgtggaggccttggattggcatgaacatactagaaatctgctggtcagaccgcctgatggttgtcagttggaccgacatgagactcccagccgaccgactcctaatcgacggtcagggtgtccggtaagattataaggtgtccagttagaccgttgttcaaatttagatcaatttagtactagtgcctaattggctatctaaagatacattattgcatatgagatctagttgatatgatgcatatttgtttctcgttttttaacatttctaccacgggatagcaaaatttccaagatttcagattttttggaatattttttaaaaaattgaacaaactttagcctaagttgaataacttttaccaaattcacacaaaaattgaaaactttgggcaaaatagtttcgttcacgcgggggaggggtgttcccgatattgcaggaattcgaagtgaaattgcatgcataggttataattatgaactgaacatatgcaggtagcctcacatttctttcatcacaaaaattcttaaaaaaacattctgtagatcttgaatgtcaagcgtggaaacatcgtgtcctccacagtttaccatgtgccagagcaacaattcatccaactgaaaccataagcttgcaaggtcaaattttcctggatgcctccttgtccgatcaaactgagatatacatgcagaacttgatatctattaatttcttatctcctcttactccatcatccatactttttgttcactatagtttgctattatgtttgttcaaaagatacgaaaatagtgaattggtactgaaagatgaggtggtatatataaaaggacgacgaaatatataatgcctctatgcatttaatacccatctatatatgttcgtagcaggaggtagtaattacatttctctcatcaatctgttggttaattattttgaattaaagtgtgaagtagatgtatatataattatgctttctgcataaactttttgtgctattccttaatcacccttgaagagctaaaaatagtgaagaccactttgtatacatgcaccatagtcaagtccaaactaagtatatagtggccacaatgtaagtcggattgcgcacaaccggcactgaagtcagccaggcatataaaggttgacaccctaaaatagtcaagataactaccatttggtaccataaaaacaaaatggatgcacgggaatgcatgtctttattatagtgattttagtgactaacgattacatgtcttcccctggacaattatgttataagtatgttacctttgttgtatcaccttaaagcaaaatcccaaaacattagaggaaaacaaaggattagaacggataagtagcaggcatcatgctcagcataccatgaagaaaagaaaaccatagtacctggcattaagttccaatttttaaagtagagatcatgtagatgcacaaatttaatttatagaccactgctgaa

SEQ ID NO: 59582 - DNA, 707 bp, Oryza sativa
aaaaattcatacctaattcatcttagctccgatttagttggttcaaagtctctaaatttttctaaaattgagatctacatgctaaaaatatccacatgtactgttcatgcttgtttatgtgctgttttggtgattttgctcttttctgcttagattccgtcgtttccgaagagtccgttttcgccgaagaagagtttgaagagttccaaggccagcaaggcaagtcacacagatcccaaacaatcctttgagcatgttgatcctatttaaagctattgtttcttttcaactattgcatttattttcgaatgtcattgggtggaatcaacctattctttgttatagcccttttgttcttgattactttattccttgataccttgggttattataatttgactagttgagctttatttatattggttcaactagatactagatataattgcttagccctgcttagaaacattagcacactattgggataattaatgactcactgttatttcatgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatgggcaacggctttat

SEQ ID NO: 59583 - DNA, 4394 bp, Oryza sativa
ccatttccacccaactccggccggccactctagtggccgtggtcatcctccccttcccctaacccggtcatcgcctttcccaggttgtgctcgaccccgtccgccgttgtcggaagcgccggccgccgctcgtctcttcccacgccggtcgccgccatcgcctcggtgaggaatcccctttcctccttcctttcctctcccccgtgagcgccgccgccctccgcgcgtgcgccgtcgtcttcggctaccgccgccgccttcgcgccggccgccgccgtctccccgcgccgccggtcaccgccggcggtcgtgcgccgtcgtcgcctcgccatggccggccggcttgagccgtgccaagccaacagccacgcccctctcccgccctgtgccgctgcccggtggggcccaccagccggtggaccacccctcccttttagccgccaccagtggggcccacatgccgacgccccctccctctccccttgtgccgctgccagtggggcccgcttgccagccgccccctctccctcccttagtgccgctgaccagtggggcccgcctgtcggcgccaccccctcccctcgctgacgtcagccctgggctttattgcgcaataaattgattaaggacttttctttattagtaaaaacacagtttatcttctaaaattcataagtaattcatccgagctctgtttaagtccattcaagtctcagtaaatcaagaaaaatgcaaagaatccattaaaaatagttttgtttcctgtttcagtagtcttatagcatgttttgcttgtgtgctttgtttgtcgcgtaggtttcggccgtttcgtcgatccacggtttctcgaagacgttgctgaggtctcgtcagtgcgagagcaaggcaagtcatgcaatacgtttgatcatattgtacccaatttacaaatatcccgcatttctattaaatgttgcatccttttacaatgtcatgtgggatgggtcctaatactcagccatttattgtttaccttatgccattgataacttgggtatcaaaatgactagatgttggtttaggaaatgcttagccatgcttagttcaactagcacacacatggggatcacattattacatagactttgactatgagcatagctttggattggtgccaccgcaatggtgttagttaattaaaatacattgaatggtgggttgtgggtgcatggttttgctggtcgcacccatggcaattaaggaccggttcacgggaaaccctgggagacttaccgtgcttaccacaagcgggagtgggtaactgcttgatctgaaatatagctcgaccctttcctaggcaccggtggcgagggtgggcgtgatgaagttgggtcggccggggtgtccggttgtccagctgccggattcaccgcggcgcaagaggggaccgcccactgccttttgaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggtggttggttgggcctgttgcaacgtggtgtagcgttggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattgtcgtttgtgtaccctggctggtcctggacagggatttaatgcacattcagcttagaaattctggttcgagaatttctgggcgtgacaaactgccatgtggcttcctcaaaacgctctcaacatgccacatggcacaacgtgaacccgtgcctagaagttgaggacccacacgtgcgcttttgccatgatcataacatggagcgtatttatctcaagattagtttcctactttgaatcaatgaagctggcaagattagctatcctacgtcaacctaatatcacattatctctacatatacatatatacaccggtcagtagattagcaaattttaaatcgatcaagcaggcaagattattacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatgatttttagtcccggttcgaatgctgtcaggtcatgtcaggcccccccggaatcattaccaaccgggactaaagtcgtaactttataccaaccgggactaaagatcccggtgatctttagccccggttggtgctaccacccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgtttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggggaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgccggagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttg

SEQ ID NO: 59584 - DNA, 1888 bp, Oryza sativa
cgagccactggccgctgtgctatgccgtgcccttgctgctgtaccgtgtcgcagccgtgcgtcgcttaaacctagccgccgctatcccgtgttgtcgttgttgtggtttgttcgctgtcgttgcccggtagccgagttgcaaagcctaaggtgcatcccttaattcctaccggcctatcgtttgtcgtaccgggactttatcgtgaaccgtgtctagctcaccggtttagtcgcagccgttattgagtcgttcgctcgttcgttcaaacgaggtgttccccttgcttcgttcgttcgtccgtgttgagtcgtcctttagtttagagccgttcagagctgccggttccgttcgccggtttcggttgatcatttgggtgatcccgtgtcacgtagaattgactcgttaagtcggtatctcgtgaggctcgcttgccagatcaatctaatccgttgaatcttggtcaactctatgtcaagattaatcttagccatccaaaatcaatataaatccgttctctcttttcaatggcatattagttcttttttatcatatggcatctaccaaatataatctaatctttttccggaggttgttttaatcttttatctcagttataaattatttgtaaattgtttaattaatttggaatagtcttttctttaataggtttaattggaattaatcttgtaaaattcataactaattcatatgaagtcggaatgaggccgttcaagtctcataattcatctaaaatcatgatctacatgtttgtttactttatgtgtactatttatttggtttttattagtctttttcctcgttttgcgtgttagcttgtcgtttccgtcgtttcgaaggatcgcgtgtgcgtcggaagtgttcaagaagattaattgaagacccactattgcaaggcaagtcacacagatcccaaacacaattcttttgagcatgttgatcctttatttaaattctctatttttttcaactgtgcatttattttcgaatgtcatcgggtggtgtgaaactgtttctttgttatggccaatttgcattgattatcctatttcttgattacctcggattataatttgactagttggatttatatcttggttcaactagatatattagatataattgcttagtcatgcttagaaatattagcacactattgggataactaatgtttcactattacttaatgatgtacatggtaaaggtagctcacgatggtcaatcgtgattagttaattaattaatgtgccaactaaaacctggtaatggttggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcataataaaagatgcttaatctggtaataatttgtttagctcctggtttggaatggtacattcctggtttggagatagaactgtgcagccgggatggttgttcagaatggttgggcctatacaacagggtatgttgtatagcgttgga

SEQ ID NO: 59585 - DNA, 762 bp, Oryza sativa
cccctacctagactttgattatacacgtgatgtatataaattgttcacatagttcttttataaatcttctcttgcgattaaataaatatgataccttgaaatacttccaggtgaaatgcaacaatggtatatccatgcgcttgcggattacttctgtaaccataaatataccaggattatttctttgccattacttggaatttatatttttagtaaagtcgttaagaaataccaacacctagacttttgcggcccgataagagctatttccgctgcattatataatacagcttaatttgggggggcatgtgttaacaacggaattttgcatcagactcaaagaggaagaatcaagatcgaagtggatttgatgtggaatcgagttggaacagaaatcggattgcgcatcggctagcgtcgtatcggcgggaaacatggcaggaagttcacctagccgataaggcgagcagccgatacaatatgacttgggctcggtattggcctagattagaataacttttattgccaaatagagatagagctcatttaaggcaattgtatctgttaattaagttagttatgtcgggttttgttagatttagcaagagaccactgtatatggtcttgtttgtatcttatctttaggaaggtttgagtcgtggctataatagactaactttgtactcggggtataaatatgaaccccatagctctgtaatacgggagacaatccaatataacttcggcgcatcgccacccttt

SEQ ID NO: 59586 - DNA, 1470 bp, Oryza sativa
atgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatgggcaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttatgcgaggggtattgtcacaactcttttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattaattaactgttttgttaaattctgaaatgtttgctaaatgctgcttttgcaaatgaaaccctattatgccatcctttgttatcctgtgcacttgcatatttgctacgtggcttgctgagtatgtcatatactcaccttgcaatcattcatcagaggaagagttctacaatgaggctgatggagtggaggattaggagtagccttggtcaagctgcctgtggagtggagccgtctgcgccgtttattttattttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacacccggtgtgactggcaccaaaaccatttcaccatatatctctaaatatcagtatcaattatctctcgtgccaattgtttatcatgaaataataatcaaaacacactttgatttcacatatgccaatgtgtattaatgtttgtggaaagcaaattatcatttgctgcgttcagggagctcactttgggaacttttcccccacgcacatttaacggagcaactcatttgcacatgtttagctaagtatcagctaaaatggattttttaaaaactatgattttaagcaacttttcaagattttttttttcaaaaatatacaccttttagagtttgg

SEQ ID NO: 59587 - DNA, 38239 bp, Oryza sativa
gattaatatacatcattagatttgtctcgcaaaataacctaggggttatggaatcggttttgtcggtaatctacgtttaatactcctaaatagcaagatttcggagggctatttaataacccggaggatccaaacaaagccgcgtcaagctagcatgcggcatcgctcattccattatggcccacggtgagcaaactaactgtgtcgcttggtgcgtgtaattaattgtgttgcatagggcgtgtggtgcaaaccaattaagaggtacttcatccgtcccaaaatacaagcatttttagtatactgtaaaatcaaatatttttaactttaactattagtagtaaaaaaataaaaaagatcaatcatataaaattgatgttattagatttattattaaacaaactatcataatatgtaactctttttatttaaaatatcatatttttatagatattggtggtcaaaatagcatatcaaaaactgtatgcaagtttaaaaatgcttatattttgggacggagggagtactctatctctatctcaaaaacatactcctacttaaaaacagaattagagaataataattaattgtgttacatagtgcaaaccataggacgtggagtactccttaaataaacatgctgtaaaccgaagctacacaaaatgatggtgctacgactatttagtgtcaaaataagcccgaacacgctgtcacagcttatatactttctctgttgcaaataagtgtagccccacacagtttaaattaatagagctgttcttattttggaacagaggaaatagctaaaaatagagcaattaagtgcagttacttaattagcagaaagtatccagagagtgcatcgtctataggaaggagtactccctccataaaaaaaaaattcaaagaccaatagataaatatttgttcggagctattctcggaaattaatttaggagtacgtgtgtacgtgcgtagtagtacctatcaagtcaccggggaccttgccgttggagaatctgccggtggcgaccccgccggggaaatcctgcccgtacggcgggaagtcggctctcgccttcgttagttgcccgttgttgttccctggatccacgatcgagtcgccgaacatgaagatcgccttgaaccggctactcacctgtgcctcactgatgcctggtgcaaccccggccaccaccaccaccaaaacccccagcagctgcagctgctgcagcaggaccaagcttctaccgcggcagcggcgacacaagtggccggcggcgcagaggccctgcagctgctcccagcaagacgccattggtctctctgcctggaccagcggaatgtgcgttctcctgccgccacagcactgaatatatagtacagttttctttagctcttgccagtcagtatagtactcctctgcaactacgggccagagctagctaatactgcttctactatcaattggcatgatacggtggttgtcagttaagttcattcattgcagtgcatgggatagaatgcacatggcaccatgaacccgatcaacgttttagagacaggcaaaagcacgggcgcacgagagacccgctggccctcgtcaatttgatgtgtccagcccagaatctcaccagttgtgcacttgtgctacgtacacggtataaatagattaggacgtgtgtgtaccaatggaagaaccgatcgaaacagactcgatctagctagcagacgcactaaaattaatattgtacagttacatccatatgttttgtactgtgtctaaggctgtgttattcccccatctttttcaactcaccttcttcatttccatgtgcacgtttttcaaattgctaactggtgtgtttttttaaaaaaggtttacgtaagaaagttgttttaaaaatcatattaatcaattttttttaaaaaaataataaattacttaattaatcataagaaaatgtgttgctttattttgcgtgcgggaaaggtgagttcccaatctcacctcctaaacacaccctaagaaggaccgtcaagttgacccaaattaatattctagacactgatggatcaagaagaaaataacgaggggtttcagtaaacttgagaaagctatatatatctcttcttcgtatgtatattctgtatgtgcatgtgataaaaagttttattggggattttatggtggtcctattgtcagccgtggaggcttgagctttcgtcgccctcattctagatttgcccctgctaggcagcgataggtttgtagtgtaaactagctgcatgatggcattataaattgttagtgaagtagtagatgccaaatcggatggtaataaatatgatttgggagtcgccacaaatagtcgatcaattgtcaacctcatggagaataaagctgatgagcggtaattgtcgacccggacgagccaaatcatgggcgtcatgaatgcacgccgagtacactgctacagctcgtctcgcctatagaatgagaatcactatgatgggcaagcagcatcagcagcaacagaagatggagccagtacttacagttgttgcactagcaagagggctccacttctacgaaaatcatctttcgtggcggtcagtttgggttttcgctggcggaatttggagccgccacaaagcaaaggctagtgaaaaatcaagattttcgctagcggttattggcccgcaaagattaatttttgctggcggctggcttaagacgaccgccagcgaaaatgtagtttcgctagtgggttacactgagccagccacaagagaaaatactagccattcataataaattcaacagattcattcacaaatcacaaattaacatatccattcacaaatcacaataaaataccaaaaaaaaacattccatccattgttctctcaaaaaaatccatccgcctcaccaccgcccagtccgtcgctgcgccagatctgagagagggagagggcaaggggaggagcgggggagtgggggagagagacctgggaccttgccgtcgccagatcagccgcccacacgcctcctcgtcgccacccacgcctgagctcgccgctcctcctcggcctccccgccgccgtcgccgaccgagcagcaccgatgtgtgagccccatcgccaagcatcaccgccgctggcggctccttctgccatcgccatcgcagtcttcgtcgtcgatgccgtgcccccggacgaccgcctcctttaccgcagccagccgttgccccttccccgctgctgccgtcgcccccagatctggccgccgtcgccctttgccgcagccggccaccacgggggagacgaagagcccgccgccggaccatcgcccgccaccgctgccagccgccgtccaccccaccgctgccatcgcccttccttgccactgccgtcgcccctagatctgccacagccagccgccgctggggagaggtgggagggagaaggctaggaggaggtgggagggaggttggggagaggtgggagggagaaagccggagaggagggggagccgaggagacggagcatggatttttaatagcgtggagcgttgggggggggggagaggcggtgcatttttaatagcggtgaaacatatattttttgtagtggtgctcttcctggtccgccacctaaaatcaggttttctgtggcggacacttaagaggtccactacgaaaaatagagtttcttttatgacggatctcttagtgtgcccgtcagcaaaaatcggttttcgttggcggtccgtaaccccccctcgttatatttttgttggcggtttgtacgtattgccgccagcgaaaattatagggtaacgctatgaaaaatcgttcttctagttgtcctcaatccaaaacaataacttctacttatccaacacaataaattcggtctacttatcggcaaatactactgtatatatgttggtaatttttttttgacaagaagacaatcatgactgggacacataaacaggctagccagctcaacctagctcaagatgagttttgatagattaaaccggctagcagggccgatttagatgaaacaggcggtaacactcgtctcatgggcgaacggaaagtgtacgggacaaaactacaaaaggatttcgcactctcacagtgaaggcggacgatttacagcacaaattgacaaagatggacgaacttggctaaaactaggcgaaaagtagatgcaatattgaaaaggtgattcaattggctaaattgtgctgagagtagattatacctccgattgaactgaccttgtccctaatataggggttggtctacttagagtccaactggtccccctctacataccttccggaacaaggaaacccaagacccgacaatatgtagtggagtcggggtcagactttgccggtctgaccgcccacacaccgtcggtcaaactggtccataagcagcggtctaacctgcttcgtgaacaatttaaaaataaaaaaatagcgtaattgtttgtaccttgtggtgtagctttaggttgtgttgggtaataagagttgggaactcaccccaagcatgcacaatggaacgatgaattagcacatgaccaattcaatattagtgaaaacatttacaaattgattaatatgaattttgaaaacaacttttcaatatatctattcacaaaaatgcatggtttactagttagggaacacatgcgcgtgaaaaagaagggagcataagttgggaaaatgtagtatgtgttaacaacaaaattttgctgccatcttttcacatcaacggtatgtaacattgccttaagcttaagatcgcccatagcaacatcttaatttaagtttatcttctaatataaagaattgtactataaatattaatttattgtttaaggttacctttacgaggaaagtgaagatgcacttaaagcgggtacattagtcctgcataaacgggctataaaagttaacacgtcatttctatactatgacagaggaaagagagtgctaggaaagagaaaaactcaccgccacaccttgagcacgttatgtgcaacccgtggcggcacccggagacgcgtcgtcgtagggagtggtagatgccgctattggtaattcttatggtcacagataaaatccgcaagcgcactgatataccaatgtagcacttcacctacggagtattccaagggtatcgaatcgaagggaacgtgtgtgattaattcttcctccggttcatctaaggacaccaagcaaagaataggctaggatagagaggatttaccagtgagaaacagtgtctaggaaaagcttaactttaatcgtaacgtgatacttgaggcactgggaacccgctatttccagatatcgctctactacatacctggacaggaaggacttaagtgctcttgagggctgtcaccacctctacctacctcaaacgtactgtgggatacgtaataattactggataataattacctaaacaccacgtctaagcaattaatatataccttagtgtttataactcaccaaagcaatcactatattttagttgattatagtgacaaaaatcccatatgctatttacgaactaaccaagagataattctcacaagataaatctaaaatactcaggaaaaataattctattaatatcagagttatgaatagaataaaagaaataagagaggattaccgacagctccggaattctcccgacttcttctactctactctcttcctaattctagtatacaaatagtacaatagagtctcttgtaattcaggtgaagctcggaagtgtctgaagaagtgaaggagtgaagctccttttatagagcaggtaatgacggttgtggatggggaattgtccgaagtgccctgcaaccgccattaggaatgcatctgggacgtccatgccaaaccataggatcgacggtggagatgtgagttcggctgaaccctggcctggcccaacaagcccaggatttggcctgtggacttcccctgacctgccttatccttttctgcaaatttcgggctgattctttggaagttaaaaagcctactcttgaatgaataagttccttctccaactttagtctgattttcctcccaacttctaggtttaccatctacatacaaatatatactaacacttgtagaaaatgtgagatttaacacctatcagtatgttggatgttttattatctggactttatgcagatgttggtggtatataatcggcatttaacagccgccaacaaaaccccccacacttagctttttactcatccctgagtaaatattggtgtagaatgaagttttccaagatataactcaagcatataaattattcaaaaccatacctatacctgtgaactttatcagtggctaacttaccatcttgggtaattggtaaatggaatggtcttgattccagtccttcttacttcatctatcaaactcttgggattttatgaagtttcgcaaaacaactcttttcctcttaatgactttttctctatcactcaagtatttttgactttgtggatcctcaccaaggcagattgtgccatattttatccctattttacaagctgatatgttgggctcggtagggataaattgtgacatacctgcatcatatatattgcaaagccaaatatacagactcaggaagattattagtcatacttctagatcaagggtctttatttgaggtggtaaaaagaaaagttaaatattttgtgtaatggtggaatagaaatggttctcctttttcctatactttcttctccacttttccttgcataaatatggaaggggcatggctactgttttttttcatcatgctcaatgttttgagggcaagctttatttctctctttttttatagccatgcctttccctcctttttttcattttctttcttttgccaaggttttttaggagaagaaagcatagtctgaataggagtttatttgaatgatttttttttgggaagccaacttccaatgtagaagcttagcttgattatatatatggaaatgaaaatgaaagtggaaatggcctcttgatcatgagagtatgaaggatatctaacacgagtcatataaatttgacaaagctgcaatcatatgcgtaataaggtttatcattgatatacttgcatatggccttgataggtataagatgaagtcaattagaggaatgagcattgaaaaagaatttttattttgaaaaacaaattcccaaaagtcatggcaaatgtagcaagattttctttcatctttaaccatctctcatataacaattacttagatgcataaggttccctaacatggatggttgttcacaagtaacaagtttagctaagaataaaatatatacaagattaatcataggaagaatttcattagttggaaattttatcttttcaattttgcttgaaccaaatattttctaaattcccagcccttgtactatgcaatggtggagatatataggcagtagacgtgctcacttgcttacctgtgaaaaatgagagtgattggggccagtgtgggttcggccgaacaactctagtgcccaatcactctgcaattttctgcagagtccagtgcacatcaggtgttcagatattcagtctcattttttgaatttgcatgtcaaaaagccgaggtatctcccccacttttatttgaaacctaaactttattaatcatgaaacaaaaacaacttggcaaacattggtgttaaaaccaatgagccacattatttgagaacaaaagaccaagcacctactactactttattcatgagaaaggagacatctatttagcaaaatacttattctccttctccatctctatgaatgcacgctttatctaagcgcacaaaccgcgactaagggtatctacattattcctaagctcagcaagctctacctctagctccgcgttgctgtccctaagctcaatattctccttgcgaagtttgttcacttgagcagcgagcttatggaccgagggctcctgcgattttacttcattatcttcgaattgcccgggcgccctcatgataggaggaggcatcgaatgacgcttcaccttcataggtggagggctacgggactctgctgccccctccttctccgatgtcgtcaaaggccagagtaagctattgccatacccaccgccgggacttcgcactccccaattgcaaaaacagtcccccttagtggtggatggagtggcggtgggtgtggtatacttgtggagcacctcatcccctaccttagtgtaaagagtgcccacataccgctcagcggaaggcggagcggccttctcgtcgtcttggaaaagacgtctcgccttcaaaagactgagctcgcccatcgtcggccatcgtgcaggcgaatcaccccgcacttttgtctttgtgacatggagggggggagagggagcgcactgccgaacggggggccaaacgaggccgtgatgggttcggccaaaccgagggagctcatcgacgggctccaaatttgctggggagcccggcaccgtcgcaaggggttgagcccagagtgcgttcactccttcgatcgtgtagtttttcaccaggatcaattgattcacccgtgttggctctcctttaaggttataggtgtagtttaaggtggagccaatgtatggcatgagagatttgccagctatgaatggcacaagttgatggatcaaaggattgggttgagaggagattgagcaaattggtggaaaaacttttgcaaaggaggaggaagaagaactaactctgatgcgtgatccgatcgttctacctctaaacgcgcatctaaacgaactaaaagtgagcgggggaaacgatcatttgaaaatgggaccaaacgggcgccgccgtggtttggccgaaccctggtgggtccggctggccgccaattttctcctgggcccagacaaacctaagctaagcacaaaaatgacaactatacaggaaattaagcatgttttagatgagatcatcatggttcataatcaattagttcaataatacccacttcatctaaagtttcattcggctcaagaaaaatctttaaacgttgaccgtttaccttaattatgttacctgagtcgtcgcggagtgtgattgcttcgtgcgaagaggtgtcgatgacgtcgaacggtccttcccatttgctttgtagttttctatggccgaatagcttaaccctggagttgaacatcagtaccttgtctcctggcttgaatttcttgttctttattcgtttatcatgccagcgctttgtccgctctttgtatatcttggagttgtgatatgctttttctctccattcttctagttcagctaactgcattttcctccattctcctactccctcaaaatccatgttccaatttctgatggcccagtaggctctgtgctcaagttctacggggagtcggcatgacttcccgtagacgatctgatagggagacattccaatgggtgtcttgtatgttgtccggtatgcccacagtgcgtccgacaatttctccttccatcccgttcccattttgttgaccgtcttctgcagaatgttcatgatttgtttgttcgatgtttctgcttgactgctggtctgtggatggtaaggtatagcaacattgtgtttggctcccatgtctcgtaggaggtctcggaaggttttgtcgatgaagtgtgatcctccgtcacttatgaccatccttggggtaccaaaccttgggaagatgatttctatgaacatcttcttagcatgattcgcatccgtggcactgcacggcatagcctcaacccacttggagacataatcaactgctaccaaaatatactcgcaattacgggatttgggaacaggtcccgtaaagtcaatactccatacatcgaatatctcaacttataggttgtatgtaagaggcattgcatcatgagcagtaattcctccttgccgctggcagcttgggtatcttctaacaaattcctttgaatcctcatacattgttggccagtagaaaccatattgccaattctctgcctggtgcggaatgcaccataatggccaccataaggcgaggcatgacatcgttctatgatcttaagtcgctcttcagttggcacgcatcttcttaataaaccttcagagcagaccctgtataggtatggctcatcctatatatgacggtagctctcggatttcagttttctttgattttctcccggtggtatgtactttgagaccatgtagtttactatgttggcataccacggagttggagtcgcgcaccgtcattagcatgtcatcttttagaaaatcatttatcggttgttcccgcatgttaataatttgcagcctagacaaatgatctgctactaaattttctacttcctttttatagttaatttctatgtcaaattattggagtagcaaaatccatcgcaagaggcgtggtttagcatctttcttagcgagcaggtattttagagcagcatgatcagtgtaaattatcacctttgctcccaccaagtaagatctaaacttatcgatagcaaaaacaaccgcgagcagctccatttcagtagttgcataattcaacagagctcaggttagagttttgctagcataacagattgcatgatgctttttatccttggtttggtccaaaaccgcaccaacagcaaagtcgcttgcatcacacataatcttgaagggtaatgtccaatcgagaggttggatgattggagcagagacgagtgcctttttgagtatttcaaaggattttaggcacgcatcgtcgaactcaaagggagcatccttagctagcaggttggtcagtgctcaggcaattgtagagaagtccttgatgaaccttctataaaagtcggcgtctcccaagaagttatggatcgccttgatgttcacagcaggaggaagttgatcaatcatatcgattttagcacgatcaacttcgattcctcgctaggacactcgatgaccaagaacaatcccttcacggaccataaagtgacacttttcccaattgagtaccaggtctttttcttggcatcgttgcaataccttgtccaaattctatagacaatgaccgaaggtctttccatagacagagaagtcatccatgaagacttccataatgtccttaatcatgtctgaaaaaatggacatcatacatctttgaaaagatgaaggagcgttgcacagtccgaaggacatcctacgataagcataggtgccgtatggacatgtgaacgtggtcttactctggtccttcgaatggatgggaatttgatggtacctagaatacccatcaaggaaacaaaataatgaacaatttgctaaccgttccaacatttcgtcaatgaagggtagcgaaaaatgatcctattttgtagccttgttgagcttcctgtagtctatgcacatcctccatccggttatggtttgttgcgggataagtttattttgagcatttgcaacgaccgtcattcgtcccatcttcggcccaacctggactgtgctgacccactcactgtatggaacggtataaataatcccggcatgcaggagttttaggacctctttctttacgacttctcgcattgcattattaagccgtcattgaggttccctggagggaatactctcaggcttaatagggatacgatgagtgcaaagtgcgggattaatccctctgagatcctggagggaatagccaagaatggcacgatgcttttctaacatagatagaagacgttgagtcttgtcttcagaaagcttgtcacttatgatgacaggagcttctttgtcgttgtggaggaaagcacagcgcatgccttgaggcagatatttaagctcaatcggaggtcgaggcggcggttccatgattggaagctcgagtctctttgggttccgcttcattttccagaagggtctcgggagactcgtgaggggcaactgccgtaacctcctccgcatactcattctctaggagtgagtcggtcaaggcgaaccttgctcgtgataatggaactggaaattcgttccctcccaaagttatcttgaggctatctgatcggggcatgtttatgatgagttgctcaatcggcagctcaatcagaatgtcaaagtcttggatttcaaagacatagaaatccaagactgcctccctatcttcaaagtagacagttatgtcttgtacaatcccgaatccttctacgaatggcttgaaaaatttccattcgggtgcttcaaattttgtttgtcggggttattgctttatcgcttaggtaagtgaatgcaaatgcgtcgaagacgagattaaccccgacagttgggctgtaaaggatactgacatcgttcccttctagatgacaaggaataactcggggagcggtatttatcagaattacttcggatgaaagctctgcctcccttagccattcgtcactcattatggatgtcagctcccggacagtttcccttaagaacccaagttccaaaggatcggtaggtggcaaaggaacgatcggcttctttttactgaaataattcagggtgttgccgtaatcttcatcaaaaccatccctgaacggaattgcggcacgatccggagtctgaatttctttattctcaacgaatggcggctcgggaacttcttcatcagtcgagtcggtcgatgtggaaggttcagggtgtgattcgactgttaaaggctcctctatcttagacacggatgcctctagtggaggttcatcgcatggcgtcataaaggaagtattttctataatgcggtccagaattacttttccttctgacggcgttttatgcatgaatgatcctccggcggttatgtccagatagaatgtagacaccttacctaaacccgtatgaaaatgttgtaaaagcacatactcaggtatagataaggttggtccagactaaactaaattgaagggctgtttttgtgtgtcttctgcttcggctgatggaaggccatatgcttgatagtgtggaactcctgttgcgcaaaaaacctggtccttttccttttgtctgtcttttttagtctttatgctgtctcttattgtctttcttctctgaaccttgtaagctactatggcctggtttagttcccaaaaatttttcaaaaaacatcacatcaaatctgtgtacacctgtatggagcattaaatatagattaaaaaaaataattgcacaattagaggggaaatcgtgagacgaatcttttaagcctaattagtctataattagccataagtgctacagtaacccaaatatgctaatgatggattaattaggcttaaaagattcgtctcgtgctttccatacgagttatgaaattagttttctctttcatgttcgagaaccccttccgacatccggtcaaacatctgatataacatctaaaaaattttcttttcgcgaactaacatgccctaagtttcatttctggtaatagaaataggggcaatcgcccttgctaaaaaaatatacaagatttatgtagtatcagatatgaaattcaaagtgtaaaatatatgttacgaaatctactattttgaaagaatatcactccagttttggtaggcccgtaaactgtatccgatatcgatcgttaattagttatgggcggtgaagatgcatggcacccacataccgcggtcacgcatattattcgcgcggtggtgtggacgggatgacatgcgcaggcttgggcgtgctcaagaattgcggtgaggaggaagcgcgcggtggcggtggcgcgccatcccgcagcatatgcttgcaggcgacgagccaacagtggcgcacggcagccaggaggttggagccattttttgggtcagggcaatattgatggacgtctgcctgcggaatgaattctctgccggtgatccgtcggcatctacggcgacgtcgccgtaggcacgcgagacgcgaccgttcatcattcccagtatttatcgtcgactgctgactttgcaactaccacatgctaattatttgcttttctttgaaactccatactacaagggcatacagattacgtactccatattatatacatgcacgcgagtgccattttattctcttcacacatactcgaataaatagagaatagagaaaccagtgagctctcaaaatttctgtttcaaagtatacgtgtaattattggcagcgttttaatacgcagccccgtacgaaacttcccgtttgcgactggaaggggatgatgatgattaccgtcgatactgttgcataaatgagcctgatatatatacgtggggactccaggcggcatcaatgcgggactatgaccgaatggactggtaactaattgattgtcagctgatatctgcggaatcaagacttctgtttttcatccgacttccgagcacatgcagcactcagacccggtttagatgggactgttttagttttaagtcccctatcacatcggatgtttgaacattaattataaatattaaacgtaaactattaataaaactcataattttggactaattcgcgagacgaatctattgagcctaattaattcatgattagcctatgtgatgctacaataaacattctctaattatagattaattaggcttaaaaaatttgtctcgcaaattagcttttatttatgtaattagttttataagtagtctatatttaatactctaaattagtgtctaaatacagagactaaagttaaatccctggatccaaacaccacctcaaattccacatctaagcacgccatgatatgaattctatttgtaaccaacatggccaagcccaagtaaccagtcaatccggtttgtctgcgctgctcaacaaaataaatgtactgtctgcttaactaatgtcctagagattaatgtacggtagtatcgaaaattgagtggtgttggttttcctttcctggtgaacgtgaagctgatgcaccactgctatggaaaacaaataaagacttgtcgcactaacaatgattatcgtaccggatgagttaggatatacaattccaattcgcaaaatgaaagccaatatctgtattcaagtaatatttttcgctaggatcagcgcttagggtagcatgatgagaagatgaatattcaaggtttgatggcaacactactaaaagaaaaaggctttatgcatgtgttgatgtaaaaacatgaggccttggagatctgcttaaatccagtgcaggtccaaaagcttgcctttaggtgtacgagcgtgccagttgatttgatcctgcaatcgacaagaaacaaagacaaagaaaccgcggttaaatccataaacgatagccgatcggctagttgccgatgacatatcatattatctttgagccgatgtcatatgtgagtcgatcggcaatcatgaataagtaaaaaagaactaaatctactcgatcggatgtagatattaacaatatataatccttatgtcgatatatacttaaatcaagtgattgggatagatcagtcgccatgccgagacagtataaatcacttggatcgaaatatatattaacaacaagactatatatgttcgtagcataaccgatcagatagatctagcatgtatcagctaatactccgatactactatatattaagatattaaagcaagtagaatataccaaaccgaagcctaatatatttaaatgcaacaagatcttaacataaagggcagatttaacatgtcaattaagcacacaagataaatattagttaaatcaggtaagattggctgaaaccccgatgctaccctaatcggcaaccaaaggcaggctagagattgagattctaatcacgcctcataagatcaaactcaactgatgcagctataaatatgaaaagaaagacaatatctacataatcaagctgttgaatgtttcatagagtggtagatatcttatataatataagtcaacgttaatatataacctaaccggctaccttctagtaacagacgctagccgattgaaggttagatagcaatattgccaaagattatgtaagatatatgataactcaatgaattacataaacaatattagagtatcataaaaatagaagcactaatcccgagaacgcaagccgccataacaaattttacctcttgttgaagatcgaaaccgatgcagctcaaccccaaagcaataactcgtcgaaacaaaacgaaagtaaaagggtggcgatgcgccgagattgtatagaacgtgtgttagattgattacatggggctcagggtctatttatacccgagattacaaaatatgtccatatcggacacgactcctatctctaacaaactttaagataccaaaagtctttgcggcagaattttgcccaaacatatctctaaggaaattacatgaaatatcctaattaatagatacaattgccttcctagtaccctaaccatgcgtggcatcctcaagaagtacatcaacccaacccgacaatgtatgtcgtgtcatattgtcagattcgaatcaatcggctaaccttgtcctactcggactatgccgatcctgattgcagccgattcggactccagccgatccttactctgtttccggaacgatctccatcttgaactccgtttcaattccttcttcatctccgatacttggattaccaaatttggtcattaacaatgtgccagttgtcaaccctagataggcagcaggcagcatctttgagttctctcaaaggtgttggtttagttttagtttaagaaccagcacctttgaggtcctaggaatgaaaataaaaggccggctcgatgtatcggctcgattcgagccaatgcatcgagtaactcctattcaccccaaccagattttgtcacattggtaattgcatattttgtaatctagggtataaatagattacttcggaagccaattaccaattactcgattcgagccaatgcatcgagtaactcctattcaccccaaccagattttgtcacattggtaattgcatattttttatattggtaattagcaaaatatttagcccggcggcgactccctccccttcgccagatctggtgggaggagaagcggcggcggcggcccagctgtgctctcccctcccgtccccttgcttgtgttgttgatgttcttgtatgcttaatactcttgcatatcttcttcttctgctggttacccctcctcgtagttgtggattcacggcttggtgttaggcagtcttgtgcctaggctgtgcgagggaaatccattgaggtggagtgctatctctgcagtaaaatgagacatctaagggcattcacagtgcgtcacacaagtctgaggagcctcacaatgccacatagaccaatgctacgagtctaaaatctagattcttcacagtgcaagtggctctatgagtggcttaattttatatttcagcccctaacacctttttttagttctattttttttttctatttgaatagagatacaaaatttacaccgaacaccctaaaatctagaaaaaaaaataaaccacccactccccctccccctctctcctctatcccttatcctctccctcacgagaaaccgtgcgtctccccccttctttgccaggcgcgcgtcccctcctcttcctccggccgtcgccacctcccctcctcctccagccaacgctgcctcccctcctcctactccggctgccgctcctttttcgtcatcggcagcgccgctcctttccccggcggtgggatcctgcggcggagcgtggccggcaagcttctgtcataggatggggtggcgcgtgtagggtgacgagctcggggggagatctcgtggcatcgactgtacccccacccccaccagcgtcccctccatgcaaatcgaggcggcaggccgacgtgctcccctgcggcggcgcaaatcgactgtagccggcacggagactatctcactctccagatccggccagacgtaaggtggtggcgatggcggtggcagccttgttggcaatgccttcctctctctttccgtggatgtgggattaatcggggtgagggcgtgagaggaagaagagcacgggaaaggaaaagatggtgttgggggtgttccctcgctgaagacacaccacacgaggctccgtcctccacaacgtggttgcacacattcctccatgcttcacaagccctcaggcgaggtgaagaacgagtgtctagttttggctcccagaacttcgtttggctccgcggattgttgatgtggcgccgaatattcggttttctgccgtggggtggaaccgcacgtccttacactatgaatgccctaagagaaagttaaattctctctctcgctttacctttatcggttccttatagctgcatgtgacgtcattaactcctctcctagcctagttagcggatcccaccttttcttgggggcttgtgtgcagcccagctgctaaatagtcactcgcttgtcctttctcttagagcaggtacaatagcaaggtattagccggctataaacatattttaatgagataaacaatgagagaggagaacagcaggctatagatctgtaccaagctgtagcacgaactccaagacacaatgtgtgtatgatatgtgggattatatattaatagtcccggttggtaacaccaaccgggactaaagatctatttgtagtcccggttgataacaccaaccgggaaaaaagatcgccatacgctttactcccagttggtgctaccaaccgggacaaaagatctatttatagacccggttggtaaaaccaactggggaaaaagattgacgaggggatcggagaggtgcgcgatcggatcgaggtatctcctcctctcctcaaccttatctccccctctcctttttaactcctctcctcaaccttatctattcttctccttatctttattcctctccttctcctctctactgccaggccggcacgaggacggtagggcgtggagggccggccgacgcggcggcgactggggctggcggccgcgcggcagcggggcacggtgggccggccggccggcagggcggcgtggcagagcgcagtgaggcggcggccggcggggcgcggagggccggccggcgtgggcggctggcggtgtcgcggcggcagggcgtggagggccagccggccggagcggtggcggcgcacgtctaggcagcggctttctttctttttcttttcttttttggagaatctgagattgttgtgggatgtatttgatttgtgtgtgatctgaatatgtgataaattttgtagaagttgtgatgtaatttttttaagattttgtgatgtatttgagtatttgagactatagatttgtggatttggaggcaatttgaggatgattgatttgggattttgggaacgggatggggtgaaatcaatatatttaaaaacaatgaagaaaagaaaagaataaagtggaactggaaagagcaaccggatctagcctgtttagtactaaccaggacttaaaaaatgctttatctttagtcccggttggtaacaccaaccgggacttaaaaatggatttttactcccgattttttttacccggaactaaagataatgatctttaggaaaagcgggactacaggggttacaaaccgggagtaaaatccccttctccaccaatggcaggcctttcagccctgtagcatgcaattggcccatagtatccaccagttggcatttatcaacttgcctgcttcataaggattaacgtgatacgctcaatcatcaagcatacgaatcgtccatattataataaaactatcttgttttttcatgtacatgcatattattttttttcttcaagcagtaataaaatgagcgtatagatatattacatatatggatggcagttttatttaggcttgcctaggccaaattcaagctccactcctacctcctctcaaacgtagccaaaaacccgtgagttattggacttgggggtggagcccaatggacaagggggttcccagctggcacctggctcaatttacgtttttactgtttaaccccatgttttgaccttatgggaacactctctaggcatctcttggaaacgctcttagtgtatcccttgcgagaaaaagaccaaggtgaggggggtgtcgaaacaagatttcggcaataataaaagggtgtggctattacgctggaaaagtggatgggtttagagacaaggaattttatacaggttcagaccttcttaataagaagtaatatcctactcctgtccgaggattgatccgccgagtgcattgttgatcgtatgatctgggagcaaaaatcgtaccccaaggggcacccggacccctccttatataggggaagaggtccatattacaaagtacaacccatatccctaacggaataggtagttacagaaaaaatataatcgtaaccgactagaatctcgggtatttccttggcatacaagtttggaatttaacccgagtccttttaaagatattctatctatacatggcctcccatacccagtcggatatacatgccgtgtaggtatggggtatccataatctctacaggggggtggccggcccaaatgctgaggcgcgtggtcaacgaggtagggcagcggctgcgtcgattggattgtcgattcctagctccccccacgacttatgaagcgttgcccgtcctgttccattctttccctttttccctcttcctcatcggaaccgcttgaatcactcgtgtcaatcgcctactgtggagattatgggtaccccatacccacacggcatggttatccgactagtcataggggatagtttatatctatggaatatgtaaccgatcatgacttgggtattacgtttccttttatattatggagcggcctaaagtcctgatttgataatattgtaaaatagatttaggaaaccgataccgtattggttaagatttctatcttgtaatcctgccccccatcctatataaggtgggaaggaggccctctagggggcatgacacaaactgatcgtcagatcaatatacacccggtggattcaaatccccaaacaggagtagggtattacttatcattgagagggcatgaacctgtctaaattatttgtctccgcatccatccatttttaggtctcgtgcgctacccccttttattattgccaaattcatgtttcgacagttggtgcgccaggtaggggtgcatcgagtttcccgtcgatgagtgcgatggaactaatctccggcgttgccagattcgtcaagcatgtccttttcgtctcggatttgttggaattaatgaatgggccttagcccactcgaagattaattctttggaaaatcacaaaagcccacctcatgggatggcatgcatgtggagttttgtaccaccttgcttattctaggagagggagacctccttaaaaggggggatgccctcctagccacttgaagcatgtgtggtggagagaagaggggaaatacacgcgcgcgctcgctcgcctcgcctggcctggcctggcagggcagggcagggcaggcggcgcgcgtgcacgacgtatgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgaccgccgtcttcacgcaatatatgcgaaaatcaatctagggtttgcctcctagactactccatcccgctcgccggcgtgcatcagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgttccttcgtagacacctgcgaaaagtttcgaccaagcagccggtcttttcgtcacctcggtacgtgttcaatatgttgcgcatttttgatctgttaatgttattctgcgtagtttacatgtgtagatctaatgatgcgttcatgctagttttcatctgtaatgtcatgatttatttatggaataaattaaatcattatatgctgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagttgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctctgctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaacaaggacaaaacaccatatgagatatagattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggtttgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcattcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtttcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtagaattggggcttcactatactaggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatacacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagatttgcaattcaaggcgtttgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcagggcaggcggcgcgcgtgcacgacgtacgcgtctaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgaccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgttcgcgtgtttcgtgccttcgtagacacctgcgaaaagtttcgaccaagcagccggtcttttcgtcacctcggtacgtgttcaatatgttgcgcatttttgatctgttcatgttattctgcgtagtttacatgtgtagatctaatgatgcgttcatgctagttttcatctgtaatgtcatgatttatttatggaataaattaaatcattatatgctgcccataatctcaacaggattcagtccagccaaagggattagtctcggcgatttcatcgatttaatctttaatatcactggctttgccgtttcagtagtcagattgttttctaacggcagattaatttcctgttattctcttgattttgcatgccgactgagatcaagatcaatggctgtcatctcggtgtgtctgcccaacacctcgggatccccaatgcaccatgtacagatgccgatgtaatccgacacgggagtggcgcggaacaataggcagtgcttacagctcgcacacgattgagatcgccagccaccagatccacatgcatgtgttgaccaatcaacatgcaaattttgatcatccaggacacctcgccggaatcatgcatcaattaattcatcaagcatgctttttatgttccagatatacacacgcgggcttatatatatatatatatatatatatatatatatatatatatatatatatatatatatatatatatatatatatatatttatttatttatttatttatgcttgtggtactaatcagattaatctattaattgatctattttgcatgtatctggaccggttgattcggctgctgccgactggtgttcccgcctacacggttggttggttggtcgcaccaacgtggttaggcattcatgtcttcaccaactggctggacttcgccaccgccgactggtgtttccgcttgcacggccggcttattatgccgccgttgtcgggtgtctacgacttcaccgccggcctgccttcgtcgccgccgactggtgccctcacccaaacggttggttggtcacaccaccgttcatgggcgtccacgtcttcaccgaccggctggcctttgccgccgccgactggtgtttccgcctgcacggctggcctattatgccgccgttgtcgggtgtctacgacttcaccgccggcctgcctccgtcgccgccgactggtgccctcgcctaaacggttggttggtcacaccaccgttcatgggcgtccacgtcttcaccgactggctggccttcgccgccgccgactggtgttttcgcctgcatggctggcctattatgctgctgttgttgggcgtctacgacttcaccgccggcctgcctccgtcgccgccgactggtgtccttgcctatacggttggttggtcacaccactgttcatgggcgtccacgtcttcaccgaccggctggccttcgccgccgtcgactagtgtttccgcctgcacggctagcctattatgccaccgctgttgggcgtctacgacttcaccgccggcttgcttctgccgccactaactggtgttttcgcctatacggttggcggactccgccgccgttaatgggcttcatcatctacaccactggcttggttccactagcgccgactggtgtttttgtcaccattgatggactgcttcattcccacatcggctactcctgctgtcaccgagggaatactacaaagctaagttgtcgcgtcccaaaacgactctaaaatacatcctcaaaattatgcatagaataagtaaaatccatgtgaaagcctccaacaattaaaatgtgcaaagttaaaagtcaaataaggcttagaggatttttgtatatttcctaaaagcctaaaatgcgtaaataaattttagtggaattttcagagcacaaataataattattaagaaataaacaaagttaaaaaggttttataaaaagaaaaaccctaaaaagtccttttttccccctcatccggcctctctctccccctcccgaccctatataaacgctccccgtgcctccctccaccgtttccgccactcgccgctctctctccccgtcggaatcgagctcgcgccgtcgcccctctctctccgccgtcgccgccgagctccggtccgccgccgtcgtcgccccggaccttctcccgcttcggcgtcgccttcttcgggttcgccgcaacctcgccgacctcgtccacctctccgtttcggtcgccgaccgccggaacgccgccgtcctcgtctacccgagccgcgccgccgccttcctccgctccggtcgccgtttccgccgtcgccatcgaaccggggtgagccgtggaccgcccatttcgtttccccctcccctcccctctctcggccgccgctccgccgtgcctatggccgccgccggcgaccatagaggcgcgggcgcgccgcctcccgtcggctgtgccggcgaggccgccttcgggcgcgccccgcggctgccatgtgggacccggccgtcagccgcccgagccctcgggtgcggctgacgcgtgggacccacggcgccggccggtgtgagccgcgtgcacccggtccaccgtggaccgagaggctgccgcgtgggccccactcccgtggacccggtccgcgcgctcctcccctcggctgacgcaataaatccgattttaaattaaaatttaaatgaagaaattcgcaaatatccatttaaagagcatataaacttcaaatggccataacatggccatttgaactcggaattggaccgttcaagtctctaatttttccttaagaagtcaagaacccatttttgtactttgtttctgcttgttatatggagtttattagagtaaaagccttttcttttccgttggtcgtgtagacgctgcagcttcggaagatccgctcttcatggaagttgaagccggtgtttgggaaagcgagcaaggcaagtcacatcatctttgaacatattgaatcccagtttataaaattatgttgatttaaattattgcattatcgctttatttaaattcccgtgttatcactgttttatttagccatgcctatttacctttgttacgaccttattattattgttattgttattatttccttgttcaccctagaataaacaaaaccccaactagtggacactctactcatggtatcactagtatgattttaggtagatgcttcgcttttaattaggtaacattaggcggttttacaactctagactttgggaatgttcgtatcacctggacactatggaatggtttggttattgtgaaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggcttagtctagttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcccaggggttccggccgtaggtgggattgggtcagtactcttgtctatggctaggatgggttggaaactatgtcacgtctttcgtctatataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcatgtgggttcacggccttgattaataattgtatagttctagaatcgtgtttacaaaatagctttgagcaactaatgtctttaaatgctgtttactgcaaccctaaccctttatagtataactcctttgtactcccttgcatttattctgcacttgtgggtgtgtcttgttgagtacggtggttgtactcagtcttgctcaatttttcccaaacccagaagaggggttcctggaggatgaaggctttggtgtctagctcgtgcctgccgtcaagtgcctgtggtcgtcgccctagtcttccgttgtttctcgtttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacaagccgtagatcccaagccttagcagtattttcgaaataaaaatcctctgttatttgtgaaaaccctctagtctttctctgtcttgctgcttcatttatctccaaaatctgacctttttaaagtgttgcttttctttttgtttgtagatggccggcagcgtcacccgtcgtggtttggacatgactggtttcgtcttggagctgcggggcatgtgcgttgtcctggggtatccacatggggtggactaccagggcaggccgcttccggagcaggagggtgacgatgcagagccccacgctgcttgggaggtcactgcagtgatcctcgctggctctcccgagcggacttcgttggcagtcaccgcgggtggagattctttccccgccacttgccagagcgccgctctcctcgccatcggcactcttcaccagcgctacccggacgagttgcagcactcgcccttccgctaccaccctcgccgcggaggagcccgcgactacgccaccttccgggatgctagctcggaggatgacgctaccatcatgcacctggcgcgcatggtggaggcgtacgacgcggctcgtatcgacttccatcagatggtgcgccgtgggatggtcgagaacaacatgaagatcctggagctgcgtcaggagaacctgcagctcaagaaggacctagacgcggtggaggcgcagctgcatcagctcaagatcgcccagggagaggtctgccgccccaagcgtcgccgcgtctgccgcagccagaagatcaccgcccgcaagagcacctccaggcccgagcttgttcgtcagtccctagcgtggacttgcttcgtcgagacccctcgtgccgagcccgcgcccgtggttccccaggagggggaagcctccggcgttggtagcacggaggatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggcataactgtgtcggagcctgtctttattttatttgactaagcaacttgaactttaatgaaccaatttaatagcagtaataaattcaagaattatggtagtcgtgggtggttagctttaattgtcagctctctctgtttgctggttctgtgtggggttttcagatggtgacgaccaggagaagtgctgccaccggtgatggcaaccaacccgaaggcagcaaccaccaccaccagggcagcccacctccacctcctcctccgcctccaccaccaccaccagacaccaacgccattctcagccaaatcctcgcccagcaggccaacatgatgactgctttcctccaccacctccaaaatccgccacaacataatgctccaccaccacctccccaacactctaaactcgccgagttcctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctttatggtgggaccatttccaggctacgcagccagaggggcaacctattacttgggctcgcttcactgccgctttccggagaacccatgtgcccgccggagtcatggcccttaagaaaagggaattccgagagttgaagcaaggcaaccgctccgtgatggagtatttgcatgagttcaacaacctggcccgttacgccccggaggatgtgcgggaagatgaggagaagcaagagaagttcttggcaggaatggaccctgagctgtccgtccgtctagtctccggggactatccggatttccaacgtctggtggacaagagcatccgcttggaagccaagcacaaggaactggagtcgcacaagtgccgcttggcgaatttccgcaatcaacagggtgctaaccaaagggtccgctacaccaatccctatccagggggatcctcctcgcagcagcaacaacagcagcagcaacctcgctccgcgcctcgacctcaattcgtggtgcgcgtcccacagccgcagcagcagcagaatcaacaagggactcgtgcgccccgtcctcctacgccaactgtgcagcctggtcaaggccgcagggacgctcaaggtccgcagcgtctgtgcttcaactgcttcgagcccgggcactttgcggataaatgcccaaagccgaggcgtcagcaaggccaagcgcctccccgctccaacaacggtgggaaggatgtcattcggggtcgggtgaaccacgtgacggccgaggacgtgctgacaactccagacgtcatcgttggtacgttcctcattcattccatccctgctaccattctgttcgactctggagcttcccactcgtttatatctgtgccattcgtggggagaaatcagttgggggtagaaaggcttaggaaccctgtgctcatcaccacccctggaggggttatgacagcaaagtattatagccctgccgtccccatagaaattcaggggattccttttccctcggatctgattctgctagacaccaagaacttggatgtgatccttgggatgaattggttggctcaattccaaggagtagtggattgtgcgagacgcactgtcactctgtaccgagggccggaacaaccggttgttttctttgcacccccaacctctgtcagtagttccgaacttcatcagataggactgtcagaaatccccatcgtcagagagttcggagacgtgtttccggaagaactacccggtatgccgcccaaacgagagattaagttccggatagatcttgctccaggaaccactcctctgtacaagcgaccctaccgtatggcagcaaatgaactggctgaagttaacaaacagttagaagagttgtaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcgatcagcttaaaggtgccactgtattctccaagatcgatcttcgttccggatatcaccaattacgtattcgtgatgaagatattccgaagaccgcattcaccacgcgatacggactgtatgaattcacggtgatgtcgttcggtttaaccaatgcacctgcctttttcatgaacttaatgaacaaagtgttcatggaatacttggataaatttgttgtggttttcattgatgacattctggtatattcataatcagaggaagaccatcagcaccatctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcactgattggaagcaacccaagacagtcactcaagtccgcagtttcttaggtttggcaggatactaccggaggttcatcgagaacttctccaaaatcgctcgacccatgacacagttgttgaagaaagaagagaaatttgtgtggagcccgcaatgcgagaaggcgttcaaaactctcaaagaaaggctggtttcctcgccagtgttaatcttgccggatactcgcaaggacttcatggtgtattgtgacgcttcgcgccaaggattggggtgcgtgctcatgcaggatggtcatgtggtggcctatgcctcacgccagctacggcctcatgaaggcaactaccctacccatgatttggagttagctgcggtggttcatgctctaaaaatctggtggcactatctcattgggaatcgctgtgaaatatatactgatcataagagtttgaaatacatcttcactcagtcggacctgaatcttcggcaaaggagatggttagaactcatcaaggattacgatgtgggaattcactatcatcctggtaaggccaacgtggtcgctgacgccctaagtcgaaagagccattgcaacactcttaacgtccgcggcattccacccgaacttaatcaacagatggaagccctgaacctaagcatagttggtcgcggattcttggctgcgttggaagccaagcttaccttgctcgatcgaatccgcgaggctcagaagaacgatccggacatgcatggactcctcaagaatatgaaacagggtaaagccgttggtttcacagaggatgaacacggaaccctatggaacggaaatcgagtatgcgttccagataacagagaacttaaacagctgatatttcaggaagcccacgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtacctgaatggaaatgggatgaaattgggatggattttatcaccggacttccaaagacccaaggtggatatgattctatatgggtagtggtggatcgattaaccaaggtagctcgattcattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtacccgattaaacttcagcaccgcataccacccgcagacagatgggcagaccgagcgtctaaatcagatccaagaagatatgcttcgcgcatgtgtcctggatttcgggaagacctgggataagagtctcccctatgccgagttctcctacaataacagctatcaagccagcatacaaatggcaccttatgaagcgttgtatgggcgcaaatgccggacaccgctcttgtgggatcaagttggggaaagccaagtattcgggactgatatcctgagagaagctgaagctaaagtcagaaccattcgggataatctaaaggtggcacagtcccggcagaaagttatgcagataaccgacgccgtaacctggaattcgcagtggacgattttgtgtaccttcgggtcacgccattgcggggtgtacacaggtttcagacaaaagggaagctcgcacctcggtatgtgggtcctttccgtatcgttgcccgacgcggagaagtcgcttaccaattggagctgcccgcctccttgggcaacatgcatgatgtgttccatgtgtcgcaactcaagaaatgccttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccagtggagcaaccacgccgaagaagaagctacctgggagcgtgaagacgagctgaaggcagcccatcctgatctcttcgccagttcttccgaatcttggggtcgagattccgtttaaggggggtaggtttgtcgcgtcccaaaacgactcgaaaatacatcctcaaaattatgcatagaataagtaaaatccatgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaaaggttttataaaaagaaaaaccctaaaaagtccttttttccccctcatccggcctctctctccccctcccgaccctatacaaacgctacccgtgcctccctccaccgtttccgacactcgccactctctct

SEQ ID NO: 59588 - DNA, 7105 bp, Oryza sativa
cagattcctcatgtctttaggatacatgatagccaactcccaaacatatgactaacattgcgaggatgttttaaattataagctagatgaattacaaactacacctagcaagataagcgacactgaaagaataaatgttggctggtttcatccttgtgacaaaaacaacatgtcttactacctttccaatttctcttagtaaggttgtccttggtgagcaattacgcctagcgttgataccaaaggaagattttttactttcaccttccaaatgcgtctattgatattcggaaccccggtatgtgttagagctagataatgagatttaaccgagaagaccccattcggggtgaggttccagtgaaactcatcttgctcatgtaccagaaccaaatcagctatgtgaggcaatatgttataccaagcagctagtttttcaccaattaaatttagcatttagccaacttagaaatccaccatggcaacaaatttgcgtttagctccttgactacagatttgtccccaaccctagtcctctctactctatatcttaccgtctttctaaccgggacgggttggggaggggggagggctagaggggcaaaattttgctctttatttgaagaaaaaaaatacaagagtctcgctaggtaataacaaataaattacaaccacaattttcgtgtgatatatagctacatatattatatctattttttgttccaaattgccgatggataaaagttggatgtatggaagtgatcgagtgagcccagagtttagaaggggcattgtcggtttcataaatgttgtagagcaagacaagaacataaggaacaatcaatgcatgacttgtccatgctttgattgtaagaatgagaagatgtttaccagcaccgtatgaggacaagcatgacgcatatctgatctgtcgaggattcatgaagggttacacatgttggacaaagcacgaagagcaataggcactgaataatggaaggcaatgaagcgagcagccttgtgaacgaggaaggacacgaagatatgcttgtcgcttccccattgggtggtgatcaggtggatgtcgataatgataccgatgacacctctgcgacgggctgaaaaacctatcggtgaacggtgagagttggggcccgacaagtatatctctatcatcggtcgtgacggctactcgccagacacaaatgagattttcacattagtgaccaataatcagtgatcacacactttgtggttaatgatgagggttgtgacccgttacggatgactggctccgtagtagtgtgaggtgtgttgcctgccttcacagtgatgatggcaccgcggcagattcatgggatcaccttctccttatcatactgcatgcatgtatccctatggggatctctgactaccgatgatcgatcactgccgtcctaatcatcatgatgggttaaaagcaaaatgtttgccaccatgtacagccacattagagcaggtacaataggaggctataagccatctgcaaacatattttaagtagataaatgaggagagagaatagcagcgggctatagatttgtagccaactgtaacacggactccaagacgcaatgtgtgtatgataggtgggatcatgtattaatagtgtagtatgtaactatatattatatgaataagctattagattagctatagatgaattgcagctagtagttggctatactattaaacttgctcttactgatccagacccatcaaatgtgttttggacctagggatttctgctactgccaaggtctcaaaacatctcccagccagtggtcttattcttgtgcacgtagaaattcatgtggaacgcgatagttctgctagctggaacaaagtgttgagattatagacatataatgatttaatctattccataaataaatcatgacattacagatgaaaactagcatgaacgcatcattagatctacacatgtaaactacatagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtagaaggcaaaccctagattgattttgcgtatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcatgcacgcgcgccgcctgccaggcgaggcgagcgagcgcgcgcgtgtttcccctcttctctccaccacacatgcttcaagtggctaggaggacatcctcccttttaaggaggtccccctctcctagaataagcaaggtggtactaaactccacatgcatgccatcccatgaggtgggcttttgtgattttccaaagaattaatcttcgagtggggtaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatcttcgctaattaaagccaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcacatgggtctcaaacccatctccttcgatgcattgtttatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccagggttgacctcgtcaaaatggtctgtttgcaagacctccatgaaacagcaccaccacccagtgtgaaaacagatccactagtggctttgatctcatccacatcagagatccagttagaatcactataaccctccagtaccgcaggatacccagtatagtgaagccccaattccacagtacctttcagatagcgcattactcactcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaccgagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaccaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctccgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtatatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcaaagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagacttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcgaaacaggcctccgcactcataacctttaccaataaaatatccatgtttagacacgactactttattagactcaaaaaccaacttaaatccgtctctaatcagacgggagtcactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccaatgttgccaatggtcacatcagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctagcatcagtagcaccgaatttagtattcagtgcatcccacaactccttagcgtcggtcatatgcatatacacctcgaccagacgatcgccaagaacg

SEQ ID NO: 59589 - DNA, 6635 bp, Oryza sativa
accatgcaattgatgtgcatgctagtatgccccccatattccggatgcctactattcatatcactcccttgaatcgtaacaaaattatggagttcttgcctcctctattatagttcctatctcaatcttctatctatctatctatctattatatactaaaaatccattaaacttcctacagacgctccctaagccgccacgtggcaattctataaacgctcataagtcgccatgtggcgttttaatatattagaaacatctgaccctcaattttcatttaaattggtgggtccataattttgcaccattagattagattaaaaatagaccctcatacgtatgcctccctcaccgcctgcaagtacgtacgtacaagtacgaacgtaacataccccccagacttttttccttttcttatacaccttcttttattattttgctttacctaatatacctccataatattattggtgtttgaacatatgtttatttactaaagaaatatgtaattatcatttattttgttatactctgtccattaaatttcctacaaacgctctcacgtcaccatgtgtcactctacaaacgcttctacgttgctaagtagcgctataataaattaaagaaaatcatataaattcttagagaaaataaaacatttaatcctcgattttcacttaaagctaagagaccattattttagacaattaaattattagatctataaaaaataatctctccctcctaatatcccgtttaaattattaaatctataaaaaataatctctcactcccaatatcctattcacatacaagagaaaatccttgcatacaattcatccgggaaaaaaaaggcaaaagctatacggatgtacgaacgaaataaaaaccaaagatattgataactatgattgaaaaaaaatcactgccaagattaattataaaagcaccagcctaaacgatcagccaagataatcaccatcagctcacggctccagcacgtatatgcattatctgctcttcttatttttaggttgttgagatatcttaggcataataaaatctaaacaacatttgatttatatcttcgattgaatgtagactttcatggttatcacggtcagtgtcatcttcgtggagggctccatgcatgtattaacttttggtcagtttagttctttacattcttgacaattaaatcaataatttaaatctatatattgatgttttattatcaaattaaaaaatagtgtgagccatatatatgccttcaccctttgcattttctatgatatagagataaaatatattactctacgaactttaaattaggtcagtgtcatctgcgtggagggctccatgcatgttttaacttttgaaaactataagttggttttatgattaatttagttctttatattcttgacaattaaatcaataatttaaatctatatattgatgttttattataaattaaaaaatagtgtgagccataccatcaccctttgcattttctatgatataaagctaaaatatattactctacaaactttaaattagtgaacccgttattttatactgttaaattaggtctattgaaaaaacaacccccccccccccaaaaaaaaaacaaaatctcccatgtaagaaaaagcaaagtaacatatatacacatgtaaaaatatatagctaaaaatatacatacatactatgatcagagaaaatcaatggtttctaaactatgattttccatgatataaaaaatattacccaaccaatatacgcagttaaactagatcaaagatgtaatatgaattcaatggtctgtaagtgttcatctattaaatatatatcaatttcaataattctgatgtattcctttaattaaatgaactattattgacctatagtagttagtgctaactgataaatacataatggcacataataattaatgtcataataatttttcaaataattatggtgtacaatatcacctgacaaataatttgaatctacatatgtaaaaatgaaaaatgaaaacaacagaatttagttatatttttttcaagtagatcttatctaattttaatatgtgagatattacgattttcaaatattttttttgaatttttcaaaactatttgattggtatttgaaaagtgagaagcacacatgatacatagacatgataaactttattaaaaatacttctagcgagtgatatggctatactacaaccccttaatccatcatgagaactatggtcatatatgtaggttttttgtttgtcatatagttttggcaacaagtaaacaatccagtaacacccataatatattttcttatacttcaggaattccgatgtgtcgggcatagttgatggatgtatgtcatacactctactaacatgataacctcactcactttcaaataagaatattgtatatgtattattgaaatttgagtaatattgatttacactataaacaaattgtgtctactatataccacaaaacaactcaaactttaaaaaggattattgtaatcacctccgtcttctctttttccattctcaaaagggtgccaagcatagataataaagcttgctatactaccatgatatagcaaaggcatacatttggatgagttaagccaccatgggtacttaacgatgcaatcctttatgagggtactaatagtgaattagccgttaaaactgttctccacgatggtcttgatgggcacgactatgtcgatatgtgacccatgtttcaaggtatcgaggaagaaagccttggtagttatgttcggcttcatccgttagatgggtattcatatcaaattttaacagtattatcctattaactcatagaagtgatattgttataatatatttttttgataaaatattattggaatatttatacatagatttggaaataagtcagatcgacatgaacagttaggttagtagtggagataatttttttagtcgattaacgatgtattgttcttattttgatgttacaaatacaatttcatctattaaataatcactcaggtttcaaaagaacgataataagtatccataataaaataaaataataataataataagtagtggcgatattaggcaaatttatatataaccgggacatagtgatttatgtttgaatctaggaaacgcttttgatataaacattaaacaaaatgcccgcacatctgcgcgggcttctttcctagttatttttaattccttctatgggctttcctagtttgcttctaccaatacaatctgatgagtgacatttattctctcttttttacatgtagttttcattggtccaaagatgagctgatgcatatatataaggataaagaagaatctacaataatctttgtccaattcattttcataggcgggagccaatcgccagaaaataaaaggtgtggtgccatgaaaaaacattttttttagtactgactaaaatattaaatagcagaaaaaaaagatttgtcacaacgagatgtatgcaataaatttactgttactcagaaatcttttgttctatgcaaaaacatgtctaggggatgtctgaagaatcttcattccacttgaccttgtttagacactggtgcctgccaacccactaaaatataggtggaacggggcagtaaaaaatgtaaaattcattgttgacgagagtgaaggtgattaatgtcgtgtgatgtaaatgttgataattcgaacaaaacatgtctatgaagtgcaaaactgaaggatcctcgagaactatgtggtttctcccacaaaaatagtaaaagtgaaccatgaagttgcatctttcatggcagataggctttatttagcttgtgatttactacatgatttagctcctattcattcttgtatatattagttaattcatctgtgcttgcaccataactctgctaagcttttgtttttgttttgttgtctgcatctttctgtactatctcaataaagcaaatgaaatctttagcatttcaaaaattccagcagaacataagttttatcctcttggattcatggacgtttttgcacaatgttggaggcatgccacgaggaccttcaaccgaacctgccgaaaccgcctaaccaatgaggaaccaagccaagaccatcaggttcgactaaggcgaagccatatgtcgaaagccatgtggcgaagcacgcaagcaaaaggccaaagacctaaatccaagctttgcaatcaagagaactacgcaggcgaaggttatatgggcgaatggcatgtgacgaagcacgaaggctccgcctggactaggatccatgcgaaggagaggaccagagggccctccagcccagggaagccccttccgtcataaccaggcagaccaagttggcccatctagagcccaaaagtgtaaaggacactgtgtgccctcactaatgtccctttcacaagggtatccatgtaaatttccctgtacaacctaaaccctaggaggtgtaagcctctggtctaggattataaatagcccccttggaccatgtaatgaggggatcctcaaaaatttttatcaagttaatatattgttttactattcaaaacatccaaccaatttccatgttcttcgacgtgacgcggttgtcattcgacaacacacaacatgatttgatgttaacatagccttgaaatctgtcgttaacaaacctactatcaattaataacaatacaaatctccttcacattcgcaaaagtatgcacaactactttgagatttgtgattggtcaaagaaacttctctcaaaatttctcattgtctgtggtcttgtgcatgtaagagttcatgtggagcttcatcctcgacaacttttctagacttcacgagactttgtgacatacaggccagacatcttagaatgtctgccagcaagatcttttgcgtcttatcaagaccatgcttgtagaagctttcctgatgcctcttattcatatcacactatcaagtcataacaaaactctggaattcttgcctcctctattatagtctcaactgtctttccttaagttatgtggtttagcttcgtagattgcttctaccaatactatctattgagttgtgaggaagagtaaagagtggcatttattctatctttttaaacagtgaagaactactcattgtcattgggcaaaagactgggtgatgtatatataaggataaaacatccattatttatttgcagtctgtgcattaattgtacgacacttagggaataaggatcagggtttaattttttggtttggccgattctatcggaggtcaaatttaaataaaatattaccaaattcaaaaaaaaaaaataaaaatttcagctaaaataatatcgtaccgggggttggggtccgaaatgaccaaaaatttcgttccggaattttgaaccctgctaaggacaaatggactgagcagaacaaacaagatttttcacaaggaacatccctttggaacattgttttcacgatatgcaaaaacagcaaaaaaaaaaagagaattaaatcacttgcgccaatgaatatgattgataccaggcaatgcagtagacctatttattactgcatactactattcattatttttcttggttcactgcaaatgtaaagcccgaacgaatgtttgggctttccaacactaagaactcatacacgcacgtgactttcactggcatggctatccattaccctctggcacatgaggttaacttaacaaactatatattccctccggttataaaatttttgacgtttcgaacatgatctcacatatcaagaagtaatttattagagtgtttatccatattttgtccatattaaagatgatcctgtgctaattgtaattacatctctatgtatatatctagtgcgttcgattccctattgttgagacattttttaattgcatgcattcagggtcaaccagtccaagattacatgctgaacaaaaatgtcaacaattagcattctctggttccaagcctgaaacgtcaataatattggtgcctgagggagtaaattacttagcagctggttccaagcctatataacatcaatagttttagtaccggaaggagtaattacttagtaattagcagcggtgttttcagtctgtatgtggtcagataggagccataatcagatagaatttttcaaggagttgattcttgcatagtggcaccactgccagacaaatttgcgaatgtgtaatacaaatttggtgttgtagtggttgaaaatagagtttttgcaatacacatactcaatgtagtaatatttgtctgggctctaaaagttttttagctctgccagtgcctgtatatgcggttttttgcacgtagaagtgcttgtggagctaagatagctctgctggattgtgccacctggaatgtttgccaataaccaatttttgccctttgtgatcaaaaaatatgtggtagtcatagttgctttctagaacttgactggtacgctagtacagccaccattttcctgatgcctccaattcataccacactctcgagacatagccaggctgtctggaattcttgtatcctctatagcaaaattcgagct

SEQ ID NO: 59590 - DNA, 14696 bp, Oryza sativa
  unsure (1)..(14696): unsure at all n locations
ttatttgtgtgtataagtaactttgatttgtgatgtagatttgagatgttacttcgatttgtggattgggggtttgatttgggatatgtatcgcacttgatttgggagacaataaaaaagaaaaaaaaagaaaaaggggatcatctcactgccgtaaccctctctttaatcccggttggtaacaccaaccgagactaaagatcccctctctttagtcccggttggtgttactaaccggaactaaagatctatttttagtaccgggtatttgaaccgggactaaagatagcgatctttagtcttggattggtagtctcggtttgaaaaccgggactacaggggttgcgaaccatgactaaaaagcatttctccaccagtgccagagttgtttccgtgggatcatggatagggaatttattgtcccgctggcaaaataaattctctagctatctcctgcaaatacacgatattactgactaaaatatagaacacaaacaaatacacgatattactgactaaaatatagaacacaaacaaatacacgatattactgactaaaatatagaacacaaatggaatcttaagaagctgggatgatagtatgagagtctcaagtacaaatgtggctgatacacttattagcggctatggattaatggcacgagaaggtagatgtgataactaggatccccctaaactatttcattttttcaatttgcaaggcaagtctccgctacaacacatagtctatctatcttctatctatctatctatctattatatattaaaaatccattaaacttcctacaaacattctcgaactgtgtcacgcccggaagtttccccttttgcttgctttaaaaaaattggttaaataaattgtccgaagaaattatcttaattaacctagagctaattccttaattaataaatgcaattaataattgaattcggcgtggtggaatttttcttgagttccccatgctccaatgcattaacaagatttttaatggaagtttcagagccttggaaataattttaaccaattaaaaatcaccaaagtgcaattttaatcccaggaaaaatcctttcttctttttctttttcctttttcctcctttttttcctcttcttgggccgtcggcccagtccacccgtcgcccgcgctcggcctccccttgtgggccggcccgttctccttccccctctctccgggacgctgacaggtggggcccacctgtcaggtcgtccccttcctccagccacccgcctccgacggcaaccgccgccgaatccgccacgccgccgcctcctccgctcttcccgcgcccacgccgcgccgctcccgcgtcccccccacgtcgccgcctcttcccccgcatctcccggcccgcgcgcgcgctcgagagggcgggattcgatttcgaatccacctctctcactctccctccactccccacatcgccggccaaataggggccatccccggccacgtccgcccctccctcgcccataaaaacccttccccgagtcccctctctcgtttcacccatttcccgtcccctcccgtgcctcctaccgagctcgcgccgcttgttgctagcgccgccgcttgccgtcgccttcggccgcgcgccactgccgctagggtcgccgccgcgccaacccgccaccgccgttagcttcgccgccgcgagagctacctcggccgccgctcggttgccgccaatcgtcgccgaaacgccgcttctctcgcacgccggtgagctctccatttccacccaactccggccggccgctctagtggccgtggtcatcctccccttcaactgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacctggaattgttttgggaaaatttggagttttgcctctttggtttgcgggaaaaatcttggtcgttcattcggatcggattttttttaaaaaaaattagctcagtctagggctttagaaaaattttagttggagtttattcgacagtcagttgggaatttattgggagttatgcattaggtcgtgtctatattcgatgggggcaatgttatgcgcatcattttccatgcaactagtctatgtattaatttattgtttagttgcattagtgtctttatttgggttcatgaaaaatgttctatgcataaaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcatgtttaggtttgttgcttgtgggctagtcggcggtcgatatcatgtgtcagtggtatgactgcctcaattaggagttgcgtgcctctttttcagtgttttaatcaagattaagataattgcacttaaattcataagcaagattagtttgagccccctgtttttcttccttttctcatatttctacctatccccttcagatggagataaggaatggttcacgcgactcgaacaacgcctgtggcagcgaagagccgatcgatggagcacgtgccaacagtgcatctggcaacagtccgtccccaccgcccgagaacccaacaattgctcaggtgttggacaatcagactcagatgatgacaatgatgatgcaacagatgcagcaacagtaccatcaggtgttgcaacaggtgcagcagcaagcacagcagcaacaacagaacctgcagttggtcctccacctcctcagtccaaactgttagaatttcttcgtgtcaagccgcccactttctcaagcaccaccaacccaatcgaggcccacgactggcttcatgccattgagaagaagctgaatcttttgcaatgcaacgagcaggagaaggttgcttttgctacacaccagctacaaggtcccgcttctatttggtgggacaactacatggtgacccgtccagctggggcagaggttacttggacagagtttcgtcatagtttcaataaagcacaggttcccgagggaattgtggcacaaaagaagagagagttccgttccctgcaacaaggaaccagaacagttatagagtatttgcatgagttcaaccgcctcgcgcgctacgcccctgaggacgtgcgtaccaatgccgagaggcaggagaagtttttgtctggtcttgatgatgaattgactaaccagttgatctctagagattatgaggactttgagaagctggtggataaggctatccgtcaggaggagcacggtaacaaaataaaccgtaagaggaaggcagctcagttcaggactccccaggggaagagtcagaagcctcgtttcacgatgggacgtcacggtggaccttccaccatgattatccgacagcaccgtccctaccacccgggtagcttcaacaagaaccaccataatggcagtcacaacaacagtgagcagcacagtctcaaccctactccgagttcactaaagattccagctcaatcagttcagccagctctgccagaacagcccaagaggttgggagaaaaacccgaactctgcttcaattgtaacaaacccggacacacggttggaaagtgcccgaagccaagacgtgctggacccaagttcgttcaggcccgtgttaatcatgcatctgcagaggaggcgcagtcagcaccagaggttatattgggcacattccccgtcaactcgacaccggcagtaatattgtttgattctggtgcaacccattcctttatttccaagcgttttgctggtgcacatgggttatctttagtgaagcttaagataccaatgcgagttaatactcctggaggtggcatgaccacaactcactactgcccatctgtgacagttgaaattcaagggttgatttttccagccaacctcattcttctcgaatccaaggacctagatgtcatacttggaatggattggttgacaaggcacagaggagtgattgattgcgccagccgcaccatcaagttaacccatgcaaaaggagaggtggtaaccttccagtctctagtgccgcggaagccagggatcagtttaaaccaggctgctggtgaagaacaagaggtagcagtggagaaaaccactaagaagctggaggatattcccatagtcagagagtatccagaagtttttccggacgatctgacaacaatgccaccaaaaagggatatcgagttccggattgacttggtacctggaactgcaccgatccacaagaggccttacagtatgggagccaacgagttggcggaagtcaagaagcaagtcgatgaacagttacagaagggatacatccgcccgagcacgtcgccttggggtgctccggttatctttgtggagaagaaagacaaaaccaagagaatgtgcgttgactaccgcgcactcaatgaggtcaccatcaagaacaagtatcctttgccaaggattgatgatctgtttgatcagttgaaaggagctactgtgttctctaagatagacctgcgatcaggctatcaccagttgaggatccgcgaagaggatattccaaagacagcattcatcactcggtacgggttgttcgaatgcacagttatgtctttcggactcactaatgcacctgccttcttcatgaatttgatgaataaggtgtttatggaatttctagacaagtttgtcgtggttttcatcgatgacatacttatctattccaagtccgaggaagaacatgagcagcatcttcagctggtacttgaaaagttaaaagagcaccaactatatgccaagttcagcaagtgcgacttctggcttaaggaagttcagtttcttggtcacatcgtgaatgctcaaggagtagctgtggatccagcaaatgtggagtcagttaccaaatggaccccaccaaggacagtcactcaggttcggagtttcttaggacttgcgggttattaccgccggttcattgagaacatctctaaaattgctaagccaatgacacagctattgaagaaggaagaaaagtttatctggtctgctgaatgcaataggagttttgaagaactcaaacgacggttggtgtctgcaccagtcttaatcctgcctgatcagacgaaagatttccaggtctattgtgatgcatctcgccaggggctaggatgtgtgttgatgcaggatggcaaagtggtttcttatgcttcacggcagttgcgtcctcatgaaggcaactacccgacgcacgatctggaattggccgcagtcgttcatgctttaaagatttggcagcactatctcatcagtaaccgttgtgaggtatatacagatcacaaaagtctaaagtacatcttcactcaagctgatttgaatctcagacagcgaagatggttggagctgatcaaggattatgatatgggaatacattatcatcccggcaaggctaatgtggttgcagatgctttgagcaggaagagctactgcaatgttgcatgggtagagcaactatgttgtgaggttcaacgcgatttggaacatctgaaccttggtatagttgagcacggattcgtggctgccctagaggcacagcccacactggtggagcaggttcgcatagctcaagcaagtgatcctgaaatagcagagctcaaaaagaacatgagagttggaaaagcccgaggttttgttgaggatgaacaaggaacaatctggatgggagaaagattgtgtgtacccgaaaacaaggaattaaaagacctgatactaaccgaggctcatcaaactcggtattccattcatcccggtagtactaagatgtaccaagacctcaaagagaagttttggtgggtcagcatgagaagggaaatagctgaattcgtagcactctgtgacgtctgtcaacgagtaaaggcagaacaccaaaggccagcaggtttgctacagccacttcagattccagaatggaagtgggaagaaatcggaatggatttcatcaccggtttgcccaggacgtcatcgaggcatgattctatttgggtagtcgttgaccgactcaccaaagtggctcacttcattccggtgcacactacctactcagggaagaaattagcagaactctatctggcaagaattatgtgtttacatggtgtacctaagaagatcgtgtctgatcgaggaagccaattcacttcaaagttctggcagaaattacaagaagaattgggaacccggttgaatttcagcactgcttaccatccacaaacagatggccagactgagcgagtcaatcaaatactagaggatatgttgagagcatgtgcgcttgactttggtggagcatgggacaaaagcttaccgtatgctgagttctcgtacaacaacagttaccaagctagtctgcagatggcaccatttgaagcactgtatggacgaaggtgtcgtactccgctcttctgggatcagacagggtgacggagctcgtggctcctcaccgggagaccgcgcaggcccccctttgccagtccggccgggggcttagggtgaaatctcaagctctcgctctccctctgtatgtggaaagatcacccgcctcgcaagaaacgtgagacaccggcgatgtatacaggttcgggccgctgccaagcgtaataccctactcctgtgtttttgtggatttgtgtatggacgagttacaaaggattaactccctttcccctcagccttccaaaagggaagaagtcaaaaaaagagcccccttctaaatgggcaaggtcctccttttatatctcaaggggataccacatgccctctctctttccaaactggactgttctttttctctttaatgggcggagatcggtacggtttccatccgggaacccttctgatgggacagcccacacctacctccactcccggcggagacaggcgcaacgtgagatcgtggctacccgttgctgacgcgaccagtgccagaccggtcattcttgtccaccacgcgtcagtttaacaacgtgcatgtttgcccttcttcgtgtaacaccttgcctgtaatggttaggatgaagcctggtataaatctgaccagggctaacgtgccatctctaagagataacacgctagctccggcttgagacgagagcctagaggctttcgtcttgacgggatggggcaaggcgtgcgtcagaccgccagtcgccacctaacccgtgatctgactggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccccctcgggggaaatcaggaggagggcggacacctcaccctcgggcccgacgtccccgaaggtgccaggccacgtgggcgattgcgtctgcctcaagcctctggtcacgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgttcataatgggcggtctattcaagactgccacaccacttgagcagcgcgcgaatctgggtgagcagatttgtctcgcccggagatatggtaacgccgcttcggtcggcgagcgtaattaacgcgcgcacgatacaatccatttcgattgccacaactgcatatccacttcatgcgccgcaagcgggcgaatgggattagtggaagcgtgggcacgggaaacgagggagcgagatagcgagatacgagggagcgaggtagtgggcgcgagaaacgaggagccaggcccagcgatggcaagggtataaaagcatcgagaaaaggatttgctcccttcctttcgccattgttcctcttgccttcgccgcctgagctctaactctttctctgctacgccctactttcgccacacgcgctcgttctcaatcatctcttcctccaccgccatggcacggggcgctgctctgctcgacggcagtgtactaccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttcttctttcttcatggatgtcctggagttctacgatctccagatggcgcacctcacccccaatgcggtgatgacattggccatcttcgcgcatctgtgcgagatgttcatcggggtgcgcccctctcttcagctgttccggtggttcttcaccgtgcagtcggtgtcaccgccgtcggtggttggcggctgctacttccagccgcgggggccggtgttgaaccgctacatcccctgcgtccttcgcaagaagtgggacgactggaagagcgactggttctacacccccctcgccaacgaagcgcgcctccgacttccaagccagcccccggcgcaggtctccagctggcgggcaccggtagatctgggggaggactacgacgccgtcctcgaccgcctggcgggcctgcgatcccaggggctcaccggggccatggtgtacggcnattaccntncgtcgncggattgcgcggctcaacggcgcgcccggagcgcctgggagtacactgggcctggagactacatgcggaccccccagggagccagatgggattgggcccccgaggacttcaagatcgtggtccaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccgaggggaacaatctgccccaggagggggtcgtgcttctgggccccgcgccgggggctcggggagcagccgccctgccgacgcccaggggaagaggaagctgggaggaacacctcccccatctcctccccgagggggcggggcggcgcgtgccagcagtcggcgcccggagggggccgcgccgacgtcgcagcccgagggggagcgcaagaagaaacggctccgcaagacgggggagacggaaccatgccgggggaacctgatttctcctccaaggtggtcattcaaccgaccccctcgcaggttcgtctcactctcattgcaaccacctttctcccaaagagaagttttttcttactcattttgttcgtcttttggttttttcttctgcttcagcgatgtcccgtcgcattcctcccgccaccccaaatccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgacagctgctgctggcgcgtcacttgggcctactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccgggggcccaaggcggctcttctcctcatcttctgtcgccccgctgagcgccgagccccttctgcaggccctggccgccgcaaacaccgcagtgctggatgggttcaacacccaagtggaggccctgcgtgcagaacgagcggagctcgaggccgcatgggcgcgtgttgaggaggggcggcgctcggtggacgccatggtggaggtgggccgtaaggctcaccgccgtcatgtctcggagcttgaagcccggaaagcggcgctggcggagatcgcccgtgaggtggaggaggagcgggcggccgccctcatctctaccaccgcgatgatcgaggcgcaagacactctccgccttcagcacgcaagctgggaggcggagctgaagaaaaagctcgacgccgcccaaggggtccttgactccgccgctgcccgagagcggcgggtaacggagactgaagcggcgtttcggcggcgcgaggaggcccttgaggcccgtgccatggcgctggaagaacacgccggcgccgtggagaggggcttgacggaccgcgaggccgccgctggtctccgagaggcgacgctggcggcgcatgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaggaggagcaggcgcgccgcaatctcgaatgcgtccgcgccgagagagccgcactggagcagcgggctgctgacctcgaggcgcgggaaaaggagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcaggcctctggagaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggaccccaatttctctccctggatggcgctggaggagttccctcccgggaccgaggacgacgcgcgcgcgcgtgtcgaggatgctgctgaccacatcgtcaacggcttcgagggctcggcccctcggctcgcgttcgcccccagctctgacgaggagggcgacgccagcggcgaggacgacggtggcgacgaggccggcgacccgggcgcatttgaatgagcccccaggcccccgccaatcttaacttttttcttattctttcttctaaggccttcatgcctcttttttgtacaatttaacttaatctgcaatgagaaatgatgaaaaaatttttgtgttagttttattttgctatatatgagatgaggatgatctgtgccgtggtctttttgcgtcttagcttgaaataagggcccgtgcccaagtcccagtcctcgaaaagcgcgggtcggggctagtgcctggggagatccacatgtcgagactggccaggccgggaacgtggtgaccgagggttatgggtgacccgattgtgggtttttgccgattcccccccggagttcaccacgccccggggcacggctcggttctgggccccgtttggcgattttagctgaccgaaccgagcccccgagggcaaggttgagtacgagtgaccttattttaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcctgagccaaaacctgacacccgacccccccccctcctcaggggtagaagcgacgaaggtgttcgatgttccatgggttaggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcggctcggagggccgcgcgccgccttcgcttttttaagtagtcgaggtcatctctgcgaagctgatcttgatcagcctcgcagtacatggtggcccgaggagacctcagggtgagctcggatgggagaaccgcttctgcgccgtagacgaggaagaaaggcgtttccccggtcgctcggcttggtgtggttcggtttgcccagagcaccgctggcaactcctcgatccatgaatcgccgtgcttcttgagaatattgaaggtcttggttttaaggcctttgaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgataaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgcgaggcggaatgggctccgcattcgccttcatggatatcggcaagaagctcaacgccttgttcctgaggaatgcatttcaggaggattccgttagccgcgcgccgatagagggtcccttctaccagcacgtagcgtttggaaatgcgttgtacacgttcactcccttcgcggtcctcgggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccttgagagttcatcggcaactatgttatcccttctgggtacatgccgaagttctatcccatcgaaatggcgctccatacgccgcacttggcgtacgtaggcgtccatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccccgcaccggcaccctggagggacagagaaccatcgaactgcatcacccagtaggtggtgtgaggcagctgcgaggggttcgtgctggcctcggggattgagacggtctctggagccggggtccactctgccacaaaatcggcgagggcctggctcttgatagcgtggcgtggttcaaagtgcaggtcgaattcagaaagctcgattgcccattttaccacccgtcgtgtaccctctcgattatgcaagatttgcccgagggggtaagacgtaaccacagtgacccgaatagcgtaaagcatcttctgggcctgagggtatcgggttttggcgtcccgaaggg

SEQ ID NO: 59591 - DNA, 666 bp, Oryza sativa
tcccatcagcaagctttgtgcgcataatgcctcacaatggccggcactcacacgggtaaggatggtgctcagagtcagagatacttggcaactcacactctcgagtaaccacggcagctgccacagcgagacacattagaatgtcagcactactagtcactatggatgtaatgaaaaccttcgaattatttttcttgttcggtccacttcttttctgatgcttcctactcccatcacatcacaatgcaagacaacttgaagaaactagattctcttatatatctacctctcccattgtcttgttgattgttgctcgcctgctaattgctcctagttgcaacgacgagagcccatatgtattgtagtgaagaaagatgtatatatatacccaaatctggagggatgtatgaaagagttggacaagctagttattgaagatgatacaaactgttatgtcctggatggttggtaggcaatttttttctgtcgtctgcctccagaagtattttaaaatttaaatagcaattactatcaccttttgtttggaattagtatttaaatttggacatgtcaagacatatgccataatttattttgccttttgtcccatataactatgagatgaagatttccgagaaaacaaataggggcaccggcctagtacta

SEQ ID NO: 59592 - DNA, 582 bp, Oryza sativa
cccatctaaacagggcattataaacgtttcgtgctatggtggatgggcagcaactctttgcttccacctggatcttctcttgttgcaggactaagcctagcactagcatacacgcaatcaaactgttcacaccttccatgtttcctagcttgttttccaatcagatttactcgaggatcaactaaaggaagagggctgtggttgtgcatacgattggagagtgagacacgcctatttataggtgaagcctatacagatgattatgttattttaattcacaatagttatattgatgatctgtactctgtattgtttgtttagagaccaagccacttacactagtacataatagacttttccgtgcggtcaaaatacattttttccgtgcagaggacctgcccgtctacacccaggtatctacgaaaatccatatttttgcgttcggacgggcggaccgcacgtgataattgattatcccgtgcggtcgtgttaagtagaccgtacgggataattagttatcccgtgcggtcctattatattgacctcacgagataatggataatcccagtcggctagcatgtg

SEQ ID NO: 59593 - DNA, 90562 bp, Oryza sativa
ctcctaaatagccctccggatctaaacagggcggtaggtcaacacattgtcattagattggtcggccggttgtctcatccacggtttatgctccaaaagtattttttatttgccggatgaacggattaaattagtaactaagttggatcaacgcatcggtcggtttaagtttcacgcactttttgaaattcaatacagctggatttatattcttgacgaagttttgcttccaccatctgttgaagtcgtactccaaattttgctatcaagagttgtatcttacaactcgttttaaccatttttcagttaaattaaatatctctattcagaacaattacagttgcagttaggtcaataccgttatcgatcaaatttaaatgcttctgcatttttttttacccagatgatgttgtgtaaattgtgcattttttttacaaaattaacacaacatcatattgatatcgctcttacatgtgttggttcccaatgagggtattcctacttgtgagaattttgaatattttagaatataatattttttgtaaaagtattcctaactttgtttaaaattcaatattctcccaaattaattaagttatgctgaaatttaattactgtactttgaaaattttcaaactacaacctcaaaacttcaagttagaactttcaaattttgaatttctattcctcgcataagaaaattttcgaattgctattttataatttcagaataacaacaaattatttgaaaacaatgcagtctgatagtttcatataattaaatatattcttaagttcatttggatgcatgccgtcggtccatagtgtgatatttttctcctgcgaccttaatgcaaaccacattccaactaccctactggtcaccattaaacttatgaatagttctcggacaacagggctataatgtatttcgcctagttgtgggcttgtggcatgattaatttacttgtcagaacgtttggctttgtagccaatcctgtaataaaccttttagagcaccttaggctctgtttagatggaactaaaaaactttttagttcctatcacatcggatgtttagacactaattataaatattaaatttaaactattgataaaacccattctataatcctggactaattcgcgagacgaatctattaagtctaactaattcatgattagcctatgtgatgctacagtaaacatgcgctaattatggattaattaggcttaaaaaatttgtcacgcgaattagctctcatttatataattagttttataagtagtctatatttaatactccaaattcatctgatatgacagggactaaagtttagtccccggatccaaacacccccttagtaaatgaacactaaaatgcagtaatagagtgtcattactcattgaattcctataaaatcaaaggaaggttacataattatagtttggataacacataaatttgtgtcaacgaaagagaaaattaaacatgaggtagaacctcatgtccaaaattcatatgaaatagcccatttcacaggaatttcaaagaaatttgagagagagattcctttgctccaaaggatcatatagtaaaaaagaaattcataggtatcaaatcatcaaaaattcatctagttttcctttgttgcaaagaatctcttagcatagaagtgtattataatagttgcgtacattaatgaagaacataaaaatattatggcgtgcatatgaaaagatttatcgcgaaaagatgttataaatttttagtacataagaagtaaaaattcatcactgagtttatcctggttcaatgatttgccattgacattgtcaatttccgtaatatactacgactttactaaattgttctacaatatgccattgtattgcatttctttcaaaaatacctaaaatacccttataagaaggtttgaaaaaaatatgcctttttatacattatctttatactacatggaagtttgtgtataagtttttgtgtgcttttgttttttaatgtaaactagctaaatgcatgtgctttgctacagataaaatttatttttcatgaaatgttccacctgtcgtgttgctatggaaaacatttaccttaatttgattctatgcatcgatatccttagattgattgttattaatataaagaagctcagggggtgatttctaaaatttacaataggagtagctataaggtgacaaattcactattcccccactagatcctcttaaagtagcatagatcatctttcatatggtaaaaaaaatatttttgtgttgttatcttttgtgtaagcaatttcactatcataagccaaaaaaatttaaataaaaaataccaagaaaacttgaaagttatatacaaacttccaggttgtgtaagaaggctacactaaaatacgtagtttttcaaacttctactgagataaatcgattgttgacgtggtacatttttaagggtattttgggtgtctttgaaaatagtcagtccaatggtatattggagaccaattgatgaagccgtcggtatattatagaaaacatcaatatctatggcaaattattgaactgagacaaactcagtgacatggagtagattatccctaaaaattattatatgtctacaattaaaataatgttcattatatgatttgccacgatgatgtcattgaactacactaggattaaaaaaaataatggaaaggacttggtagctataaatgatacacactgctatggaacacatcttttacgtgaccaggcactccacctgtgactaaaggctttgaaaaatcgacgatcttcccagataggtcacaaaagttgatttttatagttacagcaggctatggttaagcggactacgtgagaaaattattttttacaggcaactatatgaagccaaccgactggaaaaaatattttcaacaaaaaaaaaacaatgtatgcagctgccttatgaatgacagttgccaaacccatatccatagatcaagacacaaattagagagagaacaattcacatgattggaaaatgaaacaaatcaagttgttccataataatttgtattcacaaatccaacccagattcacaagcatacataaacatcagaagcaggccagatcgggttcgaacatatttattctccccacacggatgaaggcacttgtagcagcagcagcagccctccttgctcacctcctcacagcagctggtcatcgtcgcagctaccattgccaccagttagcacagccctcgcatcgggcctggagtggcgcaaggccagcattgtcaccgccaaccaagggcttccccgcggccgctagttacgttcctcctcttcgtcgtgtcaccactagctcaggcagtatgaggctactcctccccttcaccatcactgacacccctacccttctccttcgccgcagtcgccttcaccaagccctccgccgaggctcgccctcgagcttcaaaggtgacctcattgtcgctgccctcttctgaaatcagttatgcctagatgtggttcgttgacagaggataacttagatgtggatatataagagaattgtggtggtaaaatttcctagtgggttgagtgaagggtggtcgagccaaaccataactttggtaagaaaaggtcaccaaaagtgcaattcactcattagtcattttaaaaccgccctctatgtgtcatcatacatcctagattagcctaactgcaatcggctacgaacaagacaacttgcaattttttttagaagcgtcatgcaagaataaaaaaaattaaagggtccatctgaagaaagatgagcaacaaacatacaagttctttacaattattacatattcggtcattccaaaatataacatactttgatttctaacgataccgtataattacaatatcagattgttttgtgttacatggttagcaaatcaggattgtagttatgtcttttttttctttgtccgtatattttttttactggattaatcattgattaagattaagtcagaacagaatgagtttattaccgtataaaaaataaccatgctatatgttgtatatatgacttcaatatttgttatcatacagcttctaagttgggcattaaagagctattgccagcttacaaagatcaggaccttgaactaaatgacctacttactggtgtggcctttgcctcaggaggcagtggatatgatcccctcacttctatatcggtatagttttgttattagctcaaaactctcagaaaatacttcgaaacaaatttatatttcctcataatgcaccataaaaaaagacatttcgttaattgtgaaataccaattgatgtatacatgtgcatatgtaatattttgttatgatcatgcagactgccatatcgagttcaggacaactcaatttattcagtgactacaagcagaagcttacatctttgatcggagaggaggcaatgacacgtattctctcagaagcagttttctttactgtcatgggagcaaatgacttgctcaacaattattttacgcttcctgtgaggcggcatcaatatgacattcctggctacgtggactttgttgtctctaacgcagttaactttactctggtaaatagttattctatttttcatccatattatttttaagccattttgattacatggaaaattaccatttatttcagttgtaatgtaagcactgcaacgtttaaatatcccatatatttctgtgatcagcagaatgtgtaagaatatcttcatctccctctgcttttaataattcgtatagttgactattacttgaatccttcaaatggattaaaaaggcccaataattctttcctcgtatttacgaaaaatacatcacacaattctataatgtagcattatttgtatatgttgttattaatttattgctaaaaaagagtaggcaaagtttaaaaccggaaagtccaataacatctctttgagagtggaggtggtatttcgtattttctatccctagcaaataaacattgttgtgttattacttccatgagtgatataaactcattttcagttaaaaagaacgagtgatatacacgcgtttttattacttgttctcgagttggtgttattagaattacttgacatgttatatttcaaccatctcgttgtcactaggttttcatcttattaatagaaacaatttaatttagcaagttaacaaatggaaattctcaccattaggaaattactttagttcgtcgttttcaacatgttttacaaacttgcaagctagctagattgggctacttgtcaccagatcattgtatgcattgagttatttaaaaaaaataatgccatcattttataaaataatatcgttataggtacatattttagataataaatattggcatttttacattgtagattatttcatgggatgatccatttattttcattctttcacactaaacctatctcttgtacagacaatgaatgagatgggtgctaagatgattgggttcgttggtgttccaccacttggttgttgtccctcacagagaactggtccatcaagagaatgcgaaccattacgaaatcaagcatcagaattatttaatactagaatgaagcaggaaatcgatcgactaaatgtcgaacataatattgatggtttaagggttgtttattttgacatatactacaatttgctcgacctgatccacaatcctggttattatggtaagtttgtaaattctctttagttattcttttcattttagataaacaatgagatctaaaaaaacatactactacaactatattagacacgataacgataagcgcaacactttccaaaaatagaaataccgcgtcttctccctcacacgtaacttgtgcatccacctgttagcaccatgcagtttatatgctacatcgtctagcactattgcactagtatttttaaaaccttttatggcttatatctttataactgtatatttttttaatcttattgagccatcgtactctatttaaaatatatgtgacgaacgagtacaatattaaatatattcagattatttaaaatttatttttgattttaactcttttagcagtgtttttacttcgaataccacgatgagttacttgcctctagcaacatagttacctttagtagcatgaagggttagtttcttctagcagtgtagtcacttttaataccatgaagagttacattaatttttagttaagttacttccctccagcagtgcagttccttctgacacagtgcaaaaagttacttcgaatatcaatagttacttctaatactgtgaatagttacatctattttctaaagaatcacttcctagatgaaataaattgcttttatcgaaaaacaaaaatctccctctctctctatatatatggcttacctcgaataaaaaatattatgtatttacttgtgaatctacacattacatacgaagatctttctgttaacacatatatgtaattacttataatgctataaaaagttacttccattttagaattcagttacttctagcatttaagtaaattacttctaaatattttaaaatatttaatattatactcatttcgtcatatattttgagtggagttcaacggatctgaaatatataagttaggtatataagttaggtaatatatggtttgaaatatataagttaggtatatttccactgaactctcgcaccaaaagtatgcattcatacaccacgcgtacatgatagcattaatcggacaacttcggcaggcgtcgcaccataagactaatctatgcacgcacacaaattagattttgcatactatatttataataatatacacatatactagatgtgtaattaacctactatataaccgccgattaaaaaaaatctaatcatgaccgaccaaatgtattgatcaaaacgagtgtatacttggcacatatgtatgattaagagcatgtatacaaaagacttttactccatttatatactatcaccgtacaaccctgacctcttaatatataggcatgtctacgaaaataaacatattttcacgtatagatctgcaaaatagattttcacatacgactctttactctttactggacatcgtccaaatccttttacatacaagttttcttttagcccacctgaaaaaaaaggggctatctaaaaaagtgttttttaagtagtgaacactaacttcgaagatatgttcaactcaacttgcataaattggcaaagactcgcagcttgcacaagcaagcatgattaaatttaaaccactagagacagttttttgtgtatacgtagcttgcatgtgatagagcaactagactttggtaatgggttttctgtgagtcaaatatatttaattacactgaacatcatgatgattttttatgcaggtttcaaggatacatctgatggatgctgcggcaacacagtgctaaatgctgctatattcattaaatatcacagtgcatgtccaaatgtttatgattatattttctgggatagcttccatcctaccgaaaaggcatacgacatagtggttgataagcttatccaggaaaataagcagtatctgatgtaaatgaaatatattatcttatatattacatgtgcttaaacggaatatacaacgactataaatgtattctataagtgatttcaaattaatcataactcttatttaggaaaaaataacatatatgctggtgagctagcgtgtgaaattctagaaaatcaatatatattgaaaataacttagctgatattaataatgtgtaaagtatattgagccttctctgtaagaaatgttgtagggtagcccctatactcgagtatttataagatttggagtaaatgtaagaatatatatatttatacacccaagaattttccatttagagatttaactattccatgaaaattattttcaataacagagggtggacctacttgttattttgatagaggaaaggaactatgataagagggaatatatagtgcaaacctaaaaatatcatagggtcttaaccataaatgtcgtccacataaacatgattaaaacttttacctcgagtaaacctctattcgtagttaaatctaggagtaaaatttgaacattcattttctttaatttatggtagttttagtttttattgtgcactagcaaaaatgcttgtgtgttgtaataggtgaatgcaattgtcacgattgataaactcttgcagtttaaatgataaactgaaacacaacaaacaaaataatagcaaaaacaagtcaatccagttgcgcccacttcatgcgccatcacagaagaattcttatgtacaactttccatatcatcaagcatcagtattttgctatatattgttaaaaagatactctcatcgaccaaagatagaaatgttgattattcaattagtgaaagttttttttcactctagatggaatgaacttaaacattgataatttcaaaactaatatatttataaggagataaattaggaagaaaaaaaggtggaaacaagagaaaaaggggagaaatgaggagaacggaaggggagggagaggatcatgatgattaggaggaaggaaacggaggtaaaaatatttagtggtaagagttggtgaatatttatatacaggtgaattatggacgaaaagcgatgaaataacctccggccaattagacgtgagtacacggattggaagacccacaaattagtgcaaaattgacacaactaaagtctattcaccgtacactgccataggggtctacctgccagtctcatagcgaagtacggtggccagatgtggtggatatggttcgaccgaaccaccaactgcactcctaaccatcagcttccatgtggcaactccccatctgtccccaatgacggttaagggtgttaactgccttaaccactaacctacaactgtcgttagcctctataaaatgaggagaagctctcactctcaataaacaaaacaagtggagtacaactcactaacacatttaggctactctctagcagagttagaatataagaagagtgtcaagggaagctccaaaaggagtgccccaaatatcggatttcacttcaggatgttctggagatatttgcctatctttgggagagtcctagaggagcgccgtagttgtcgtattcatgatcttgtacctcgatggatacttcttttacataagtatttgtaatctcctttggtatttacttgtagattgtagtgatcgacaataatacttatggggtgcacaataataacatgtggattatactggttaaggcccttaaggagaggtaataccctagtccaattgtaagatctttacccttccaaagaaaatgcctacgagccctatctatattatcaatgacaacataagaaaataacaaagagcacttgtattatcaatgacaacataagaaaataacaaagagcacttgtagtaagtatgcatagtataagagtcaatttatccccatgggaaagtgaagtgaaagtggcaaccatattctcctttcaatttggtctgtgagaggagagaaatcaatcacttttggctttgaagcactgagagggatgcctaagtatgtgaatggaagagagatcagagaacaaccataagttgaggccaacaaaagagaacaaccataagttgaggccaacaaaagagcattatgttcatctagattgagtggaatcataccagactttgcaaaattcacctttaacgttgtggatgaagaaactgtctgaacaagagctttgagagctattaggtgaggggctgaggcttgcataaacagtgaagtgtcatcaacatactgctttatgggaaaatagtttttggttttctcattttaattaatcctgcaattggtagttgttgatttaagattatttagggtgctcttgaaactcaattaaaaattgagggaccaatttagagcatgcagaacttaattaaaatacttcaatctcaattagattttttcttggacgtattttagtatttgaatttcttttagacttttactattttttattataacttttagaaagtgatttttaacttgggatggatttatcaggccgtgacatgcttatatgtagggttgaaagtgattcagataattttcgtccaaccggaccttttttcggattcggatagtttcggtcggatatatccggaaattttcgaattcggatatttttttgggatatgaaaacgaatatgactagtagagtgcccgtgcgttgcaacgggtaaaaaataaaataacaataaccattagttcatctttcaattttcatgatttaaagaagcatttattcacttagagccaaaaaaagatgggatttcaccaccagaaggaaatattttttttctttggctttaaagagtgaagataaaaccactaaaatttctattaaactgagaaaaacgctacccatagtgttatggaccatgcaagcttctatgcagacgagaatgttaacacaagcttctatgtaaactgagaaaaatgttgccgcataatttgcatataaatagttctgatcaatgtcaaatttccatcaagaaatctctgctacaatttcacttctaatgaacctgctaatctctctccatgtctccagctcgtgccataagctcccactcccatacccccacataatccatcaactccttttcctggcaagtggctagtacaccaaggccacacgctagagtgatctaaagcctgccaaaatgaaatgagatgagaagccacatgaagaactttggaagcacgatagccaaaataaccaaaatttgtcaccttaaagcaattattggaacatttaaataaaaatgaatgtattgtgcaggcctatgttttgacaaacacatgaatttgaaaattttgcagtttgatagtttggagctaaaacttgggcttgtgcaggcctgcgttttgagataaattaagctagtaatgtgtgatgtcatgcataaatcattctgaactttaatagtctgaaacttgcacatgtattgattatgaaatctgaacatgggcatgcatttttttgtcaacctatctgcacagatagctcccatccactttgaaggaagatctgacaatgacatactacagtgcacagatgaacacagcactgcatattttggtccaaatataagaatgcttattacacaaacaccataagatggcacaatccagttcatgaaaggaaaacactgaattttcttcctttgaaaaacaaaaggtgcaattaaagaataaaaagcaacaaattttacctggaagcgcaaatgtgtcgaagcactcagcacccttcccctgccctcgcccttgatatgttggcaggttcttcactgcactgaattgaactttgcattcacctgtcaacttagcacttacagacagaaatatcccgaataggataatatgtcatttatgaattgtgccgctgcaataatccagctattgaaaggagaaagtgtaaaatatggttatcaaatcaagaagactgtcaagttaaatgagaagcgggaaaaattcatactcattagtcaactgaatagcgatttgagtaggaagcatatcatcctcctaggggaagaaacgtgcaaacatcagaaaaaccgtttcgcatcaaagtaaaaaactcatagatacactaccaggacaggcttaacagcatatgaagctaacaattaacagatacaaaatcctggaggtgtaatacactttctcattaggcatatattcaaacttcaactattctcaatgctcacaaatattgccttaaattacaaaattaggtgagaggaataaaaaaaccaaaccaaaatccatttagataggtcatgcctaactaaatgcaaaatccattgtttattagccaaaaagtaggtgatttttttagaagaataagcctctcagattaatccctctgtcaattgagacataaggctttcatttactacttaaaaaaaatcgtagtggcggtagtgactccaatcctgacagacacacgtaatatggatagtttgatcgccaaatccaatggttcggataacaggcaaacatgtgctttctctttgcatctacgcccatcacaatgcaaagcaactccccctctcgcttcctggtttttctccgcatctgctgccaccaccatcaccgcaagtctgcaacctagccatggcattgacagcctcccacaacgccttgccgccccttcctgccctcccccattgctccaagacaccacatccccgcccaagccgcttggccgaagcccgtgctgcgccgccactgccctccccctgttctccacgtcacctctccgcccaactcaaatcctccatgccatccccgcaacacaccgcttcgctgtggatgtttgagaaagcacatcttaaattaacagcatcccagaaattattagtagcagagtgtaaaattcactgtcgttcccctctatcaatgtcacaccctgaaaattgttaaattataaattgttgtgaaaaaggaatttttagaatttatttaataattaaagcaagtgtgtgaataaaatctatgaaaaaattgaacataaacttgatctagataaaattttattgaatactttgtatgcccaagtattctctggatttttttcagaattatttgagtattggaattatttttaataaatgaaagatcatttcagcaattatttaaattaaaaagttaattaaattctcttcctcagtctgggctgaatcctgcccactcctctctctcccttctcccttccgcagcccgtgcctctcccttggccgaagtctgcattagctccctcctccttctttctctctgacccctggggcccactaggctacagtgccatcttcctcctccagcatctctcccgtcccgtgaccgtgaagccgacgccgcatcctccgctcgatccggtgcatcccgtgctccgtttccaaaattggttgcaaaaacggattcccctcaatctcctctatcttatccctaagaaacccctttaaataccgttgtatattgcgtgaattcgacgcggtttcgagctccgtttttccggcgaatcctaactaatccgtcgccgattccatccgttcccgagccgacctctccctcttccggctataaatagcagcccctcgacctcctcttccgtttcctcctttttcccgaatttttccctaaccccttcttctccaccagtgttcgccgtaaagccgccgtcacagtcgtcccgatctcgccgccgctcgaagctcgtcgccggctgccgttcgtcgcccatcatcatgcaactgtgggtaaggactgtcttgttctcctcttcgctttagtgctctcgctttccaccgttgtgtcatcatttgtcgtcgccggccatctcccgttgccgtttttcgtcgccgtcaccattggtgagttcgtcgtcgcgtcttctctctcccggagctgtccccttatcgtcggagcgtcgccgttcagtcctcgttgctatccagagccatccgccggtgatgatgttatcgctgacatccacatcatctcaagccattgcaaaatcaatataaattttgttatctcttttcaatgacatattattcctttttaatatatgttacctacgatctaatctattttcggaggatgttttaatcttttgtctcagctataaatcatctgtaaattgtttaatcaatttggattagtcttttctttaataggtttaattggaattaaatcttgtaaaattcatatctaactcatacgaactcggaatgaggtcgttcaagtcccataattcatctaaattcaagctctacctatttatgaactttaattgtactgttcatttggtttttattagtgttataggtttagttttccgttgtttcggaggatcgttcgttcgttggagaagttcctgaagacgaattgaagacgctttttcgcaaggcaagcatgttgaatccgtttaaagctaatgttttatttcaagttatgcattattttagaatgtcatcgggtggtgaacctttctcatttaattatggccgaagatggctttattttcctatgggttataatttgactagcatcgaccttatatatcggattggttcagctagatgttatttatagttgcttagccgtgcttagaaacattagctcattaatgggataaattatgcttcactattacttatggttatatttaatggtagctcacgatggttaatcgtgttatgataattaattgataattaaaatatgatatatggtgggttgtgagcacatggttttgaaggtcgtgctcatgacaattaaggaccggttcgcgagctactgttgtaaaatattaaccgtgccaacaacatgccagcgtgggcaacagctttaccttttgtatagcctggttcattacggggtgccagactgagaagcggcgagaggtccgtgggggtcgctggggaatccatgcctctggtttttgagggggtgattatgatccaggaatggtgcactgtggtgagttgtgttgggcaaagggtattgtcacgatttccccatttgcagtgccgtggtggtacttcggggcatggcaacatgtgtggaatcgtgtcttgtgggtacagtggtacatctctggccagagtaaaactattcgaatagccgtgcccgcggttatgggcgggtctaacaatgtttttcgtgattagtcccacactactcattaatgataacaatgtgataattaatttgactcctggtttagaatggataattcctggtttggaggtttgatctgtacgaccggggttggttgttcaggtttggttgggcctgagcagcatgggtgtgctgttcagtgttgattaatattgatgattaattactctactgttttacaaatttttaaatctttgctaaatactgctttcgcaaatgaaccctatattatgccatcctttggtatccttgtgcacttgcatacttgctgtgtggcttgcggagtattccatgtactcaccttgcaataatcatcaaacctcagttgaagaaaaaggatccagaaggagaagacctttggtttagatcccagttgagctgcctgtgggagtggagctgaagcttcgctaggttttatttttccgctgcagttttcttcatggtaaggactaagtgcctcttatgtaagtatttatttgctttagttattttgatgaatctgtatattaaattgtcagtttgtgtacctcggttaagtcctggacgagggtcttaatgcacaaattagttcggaaattacttatgaatttctgggcgtgacaatcaactatccttctctcccatagtacccaaccttagaatcgtttccatgaccctgaaggctgaagcaatagaataaacacggagctactttgcattatcatttcggtttaactttgtaacatggtaaatcataaaggttacctatgggatgacaaatcccacatcatttccctggtggtctgcattacgattctgaattctaatacctcaaatttcctctacatagaaatgacaacaatatattagtcgagttctgcataatcagccgcactggtttaggcctcagatcaagattgttttcagttgcatggattgatccgaacagcaagtactgcaccaagagagggaacacttacgctagttgaggtcatcgaatttctgtgaaaggtcgtcgtacctctcaccttggcttaatggtgtaggaggatacgtggggcaaccagtattgcatgaataatgtctcgcggcgctaggtaggaatgagctcgcactccagaacggcctcgtggacctgccggacggtggccttgaggagaagatgggcaacggctaggagcggggtctcagggggtggatgcacgtcggtgagtgctgcggcgccgatggaatggaggtggcgtgagcaggtgcgtgggaaagcgcgaaggcagcggagaggagatggaggagaggacgatgggccaccggggagagctgtggcgccactcctccctccccttccaatctcagccaccgtcactcgagctcccgccaccttgtgaggccagatcgatggtgaagagagggttgttggcggcgttcctatcgatttgaggtcggcggcgcttgcatcgggagggacttgagatggcagtgcgacagtgatatgtgattgatgaaacttgaggcaactgcgaggcgaaggtggctatgagaggggagggagacggagcggtggccggcggcaaagactgaaggcctgcgaggtggcggtggctatgcagatcggcgagggcggaagaggcgatgcgcaacggaggtgaaggggaaagagcgcaaagaaggtgggggaggggtcgaggtgcgagtggcggagggggaggcgatccgtaaccgaggggatacgcgacgtaatctggaccgtttgatcctgtgatccaacaaccctgtgggttggggtgggggagcgggcggaggaggaggagagcgaagggatcgatctggccgttggatctggtgattgtacggatagaatggtgcgtgtccgtcagggttggagtcactgtcaccactacggaattttaaagtagtagagatataggtgatatccatcggaaatcagatatccgtcagatattatcgggtattttccatcggatatccgacttacacataaggcccataatacagcccaacccaaagaagaggcaaatcaaacttcttggcaaaaatgaatttcgatttgaattttatgatactaaatgaactcatatgaaaaagttgtcaaaaacaaagttgtagaactcatttctccatccgagtttgattgaactatataaaatttgaattttaaaatataagaaattcaaataatatttttgggtagtaactgatttcaaatggaaaaattgtcaaaaacaaagttgtattcttatcaagatctataacttttattttgatcatttttctatatgactttgtttgaacagtttgaatttaaatttaaaagtatgacaacttcaaacaatattttcaaatactaaatcatttcaactgaaaaagtcatcaacttcaagttgtataactcaacaagatctataacttttattttgatcatttcttcatccggtaaagtgatagtaatattgttcataaaatttgcatatctctcatttgcatatctctcatttggttttataaaatataagagagagatgtaaattttatgaacaatgttactatcactttgtcggattaagaaatgatcaaaataaaagttgtatgtcttgatgagttgtacaacttttatgttcatgacttttcagctgaaattatttactgcttcaaaatattatttgaagttttaaaattcaaatttttaattgataaaacaaagtcataagaaaaaatggccaaaataatagcagtaaaaacataataacatgatagagcataatttagaaacacaatagcaaaaatcgtttgttagtagtgaggggtttttatattctgattaatataatattcgtcaccgtattcgtttcgcttcgtattcgctccgtatttgtattcgataatattcgattccgttttcatatccagatttctgattccgatttcgatttcgaaaaaattatgaaaacgaatatgacagagcagtttccgatcgtattcgatccgcttttatccctatttatatgtagtggggtggactgctcacttgtacttccattgccatctattaattactcaactttttgttatgtgtggcagggagatggaaagctgaacgtatgggcgatagtcagatagggatcggaaagattcgaccaggatttagtttgattgtgaaaaaatcgggtccatctgctcaaaatctgacggttaatacatatatagtgatgatgtggggtgagctgtggaacaagctatgcctatgggtaccaaatattgaaagaaaggatatcgagagttttctcaccgtttcttgtatgcgacacgcgagggatgcaaacaaagcaaccgcatcctactatttgcgacacgcgtgcgtgacacagctgcatgcacgtcgcagcacgtccaagtaactaagcgtgttggctatacctatactccctccgtcccaaaatatagctatttttagcaagtgtcttgttccaaaatgaactatttcttcacctacctcctcctctcaaccaatcacaaccattcttcttcacctactttctcttttcaaccaatcacacacttcctccaatcattctcacctactttcttaatacccgtgccaacctcaaaaatggcttcattttgggacggaggaagtactatatatagtccctccatttcaaaatatttgacaccgttgactttttagtacgtgtttgaccattcgtcttattcaaaaaatttaagtaattatttattcttttcatatcatttgattcattgttaaatatattttcatgtacacatatagttttacatatttcataaattttttttaataagatgaataattaaatatatgctaaaaaatcaacggtgtcaaacattttaaaacgaagggagtactatatatatcatatatatctagtgcgcatcgatccctagtggagtggtagcacatgccccagagaggcgcacacaccagtgcagcaatgagaggctaaccgatcagatcatcaagctcaagcaagctaaaatcaatgatcgatgacgtgcctaagcaacagtcgccatggatgctgcctttttgttcgaccgatgctggtgctggtgatggtgctggagctgacgatattgattccgccggctagctgtcttgcaagtccggttcggaacatctcggccatcttcatcttcggcgactcgaccgtcgatccaggcaacaacaacaaccgcctgacgccgtccaaggccaacttcccgccgtacggccaggacttccccggcggcgtggccacaggcaggttttccaacgggaaggccatgagggacatgataggtatgtgaaagtacttaattcggtggcacaaacaatctgtgagattaatatatacctctgtgcgtgtttttgttgtgtttgttttttctgttgtagtattgtcacctatatataaattaagtcttaatgaaaaagatacgcagcggctcatcgctcgagcgtattaataaatgattaagcatcctagctgactttagttcttctctagggcttgttcccttattcccttccgaaagggaattggagataatttagggcgaatatttccctcatgctcatatggtgactcgttgatcgatcaaatatggaattgtcctatgttagcatagaaaattatggtgaaattagggcgctttttttgcatataggttgtgggtgatcagctgcacgcaaaaccagaaatacgattaacatatgattagtttaatattaattattaaaaatttagaaaatagattttttgatttttttttcacgattaataacttattttttatgaaacacaccgtttagaaaatagaaaacgaggagtatctaattaagttcagttagctcttaagaacgttaccctagttggatacgctagttaattctcatccaaaatctcaagcccatgatatctatatggatttatatagcattttcttaggggaaaaaaacgtgagagagaattcattaaatcctattatcattaaatggactctgtagtttttattttattttaattcaagacatcaaaccgagtgtaactgaacttataacttctaaatttcacaattattgaattaagtaattgaaatgcactactataaaaagacacatagagacgacatcatagataccggaacagctaaaaccgacacttaaaatacttttcccacccacacaaaaaaccacaggggcacgcaccagccgcaaaaaccggcacctatcttccttgtcagagaaatgtacgctcacttcccattgtcaataaattccatgaataaacacacaagtatgtatacacaaaaaaatttaagaacaacgatcagatgcctactctattggtggagaaaacacctaggtagattgagcaggtcgggcggccacccagtgctacagagcactttttttcaagcaaatttgccaccgttttttcaattttgcaaggatgccactcgaatgataattccagtggtatttttgcattttttagtggcagttttacaataacgattcaaagcaatggtaaatttgtaattgacccttttttcaaacggccgaagtcagtctgcagccactagccagacgactgctcaatcgcctggagcatggtgtatgtggaaatctatattttgcccttacgggtataacaaccccatgtgaagaagtattttgcacgcgggcacgtaaagccgccatcctatgaaatgtttttggcgaaaaaaattaaaattcaaaaacacaaaatttccaaaaaccctagctcgatttgatcccatcaccaccggtagtcggtgaatctgccgtctttgctgtagttctccatctttgtagccaccgtcatcggatcctacgttcccatcaccggggccaccagatccgtccacgggggagacagagaagcaatggagggaagagggccccgccacatcaggttaagcccctcgcatcgccgccgccaccggatccgtgcaagagaactaggagaagtcatgttgtggagaggttgccactacctctgggtccgcccctcctgatggaagatggcggagaagcgatggacgggagaggctatcaccggacacgccctagctagggctgtagccgttggatctgtcgtctctaggctagccactgatggatccgctgtgcctcgcccctcatgtcatagccattggagagggagtgtcatggccgacctctgccgttgccactaaccaccactcaagccaccattgccgcccacctctgcgccggccgccatctccgccaccttccatcgctgaccaccgcatcggagagaacgggagggagtgagtgagaactagaggctaagaggaaaggagcatcgcagcaaagctccgacccagccgccgtcacctcagagttatgtagctaaccactacaccagacagaacgagagggagtgagtgagaacgagagataagataagatagcatgagatagtgaggagaagctcttaagaaaggccaatatgaaggaaggtggcggagatggtggcatgtctagaaaaatcaatttttatagctggacttttatggaacacaccggctaaaactttttttgtatgggtcatattttacgattttcgcatacgggcgtttaccgacaccgctaaactttttaaatatgggtcttattttaggctgtttgtaaaaataaaggagtgatgtatgtacaaaccataattatgcatacgtgctgtgataactcaaactcctccatccacacaataacataatttgacccatcatgccttgtccttgccatctgccaccatgctctatataaaattactgtaccaattttgtttctggtatctccatttacttgggcataatggtaaggtttacatgatgttttaatttttcttaaagtcaaatttctctaggtttgactaagtttataaaaaaaatattatcaaaatatatccaatgttagattcaatggtattaaattggtgttatagatattactgttttttctataaacttattagtcaatttgacttaaaaaaaagtcaaaaatgacttatagtatgagacagagggaatagttgagaccaatctttgttatgtttttatcaaacatgtatactgtacttgcaaacactaatctaatgtaagaagatttggaactctcagagagagtagtttgcaacccgaacaagaatttgtatttgtgtatcaagaattctattaggatttcaaaaacagttcactttgggatatgtaaatttgtgtatcttgtccattttaccatgaaaaatcaagttttgatgagttttttttatctgaacttatttactgatattattaattgattgaataacatggtaactccgtatgaatatctggtttattataattaagattatttcgaacagcttcaaaattgggtgttaaggagctaattcctccttatctcggcgatggtcttcaacttgatgatctactcagtggggtagcatttgcttctgggggcagtggatatgaccctctcacttctaaaataacggtacaattttacttcttagaacttatgtctcaatacaaactgctctctaattattatccagtttcaatttgcactgtaaagtaagattacagtgtaagacacacacacacacacgcatatacagctaatattacttcagacgtattttctgattttcagaccgcgatatcaagtagtcagcagcttcaattattcgaggaatataaggagaaactaaaatcattggttggagaagaggatatgacacaagttgtcgcagaagccgtctactttacctcaatggggggaaatgaccttgcaaacaattacttcttaattccttttaaacagcatcagtatgaccttggttcttatgtggacttccttgtatctttagcagtcaacttcacattggtaagaagtatggtcccatgaaatgcatgattttttaagacaatttacatatattgaatatttgaacgtttccaagataaatcacgctttgtgtacatctgattggaatttcttggttgtagttgctgatttagatttacagtgaatactccattagtcctaaaatttaagaagttgtggagttaggcgtaggaaagtaggtgggtaggtcactgtattccaagacagtgaatgctaaaaaatgatatattttgggatggattgagtagtccttttccattctaaattgttttatgcatctgagtttgaatatgtaatgtaacattatacttgtttgcatattatacagcaactgaatcaaatgggtgctaagaggattggattttttggaattcctccagttggttgtagcccttcacaaataatcctcggaggacatccttcagaaaaatgtgatccagaacgaaaccatgcgtcagagctatttaattctaaaatgaaaatggagatagctcgactaaatgcagaactgaacatttatgggctcaaattggcttatatggatttctaccgctatctgctagaacttgcccaaaaaccagctctttatggtacgttaaattacatattaaaataagagagagattaactgtttcgcacaaaaacaaataattacatacataattattatggagtgttaaaatattacatgttgagcaaccggaaaagtatgtggtgaatggatatgatataaatttccgaatgataattgatgatctgcatgagcgtgtcgcattcaactactaattattaattctgggaggtggtctgtacgaacatttttatactgacgccgatctgaaattttccattatacaggtttcaaggttgcagctgtgggatgctgtggtagtaccttgctcgatgctagcatatttattgcatatcacactgcatgcccaaatgtccttgattatatttactgggatggcttccatcccactgaaaaggcctatagcattgtggttgataatatgatgagggtaattaaagagcatttgatgtgaaggggataatactatcatatattgttagtgatatgtcctagaggcaatcatagagatgattgtatcacatactatgttttcatatttatccgacattcactggtggagaaaccatctttcgtcggtcggccgaattccacaatagtcccggatgcaataaaaaccggggctaaagatgatctttagtccccggttaaaaagagttacgggcatatttgatctttagtcccggttggtgatctttagtcccggttcaaatgctgtcagggcttgtcagcccccccggatctttagtcctggctagtaacaccaaccgggactaaagatcgtaactttagtctcggttggtgttactaaccggggctaaagtccggttagtaacaccaaccgggactaaagtcccacctctctatatatatgtcttcttcctcctccagctgcccgagcaagcttcaaaatttcttcaaaaaagaggggaggtcatgccaaaatttctagtgaatttattttggtgattacatacaaatcggaggtgcctaaaaggtttgcaaattcatcctccaatgtttttttttgtcatattacatttggagctatgttttgcacacttttttgtctccaaaatttagttgtaagttgatgagagagaaaatttgtgtggggaagaaagaatatatagaaatttagtttatttgctaaagaaggttttataaaatagttgagaaggaaaatatagtgaaagttaatcttaaataatagaaacaaactaaaatgaaaattaaaagaagtaaaacacattaaaattagtttaaaactttagaaatagtaaataagtaaaacacgttgcggatgatcttggttagatgttgcaggacaccaagaaggactgcgaaagtgaaaaggagccccataaattgaacaagatgttagaggaccacagaacattgttgtacccaggttgcgagcaggggcataaaaagttggataccactctggagttcttgcaatggaaggcaaaaaatggggttagtgacaaggcatttggcgatttattgaaactcgtcaagaacattcttctggagggaaacaaattgcccgagacaacgtacgaggctaagaagatagtctgccctctaggattggaagttcagaagattcacgcatgtccgaatgattgtatcctatatcacggtgaggagtacgagaacctagaagcatgccctgtttgcaatgcactacgatacaagattagacgagacgatccaggagaagttgacgggcagctaacaagcaagagaattcctgctaaggtgatgtggtatttccctataataccatggctaaggcgtttgttcaagaacaaggggaatgctacaatgatgcgatggcacgctgaagagcgtcaacaggacgggatgccgagacaccccgccgatggttcgcagtgacgaaacatcgacagaaaatttaaagactttggaaaggacgcacgaaacatacagtttggtttgagtacggatggcatgaatccttttggagagatgagtagcggccatagcacttggcccgttacgatgtgtatcttcaacctcccccctggctatgcatgaagaggaagtacataatgatgccgattattattcaaggccccaagcaacctggtaatgacatcgatgtgtacctaagaccactggtcgaagatcttaaactgttgtggaagaaggaaggtgtccccgtgtgggacgaggacaaacaggaggagtttaacctacgagcgctgttgttcataaccatcaacgattggcctgcacttagcaacctatccggacagtccaacaaggggtacaaggcttgcactcactgtatggatgaaagagaaagtacgtatcttaagcactgtaggaaggttgtatacatgggtcatcgtcgattccttgcagcaaaccacccggtatggaagaaaggcaagcacttcgaacataaggctgacaatcgtaggaagcctaaacatcgcagcgggaaaacagtgtttgctatggttaaagatcttaaagtagtgttcggaaaggggcctggaagccagcctatagagagcaaagatggtcacgcggcgatgtggaaaaagaactctatattttgggagttaccctattgggaattcttggacgtccgccacgcaatcgacgtgatgcacctcactaagaacctttgcgtaaacctccttggcttcctaggtgtatacggaaagtcaaaagatacattggaagcacgtaatgatctaaagcatatggaacaacgcggcgaccttcacccggaaccaaaggagaaatgaagccattacttgagtccagccagctacactcttagcaaggcagagaaggaaagtatgtttgaatgcttggagagcataaaggtaccgtctggatactccacgaatatcaagcgaattataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcggaaggtcatcgatccggatagattagaagcccttcagaatgatgtacttcaatgtctcgttagttttgagttgatatttccaccttcatttttcaatataatgacgcatctgctttgtcaccttgtgaaagagatcagtattctcgggcctgtgtacctacacaacatgtttcctttcgagaggtacatgggcgttctgaagaagtatgttcgtaaccgtgctcgtccagaagcaagcatcgccaagggttatggaacagaggagatcatcgaattttgcatagaatttattgaagaccttcgcccaatcgggatacctgaatcacgccatgaagggagactacggggaaagggaactctcggaaggaaagcaataatgacggtagacaacaatttattccgtaaagcccatttcacggttctgcaacaatcttcattggtagctccttacatcgaggagcacttggctctagttcgcgccaagaacatcggtaagtccgatgcatggattacacggcatcacattgatactttccccgcgtggctacgacaatatctcatgggtaacgagtcgatcaaccaacaacttgccttcctggcgaggggaccgtctgggtcgatcgcgacattctagggatatgagatcaatgggtacacattctacacgagagcccaagacatgaagagcacgaaccaaaacaacgctgttcgtgtcgatgccatgggacacgatgtaacaactgacacgtattacggtgccatcgaggacatatgggaacttgactatggtcctctcaaggttcctctgttccggtgccaatgggttaggttgactggtggaggcgtaatgattgatgacagtgggatgacaacggttgaccttaacaaggttggatactcggacgaaccttttgtccttgccaatgatgtaacgcaagtcttttacgtgaaggacatgtctagcaaaggaaagaagggcagagggcctgacgagcctaagcgtcacgtggttctcccaggcaaaagaaaaattgtcggagttgaggacaagactgacgaggattacgatgagttggatgggcaaccccctttcacggtgacgattgaccctagcatcctcctatcaaatgaagacaccccttactcatgtagcgatcacaaggagggaacgatagtgaggagaaagtacgtgcggtcaaccgtcaccgccgatgtattgccgtaattattgtgtacatgatgtaaactattttggatgtattgattatccatataaatcaattgttgtatggcatatgttaattacgcacgactattagaggttttaacaagtttaaatcatgtatatgctagttatatgcgataattacaatttttaaaagttttaaatcacgcaggtggcattttcatatgttaattagagtttttaacaattaatttaatatcattcatatgctaattatatatgactattcgaatttttaaaaggtttaaatcatgcatgtggcatttacatatgttaattagagtttttaacaattaatttactatcattcatatgctaattatatatgactatttgaatttttaaaagttttaaatcatgcatgtggcatttacatatgttgattagagtttttaacaattaatttaatgtcattcatatgctaattatatatgactattcgaatttttaaaatttttaaatcatgcatgtggcatttacatatgttaattagagtttttaacaattaatttaatattattcatatgctaattctatatgattatccaaatttttattaattttaaataatgccgtatgtatatacatatgttaattagagtttttaacaatttaatatcattaatatgctaagtatatatgattattagaatttttatttattttaaatcatatatttgcttattacgttttatcaacttaatttattacagacaacaataatttttcgaagtaattgtcattaatttttgtattttaaataattttagtgcattattttctattttagaaacacatatgtaatggaaatttatattcagtgcgcttatcagtagtcccggttcttatccctaaccgggtttaaaaagaatttggaaatagcgggaaaatatctttagtcccggttgatgagaacaactggctcccggttgttctcatcaaacgggaataaagatctaggggaccaacacttagaagtttttgcctgatcaatctctctcggcttctccttcgccgccactgcctagggcatccccgcaccgacaccgccgtcgtttctcgccgtcgtctcgcgctcgttgtcgtcgccgcctccgcctcctcctccgccgccgcatctctggggtgagagccgccgccgcctccctctcagctctctctctccgatctcgatctctctctctccctctcggttgacgccggccgcctcgttgccgacgccgacgccgacgtcgtcacgacacgacaccgcgccacgacaccgcggcggcatgaaacgccgagacgccacgacgccgccgcggcacatcactggcgccgcgccgccacgccgccgcgcaccgccgccgccgcgccgtgtcgtaggctctccggaccttccattataattgagagatgaagtgaataattcaaatcatcaaacaagcataatgaaatatccgacgcctcgagagaggaatattggagatattgctaggcctttagcctgccagtcaacttcagcctgagatgtgcccgtcaaaccactcgaaggcggcaaccagatgtgttacacattcaggagacttgacaaaaatggctaaagttctacaacatctcaaatattcctaactcatactcatgtgaatctagttcccaggatgtgcactagattcacactttcatctcaagcatgattagacatagcaaacacaaataagatgaaagcgattgtaaactacatctactttagttacattggccgactggccaaaaaaaaatatatatatatagaacagcggaagcttgtctacccaatccacaagcacaccgactaggggtttaccccattaagttcaagtcctagaagaagcagtcgatcacccgcatcactcaaaggctaagtctaaatcctgcaagcaaaagttaattcaacagcaagagtcagtacattattagaaataatgtactggctagcaccaagacaagcctaagaccctacttgcaaggcatataatcaaggaaggcataatatggttctttttagcataaagcaagttttatttgcataaaacacattcaaaacggatttgctttcaaataaaatttcagcaagctagtacttagcatatgggcatcaaagtaggcattaatcatgtataaatattcacctcattgccatccatggcagcaaggagatcattctcaaatctcatcacaatttgaaggtaaatttcagcatttaggagaataaacacaagtctatactcaatacatatccacacgccgctcatgaccgcgagcacggctaatcgattagttttaactctgcagagtttgtacactttacccacatgatgcgaaataataatcatgcaagagcatggcacgcgatacataagtacccgatttattacccacaacaaagtttttccaaaattcatgatttagccttacaccagcacgatacgtgttcctccatcctagtcatactagaaatatgacctagaaccgttaagtggcgggcccatgccttgaacttaacgccgtggtggcggacacaacgggaacccacccacgtggcacaataccgttgtattggacagacttagtcacctaaactaccacgtcggggtaaataggaagttcctctgagttatccgaactcatacacaccggcctaccagaatgtaaggctaaaccataaataatttactaagcttgggctatcccatactagcacatgtggttgtactgtatacgaaatgaactgacattgagtgaagtccttaggtcggtttgggcgcactctccccctatcggtatacaactaatcaccatatgtacaccacttgaggcccaaacctaaaatccatgttttccactattttatttatcaaaatcacaagttttaaagttctgtccagattaattaaaaatcaattttcatgtttgaaatgagcccataatgacaaggaagaccattctaagcatggctaagctttatagtaacctagtgtcaccaaaactcatatataaagtggtatagccatattgttcctaaggttaggaatgaggaatatggatatatgtggagttaaggtgataatgcaaataataggagtttatctaacaagtttaacaaaattttaatttattagtgtacaatcgacatgcaagatttgcaaacattttcaataacctccaaaagataggttcaaagtgatcaaagagagggagatgggacttgccttgaatcaggaaaatgtcagcacctaaatcacttcttcaccgattaagcaatcatctatacaaagtacacgttatgcaattaaacaccgaaatatgcgaaaaatccaaaatgttctaaaatgcgtgatttgtgcacagagaataggtactggtataaaatgaatttaggtgaaagaatttctattttatctcattttatttgggagttatgaattttagaagtttcgtcggtatagtgtaggatttacttagttactattgtgaaatgctgttgtaaggtgattcttattaagtttatgtttgctggggtgaatatatttgttttctaagactaacacatttggtttcataatttttagagttaatatgaattatttatgtattttacaagttttaacgtgttctaggcatatattccctatgtgtaaatggctttggagatttaggtccagaacttgctctaacttgctagtgttgtataaaatgtgtattttagttaactaatctaatcttagtttataaaatttagtgttcaaattactttacttcacattttataagctaggggatgttctatgttagaaacttaacatatcaatctggagattattatatgagttaaggatactaagttttggtggaaggggatggatctatgccttcactggttcaacaagttttatttggatttatttggagctaccatgcatatatatactttttcatatgtattgtttaaccactactatgtgtttagttcctattctaccaaattaaggttcagagccatggtctgtaaagagggtgctataattcactctactaagttgaagtatatcacttgctggttctatagaaaatttggttcacttcattttgactatagatgaattttctacaaatgttacaatttaaggtatgctccatgttgcttattccttacttaaatacttaggggttttcgttatactgtaagtatgtctttttattttataacattgaagtgcacaaccctatgattctactgaatttgggtttactcaaaaaggatctaagatgaattttatataaacttctaaagttcagcttatgcaaaactagtcattttaaaggtaatagttttagaggcattcgatgtatagtatgtatactatttcattttgctttataggagaacataagttggtggatctgtagaaactgagtttgctccaaaatgagttgaaatgaattttgtatgcattttataaatttgtgcatgctttatgtgtgatttaacttggataaattttagaggctaaatttgtactgtgagtgcaagtttttattccataacactaaagttcacaatttggtgagttgacagaaatttgtatcatcttaaaatgagctatatttaattttatatggattttacaagttttaggtactttccttttataatttcagatttttgtttccaaggggtccactgtcagtgaaagatcaatatacaaaaagatccctgaggtttctaagaatcaacccgcagacctagcctcatatgtcagtgagttgaaaagttgcacattaatccttatagttgtttaaattctcgaaacaaggtccctgacttcttttctcatgcacagaggcagaacagccatggctgagctcgatctcgagctcaccggcgacaaacgatggctcgtttgggggtgcaaccaaaatacaaaatgaagatcatgttattgcgattccattcctctacttttctcggtcagtggacatcggagtaacgccggcggcgagtccgaaaggaggatgttttcgggtggtgatgcatgtgcttctacaatcatgtattggttaattgggtgcatgcatgtatgttctataggctgaagggtgctcaccgagatgctagacatggctggggtagctaggttgatgacggcggctcgtgtaacggctcggcggcggcaagaacctccgggtgaacggcgatggctcaatcagctccaagaactatcatgcatgtgtgtccatgaggttagagaggccccagggatgctactgatgcatggaattgggttggtactcaccggagggggtggattcggcaacggcgacggtgaccggaggtggagaagacggtggacgatctccacactcgtagcaccatccttcgagattcttgaggggaaatggagaggaggtcgaggcgaagacgctggcgcgacagcttggcccggcttggtccagataagcgggaacggcgatgatgtcactgcggcggtgcacagagcgcgctccagagctccggtgtgcacggcagcgttcccgtcgattggctgcaccagagaggatgaaatcaaaaggagaaatattcggcatggtgaggagagtatggaacgcaagagaagaggaaacgaccgcggctcatcaacgattgcggccatcatcttcttcgcggccggcgatggagaaccagtggagaagagcagcgaggatgctctccctcggatggatcggcactggaatggtgggtgaagagtggcgacgcgtctgggagaggcagaaatggagctcgtcgtttttagggtgtcgacacgtcgtggccacgcgtcgcgcggcgtctagagccggtcggcgctcgatctctccctctcagtgtttctcggtcagctagggaagttgcacagaggaagggcaagccagagggactgacaagggggcccaggtcgaagtaaactaggtggaagagagatgtgtaggcagaaacatgggtgagcttggtttttggacgaatttccggaattattttctcctctaattttgtagcttcaatacttaatgtgttgatcagattagctagtattgattttactggaggtaggtgtatgtacctagtttccattttctttggttgcactcaaaaattatggatagattactcacagaaattagaggaatatgggttctttggaaactagttcgaatttttaggagacctaaacagagaagataaattctgaaaaaattatttttattcatgataaatgacctagtatttgaataaattattttacttatacacttttatgcagttaaatgcacttttagacaaagtatggttttagccgattaagaactacagttaatctagtttttattagtttgactgatttatttgaggtaccaaatttagttattaaattataccaaaattacagtgagttgtatgtgttgagtagagcctacatgaattttcccatgattttatcttgcatgaattattttagataattcgcaggacttatgtcttatatgtgtttctctttcctaaatgcatgtaaatgtttataaaagttatatttggactctcattaacctgaggtgatgttgatatgttagaatcacagtttaccttacacatgtcataagctccttccctatttatgcataagtttactttagtattaaattaagagaatgcttatagagatgattaagatagaatataccctatatgatataatttatttgttcactttcatgttcatgacatgtcttcagatggatgtccaaattagttttgtgaggcttgacattagccatgttgatattttttttaaggtgtatggtttttatgtattattttccattagttaacactaggccctaatggtttagttgtttatctagatcttagttaatattcatgagacctattatgaaatgcaaatcgaaaatccaaatgcataagaaggactcaagtcaaaatatgatttatgcacgtatgcatgctttcacttgggttgcatccaagtcctaggttaaagatgaaaaagtttttaatttgttctcaaattttattcatgcaagagttgaatcaactccacctaggtttaaaatggaaatttttggtttacaaaattgaagaacttccctttcaactagttttgatggaaattccttaatcctaaaattcaggtatgttacacgccgccaccgcgcaacgccgccgccgtgccgcgcgcttcgccgccgccgcgaaacgccgccgccgtgccgcgcgtgtcgccaccgctgtgcaacgccgccaccgggccgcgcgccacgccgccaccgcgccgcgcgccgcacgccaatgctcgtgccgaccgccccgcccctgatccgctgccgccacaccgccgcttcgctgccgccacggcatcaaacgaattaacgtgaacgtgcacgaacgtgaacgaacgtgaactaacgaacgtaaacgtgaaatgcaatataggcaagtgaataaacgtgaacgaacgaacgtaggtgaatgaaacgtggccttaacgagaacgcgaacgtgaacgatcgtgaacgaaacgtgaacgtcaaatgcaatatatgttactttgcgtttatcctaatacatctttttgtatgttgcggaaaagacgttgtcggagtcgtccctcaagccggagtggtagctagccctcgaaggaattcacgcaggcaagtgacgatattatatcgcagaaggttatatttgtaatgcaattaagactattagatttaatatacgacacttagacttagttttaatataagattattatagttttaatacaagattattagatttgtaactagacttagcatataagattgtttagggttctaatatacgacagttagactacgcatatatcactatttgagttttagtataagattattagatttgtaattagacttagcatataagattgtgtagggttctaatttacgacatttacacttagcatatatgactatttgagttttagtataagattatttgagttttaatataagattattagatttgtaattagacttagtatataatttattgactagctagggtcctataatatacgtcacctagacttagcatttatcactatttaagttttagtataagattattagatttgtaattagacttagcatataagattgtgtagggttctaatatacgacagttacacttagcatacatgactatttgagttttagtataagattatttgagttttaatataagattattatatttgtaattagacttagtatataattattgactagctagggtcctataatatacgtcacctagacttagcatatatcactatttgagttttagtataagattatcacttagcatatacgtcacctagacttagcatatgattgttagcatataagattgttaaaacataaatgtctcatgacttagcatctgtttcctgtatgaacagatggctgatcgcgatgatgaacagatattgtacgatacaatcgcggagggaagcagccagtactggaacgaagaaaaggggaacaaggatccaaaccagtatttgaatgaggaagggaacgtggagagggatgcggaggggaaccaggaggggcacgtggaaagggatgtggaggggaaccaggaggaggaggctagtggaagtcaaccctccgctggacagaagagggcacgcgggcaacgaggtgccgcgaagaagcttgagggtcagcacatcataacggaagtggacgaagacggccgacctagtgccccggcagaagccgccaagaactatgtacgtcatagcggttgggttgtgcaggataacgtgcctgtcagtacggtgtactggcgcagaacaagggcatgcggagatcatgagagctttgtcccagattcggagaaagagatgctgtggaccacaatgctcgagacattcacccttcccgcgggtacagaggacaaagtgaaaaggtggactctgaagaaaatggcagaacagtttcagagcttcaagggagatctataccagaaatatatcctgaaggggaagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagtggggtatcgaaccggccaccgctaattggccggaacgatcgaagttctggtactatgctcacggtggaacgctcaacccagcagatggctccctggtcttcggcgatcagatacgcgaggctgcgcgttgattaacagacgcagtggaaggctcttctcagggcacgttccgaccggacagagagaaggacgagctgtcactcgccctgcagactccagagcatccaggacgaacatgagggaaatgggtgattccttggaatattgggttcaaggaggacatccacacatacaggagtcggatgaggagcaagagagataccgaggcgaagattgcagatcttgagttcagggtatcgagctacgagctcagcatgcaagaggaggtggcaaggaaggttgatgaacgcatggccgcacatcggtccaatgatccccagccgaccattcctcctgcaatggtgagcccgtcaggaaatcgtagcagttgcgcctcaacagggcaggtaggatcacagagcatggacgccatgcaaacccaggacaaaaccacctgccccgttgatgacatcactcagcggacaccatgtgagctgcatatccccttcaagaacttatcaataaaggtaagctcgtagtttatagattttagatttggccattccgcttgttgctgcttatatatgttgattactaataaataacctctcaccacatgaaggtggcgtcgggcatggccatcccaacggacccttcaggtacttccactgcaagccgattccagcaggatactccaaggtcgaagttgagttggtcgaaggcgcgtactaggacttcgagctagattaccctggaggagacggtgaggcgcatctacgagacacaagccacgccattattctatggcgcaagcggtacatcatcctccctgggcgacaagcggcgtctcgtgcaccatctcctccggctcctgcaccgtctcctcctcatgctccagcaccgtctccacctcaggctcctgcaccgactcctcctcaggctcctgcaccaactcctcctcaggctcctacaccgactcctccgcaagctcctcttacggcaccttccaagtcaagggccccccaagctccaccgcctgcccccacaaaggcaacgaagaaggcgaaagttgacgccgccaagaacaaggacccggggtacgattgcacgcaagaggagcttgacgcttacgtggcatcagaagtcaggagacaattcaagcctcgaagtccagaaaagaagattcctatagacccgagtgtcaggaacttcttcaggggtatgtctgcacctgccaaggaggccataaagctatcggactatgagtgaacactcaagaaagcatgttctagaaagtccaaaccagtccctcagcttggagagcaaccaaaccaggagatcgagccgttagtgaccggtcaagattttggaatacaagactttattaatgacaccgggctaactacagatcaattgctaggagacgcaccaatcgaaaaggcggaagtgaaatacatgtacgaacttggtaaaccgcttgtcaagcctgagctgctgcagtccctacccacacaaatgtacaagttccatcaggtgtacatggagatgagcgccaccgatagagagatgatcggagcgaggattagggacacggacttcttgcaaggagatgacattctctggatcaatttcaaggcaatctacgaactataccagctggacgccctcggcgtctctattatgagttgctggattttgtaagtatatcgttcagttagatttcttactacgtctcctttaattaattaggtccttgtatataagtagactatatataatatatactcccttttatcgttgtagaatggagattcaaagagcccgacggcggggggttttcgatactggattcatcgaccctcgaaaagtaaacgtcgcaatgctcgaccaatatccgcaagccacagaggacaatctcgtccatctcctgaaggcgcagctttacaagacgttcatactgttgccgtacaacacagagttagtttaattttaactgtcttcctataccaaatttcattcccgtacgaacatgctaagtgtttcatatgtaatgcatcccacgcacattgcagattccactgggtgcttttactcttcgacctagaggcctgcaccgtcaacgtatatgactcaatggataaaaaagagtctacgtttgacaaggttttcgaacttatagacaggtactgtcataagttcctatgttaattaggaatcttgtaatagttaattgctactgcgaatcatagctttaaactccatgtagggattggtatcggttccgtcatttggtccgcggcaaatggagagaaacacttaggcggaagttcaaatctcctgtgagtacacatgctctacatttatatttctccgattcaaatacataaaagtgttatattaattagatctctcgtcgttcgtcatttatttatagtgcggaaagcaaaagcagggaactaacttgtgcggctactacgtgtgcgagtattgccactgccttgcagaccaaatcatcaccacaagagagctcgatgtacgtacaaataaattcaaaatttcattatgtatcgatttgttgtttaattactaatcaatttcatacattcatatagtttattcgcatgagggataacctgatcacacacaaggaatttatcgcggcggttcaagaacaactcatgggattcatcaacgaacaaatccttgatcccaagggtgaattctactacgacggaaaaacaattcataggtccttagcttctgagatagcgactactactacgtcgaaatcgtagctagctaggacatataaaggattgtaattaatacatgactatgtttctatatgcatgtgtagacattttctataatgtaaatatatattttggtcaaatatatatatatatatatatatatatatatatatatatatatatatatatatatatatatatatatataaaccatgcagcaaatgggccatgcaaaaaaaaaggtcagctcgatctttagtcccggttatttcacccgggactaaagatagcgatctttagtcccagattggtagtcccggtttggaaaccgggactaaagggggttacaaaccgggactacaaacgctttctccaccagtgattgttccttgaaatagataactccttattggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatgcggacacatgttggtgatggcgtgtggataccggtagaggcgccgctggtttgaggtgctgatcggcgtgggagtacggcgaggagaacgcacgaggaggagaaggtcgagccagtgcgatttactacttcctctacatcaacgtgcgctacttcgtgagagttccttcgacttctcagtgtcttcttccgctgcacagcgtatcgagtggtaacgatctatgatctaatacttgcatggttcctggtttacgcgatagaaaattttgatttatgctatcgtagcctacgcgtatcccaatagtggtatcaaagccgccatgtatagtttatgatctagatcaatgcatattgttgatgtgcgggtgtagtagatgagatctattatgttgtatatgagttcttaggtgatcggaacatgagatgaaccgatagccgatgggttgatgagatcaatcggtatgtgtgttggtgacttcactggaatgtctagtactcaccaaggccgagcgcgatagtccgatgtccactggaaccgcacgccaatgagaaaaacgagccaatgagattgactcggtttcggcataatttgattacaccgttaaggttttcacatggcgaatcgtagatgagatctatgtaccccgtgaccttttcagggagctgccctgaaacccgcggggggtggctcccccctcgaccccccgcccgctaaccggcgtgtgcgttgccccttagatttcgcttggggtttttatatctatcttactttattgctgttatatatttgatatgacatggtaggatagattacctcagaaaaattaagtgtaatttatgctcttccaataattgcacctattatggttgtgatcatatgtgatgggtttgccatagcaaagtgtcactttttatcatgataaaataggatagatgtcgaacatctatatgcggaaattattggtttacttgacaaggttatcaaaacagttttggaccttggggcataggttgggttggacatggagatgtcaccccaacagcacaagagtcacatatgatgtgattagctaggtgttgcttacctattttgatagttgtctagctgtgatgccaaagctcactagacactaataaaatgaggatcttgactcactatgttagtagagggaattttgtttcacaatacatagtgggagtatcttttgttaaattgtttaattaaaggttaaatgtaaacatggtgctgattttgcatacatatatttctattgtagatcatggcagctcctgcaccatccagttttaacttgcggtctattcttgagatagagaagttgactggaacaaacttcatggactggtatcgcaacctgagaatttttctcaggcaagagcacaaagagtttgtgcttatagagccttttccagctaacttgcccaacaatgctcctgctgctcaacgtagggagcatgaaaagcgatgcaatgattatcttgatataagctgtctcatgcttgctactatgtcccctgagcttcaaaggcaatatgaggcattggatgctcatacgataatcacgggactacgtaacatgtttgaggaccaagcaagagctgagaggtttaatacctcaaagtccttgtttgcgtgcaggcttgcagaaggtaatccagtgagcccacatgtgatcaaaatgattggttacaccgagagtctggataagcttggctttcctcttagccgagagttggctactgatttgattctccagtcgctctctcctagctttgagccgttcataatgaatttcaacatgaacaacctgaacaggaccttggcagaattgcatgggatgctaaagactgccgaggaaagcattaagaaaaactccaaccatgtgatggttatgcataagcacaagcccaacaacaagaagagtgatcaaaagagaaagctaaactctgatgagatcacgagtactagcaactctaagaccaaggttcaaaagacagggcccgctaaggatgcagagtgcttcttttgcaaggagacaggtcattggaagagaaactgtaagaaatatctagagcagctcaagcagaagcagcaggatggaaagagttccacctcaggtattaatgttatagaaattaatcttgctacttcctctactgattcttgggtatttgatactgggtcagttgctcacatatgcaaatcgttgcaggggctgaaaagaagtaggagcttagcaagaggcgaagtggacattcgcgtgggcaatggagcaagagttgctgctgttgcagtcggcactatgccattatctttatcgtcaggataagttttggagttaaataattgttattgcattacagctttgtgtaagaacgttatctctgcttcttgtttgcaagcagagggttatggttttagatctatggagaatggttgttcagtctattataatgacattttctattttcatgcacccatgatgaatggcttatacattgtgaatcttgatggatgttcagtctataacattaatgcaaaaaggcaacgtcctaatggtttgaatcccacttttatttagcattgtcgcttgggtcatataaatgagaaacacatggagaagcttcatagagatggacttctacactcgtttgattttgaatcatttgagacatgtgaatcttgtttacttggcaaaatgacaaagtcacctttcacgggtcaaagtgaaagggcaagtgaactattgggactagtacatactgatgtatgtggaccaatgagttcaactgccagaggtggttttgggtactttattacctttaccgatgactttagtagatatggttatgtctacttaatgaggcataagtctgagtcatttgaaaagtttaaggaatttcagaatgaggtacaaaatcatttgggcaagacaatcaagtatctacgatctgatcgtggtgtagagtacttgagccttgaatttggcaatcatctaaaggagtgtggaattgttccacaactcaatccgccaggaacgcctcagtggaatgcggtgtctgaacggaggaatcgtacattgttggacatggtgcgatcaatgatgagccaaactgatctatcgctaagcttttggggttacgctctagagacagctgcgttcacactaaacagggttccatcaaaatcagtggataagacaccatatgagatatggactgggaagcgtcccagtttgtctttcctaaagatttggggctgtgaggtctatgtaaaacgtttgcaatcggacaaactcacacctaaatcagataaatgcttctttgtggggtaccctaagaaaacgaaaggatattatttttataatcggaaagagggcaaagtgtttgtcactcgacacggtgttttcttggaaaagagtttatttcaagaaaggatagtgggagcatggtgcgacttgaagaaattcaggaaacaccggaaaacgcttcaacgtccacacaaccacaagctgagcaagatgttgttcaacaggttgaacaagttgttgttgaaccagttgtggaagcaccggcttcacgaaggtccgataggatacgacgtacacctgcgaggtatacgttgttaactacaggacaacgtgatatattgttgttagagaatgatgaacctactacctatgaggaagcattggtgggaccagactctgagaaatggcttggagccatgaaatccgaaatataatctatgcatgtcaatcaagtttggaacttggttgatccacctgatggtgtaaaagccattgagtgcaaatggatctttaagaaaaagacagatgtagatggaaatgttcacatctacaaggcacgattggtggtgaaaggtttcagacaaattcaaggtgttgattatgatgaaactttctcaccagttgccatgctaaaatctattcggattgtttaacgattgctgcctatttcaattatgagatatggcaaatggatgtcaaaacagctatcctcaatggaaatctcgatgaggatgtgtacatgacagaacccaagggatttgttgatccacaattagctaaaaagatatgcaaattgcagaaatccatttatgggttgaagcaagcatctcggagttggaatattcgttttgacgaagtagtcaaggcgttgggctttgtcaaaaacgaagaggagccttgtgtatacaagaagattagtgggagcgcactggtgtttctaatcctatatgtagatgacatattattgattgggaacgatattcctatgcttgaatccgttaagacatcgttgaaaaatagtttttcaatgaaggacttaggggaagcagcatatattctgggcataaggatctatagagatagatcaaagaggctaattggattaagccagagtacatacattgacaaggtgttgaagaggttcaatatgcaagattccaagaaaggtttcttaccgatgtcacatggcattaatcttggcaagaaccacgatgtcacatggcattaatcttggcaagaaccagtgtcctcaaacgattgatgagcgaaacaagatgagtgtgattccatatgcctcggcaatcggatccatcatgtatgctatgctatgtacacgtccagatgtttcatatgcacttagtgcaacaagccgataccaatcagatccaggtgagagtcactggatagctgtaaagaatatcctgaagtacttgagaagaactaaggatatgttcctagtctatggaggacaggaagagctcgttgtaaatggttacattgaagcaagcttccaaactgacaaagatgattttagatcgcaatctggatttctgttctgcctgaatggaggcgctgtgagttggaagagttccaagcaagatacagtggctgattctacaacagaagccgaatatattgccgcttttaaagcagcaaaggaggctgtttggataaaaaaattcgtttctcaactaggtgtgatgactagtgcttctagccctatggacctctattgcgataatagtggtgccattgcacaagcccaggagcctagatcgcatcaaaagtccaaacacattttacggcggtatcaccacattcgcgagatagtgggtagaggagatgtgaagatatgcaaaatacatatggatttgaatgttgcagatccgttgacaaagccactccctcagcctaagcatgaggcacacactagggcaatgggtataagatacatttatgattaactctagtgcaattggtagactgttagtgatatgcccaagaggcaatcatagagatgattgtatcacatactatgtttacatatttatccgacattgttccttgaaatagataactccttataggttaatgaatatgtgattctttcatgagactctttatgttgtttgttactatttctaaaggatccctgatcaaatatcatatgtggaacaaatatgtttatatgatcagcacatgtattaattgatgatcatgtctcatggatcatggtatagagataccaaattaataatgtggacacatgttggtgaacatgtcgttggatagacccaacatgagacactgcaagagccatatgtgttgtgtcatcagttatctcatttagtgttggtgttgaatccttagacctgagattatcatggttctcaacatatgtagtagcttacttagggactgctaaacgctactccgtaaatgtgtagctataaaaatagttttcgggtatgctatgaaacatgtagtgcgatatgaataatcaagatgggatttgcccctcctatggagagatatctcttggcccctcaatgttgtagattatggaagtgcatggccatgccaaaggtgattgaggagtcaatcacaagttatataatctatcaacaggttcgagtgaatgattgagctattagaggatggcacatatctagccttgagcttaatcgatattgtgaggcaatttggttcatacaagtatacactagacgttcagccgatatgatctttatgtatgcccggtgggtcaatacgttctgctaggggccgctgttgacgcgtggaccgaaaaggagttttcgggttacagccaagtatatatgaacctacagggtcgcacgcttaatgggccggaataaggggattggatggagatccaatatgagcttacttcggataagggatccgaataggaatcctacaggccttggaggcccgagtgatggatcctatatattcgtgaggggtgtgaccggcggaggcattgcatcatgtgagaaaccctagccgtcacttccctccccgagcaaaaccctagccgcgcgcgggtgctagcacatctacgtgtggcgtttcgtccctgtacgtgttgataccggtagaggcgccgctggtttgcagtgctgatcggcgtgggagtacggcgaggagaacgcatgaggaggagaaggtcgagccggtgcgatcgactacttcctctacatcgacgcgcgctacttcgcgagagttccttcgacttctcagcgccttcttccgctgcacagcgcatcgagtggtaacgatcaatgatctaatacttgcatggttcctgatttacgcgatagaaaattttgatttatgctatcatagcctacgcgtatcccaacatatatatccccttattcatgaatttcccttccactatgaagtattttgtgtagcgtagtatatgctttagaatgttagttggactgctcttatttttatttatctctgtgttagaatgatgggccggtctcagttatcttaatatttatcaataaattggataggccaaagagcttgttgtaaaattgatctctaaaatttaaaaccttgtaaacgatacacatggttgaatgtactatttggcactttggaatttaaatttctactcttgcattcaaaacaatatccttatcagaattttcatggaaatcctagagctgataaattcttagatatatggtaaattttcaagcaaaccatagtactccacacattgataataacaacgtaggcaaattttactacagtagaccatcatttcatggttttagctcctggatatggtagaagtcaatctttaagagaaaaaaaacttttgaaatatggttatttgctgctggacaacatgctcattacaatatttattttcagtttaatagaaaagagaaacagtatgcaaacacaacattcccttggccccaattgtcatattctccgattggtatcgacggaagcaaatctacgcgtggatacatcggagttggcgatggagtcggtgaccagctagacagacaggaacaacttcaatcggtgtagcgccttccaccatgtgctcgctaaccatcttctccctctcgatcaccataatggctttggcctcacccacgcacgccgaccatggacaacctcgcctcatgcatgatgacgctttgttgtccctctgttccttccactgtggtctcccagggcaggagtattgagtaggcaggaagataaacggtatgacaagtagggtcaagactatttttttgactttttatactatttatctcttctatttagccagaaataaaaagttttatttatacagtgtacaacagtaaacaaccatattttttaagttttttcttcttaaaatttaactatagatatattcacaaactaaaaccgcgaggtaacaatgtccttgggcaaaattttccaaccatccctgttaaatttcttagtacggtatagcgaagcctgatgctgattgtaaatcaatcctttctcaaatctcaagccggcaggtttgccaattgatgattggtccacgtgtcattattcacttggcagataaatcagcatctaagagtaaaaaaaaatactgagacgagcagctggcgtactgtaaggaaatgaaaaataacagggttaccgcatgcagtgttctgctgctgtgttgcagctccgcatgcagacaacagaaaaatcaggatcaatcgagcggaaggagcccacatggctcacccttacattggttaaattactcatcatatagagagcgcgccattttcaaccttaccaaattttgataaggttgctaaaaaaagtaactacatttagtttgctgtcaaattttagtaactatataagaaatcctgccaaaattttggcaagtggcatagttggtaagctttttttttgcaacaaaggacttgttcactttgatgccatttttaaccttaccaaattttgttaagttgctaaaagtggctatatttagtttgctaccaaattttggtaactatataagaaatcctgctaaaattttggcaagttactaaaattttggcaactataccaaaatggtaaggttttttttggcatcaaagtaaacggtccagagttttggtttcaatgagcgtaataattgtaccctgcatttgcaataaaattgttgaaacaataatgcatctcatatatatttacacacttatctatactaatataaaaaacactagttcatcaaacacctctctttctaccgttagatctatttatccaaaggcttatatggaaagttaaatcaacctttaattagcgatcccacgtcgtgataagcagcagttgtagcgatcggtcaaaacgaaaaaataatttgtgttgccggccctagcccgtcggcgccgacgcctcctcctcgacgtcccctccattgctggcggcggagatgcagaaggtggtgagcctgacgagagggggagggggggagtgtcgtcgtcgcgggcggcgtcgatgtggtggagcacggacaacggggtgctcttgcggtcgagggcgtcgtcgaggggggaggaggacgacgacgacgaggaggcgctgcggtggacggcgctcgagaagttgcccacgtacgaccgggtgcgccgcgccgtcctgccggtggtggacgagggcggcggcggcggagggggatgggaggcggggaagaaggtggtggacgtgctcagcctcgacccgtaggagcggcgggcgctgctcgagcggctcgtgcgcgtcgccgaggacgacaacgagcgcttccttctcaagctcaaggagcgcatcgaccggtgcgtacagtacttgcacatttcgtcacgatgtcgccgtggcggtggtcgaggttgcgggttgcctgcagggtgtttgatgaattgcgcgtggtaatttgatgtgcagggtggggattgatattccgacgatcgaggtgcggttcgagcacctggaggcggaggtcgcgtcggcaacagcggcctccccaccgtcctcaactccataaccaacaacctcgaggagccgagaatgcgctggggattctacccaacaagaagcagaccatgcccatcctccacgtcgtcagtggcagcgtcaagcaccgcaggtgaaagaaagaaacataagcatcacattttcataatcgcttctgctttacataacgttacgtttgtgctgctctcatggtttatttgggaaattttgaaagattgtaaggtatttgcttgaacatatttttgtatgggatgccggttccaccggaaacgaaatgctttttccattagacatgtccctgcaaactgtaaagtttatttgtcttttgttggagcctagattaaccaagaacatttggaattcaatttctatgcttctcctataaaacacgcacctttgattatgcaggatgactctactgttaggaccgcccaggtctggcaagaccaccttgctacttgctttggctggaaggctcggcaaagacatcaaggtttcaaacaaattttctttacatattttgcaataactgcgatataacgatgcgtttgggcgtttggcaaaccagtccgtattcccacagatgtgtgcacttcatcttgaatatagtatatggttagccaaaatacagagaacatacttttgtatgtatatttgtgtattgcttgaaaatattcctaggagcaatagcgattgttgcgtgctttgccaatcagttaggtacatggacctatgttgaatgggagacgtagataatcttggcatcaaaacataatcttgaacttaccttttcagttacccattatagaatattaaaattgctaatatatactgttaataagtgaacatcaaatattccaatatattactattaaatcattcgggagcacagtgcttaggttgcttccgaattttctatattagtacacaggtcctcattctgaagcatttttcaggcaaaaaccaactgtacaggtttcacaattgaagagagaatctcatttgaaacaaaccttttttgtcaaaggctttgtggatacttgcataaaacagcacccaaatgatgctgcttttcttgaagaaacaacaattgttgagcattatgtgagattgttttgttctgttctgaactgtaaaccgcatctaattgtgtgtccctggcgcacttttgttttgttcatgtatgtatttgtatgtggtgtggatgcctatgcgctgaataggatcccccgtgttggtgcagatgtttgaactttgtggtggttcttacagacctgagtagcttggatccacttgtgatgtagtctatggcttttcataacattgtttgcactgacactatgacactatgcaactacttactgcagttgctttgtatatatatctcgacgaagtatgaaacgcaatatataccgacatggatgtatatcatattaacatttacattgttaaggttttttaccacggaaatacattcattgattatttaacatgatttcatcctatgtgattttttctcgttgcaacgcatgggcacctaactagttcctgtaaaaatacatgagcatctccaagaactgaacaatatattttaaaattgattaaataatcacactcaccagcaacacatatttcacctaccactagaaaaaaaataaataaatcgcaaatacaagcacacgtaccaaatttatgatttaaatctaggtggttaagttttaccacaagaaacaccatctaacacatatgtagcctatcgctggaaaatactaaactataaatacaaacgcactaaataagtcttgacttaaaactggttgcttgggttccacaacgaggaacataaacaactaagtattgttatgaatgatgaacattggaactcctcacaaaacaaaaatgtgaacactttattttttctaaaaaaaatatcaagacctaattttcattagtagataatttaattataattttagacaaatcaaggaaccatggaatagcatgggcgaaaaaatagataatttaagaattttctgaacaataagctctagtatattaaatagtaactcgaaatctcattcaacaatttatttcaatgtatgttttttcataagtttccagaaaatgaaattgattcctatggatttttgtgattgcactactcaataataggtacgggccataaagcgagcgcgccaattgacccgctgaatttctagtatttcctaagcctatcagcaggctatcagcctgcaaataacttttgcatcctgacggaggccgctatctcttgcacacaaagatgccaagtcatgtaatgtaccacgtagcgcttagcattttttaaaaaggaaaacaaaaggtagcctaagcctaatgcttaagtgtgctcagtagacgtaacccttttatgataaaataaaaaaataaataacagacttaaaagttttgcattttgatttgaattttttaatttaagttgaaagttttgagttttgagatgaacgttttgaaactttcaactcaattttgacaacttttaacataaacttcaaaactttcaacacaattagaatcttttaattcacttttgagaattttcaactcaaatttcaaaacattcaagccaatttatgaatctttcaattcaattttgaaaactcaaatttccaaaacattcaaataaaattttaaaatttcagccctatttttgaagcttccagttcaattttgaaaactttctggttaaattttaaatttttaactcaactgtgaactttcaacttaattttcaaattttaagttgaaaatttaaaaaaattgaattgaaagttttaaatttggagttgaaagttctaaaatttgggttgaaaatttaaaattttggatgatttttttttaattttgagttgggaagttttaaatttttttacgatggtgaaggcgtacaacgcgtcatacgcgtgccacgattgtatgtgtgatatggtgatgctcacgtctgctcccatgtgggccgacagtgtgccccttacgtggcaatgggtcggcgtgggactacgtatcggcgtatccatgtggcaaggaattctggagcctagcactgtttggtccatcacccacctaaagtgacatagcctacctccaagcacagtgcaataacaatacctaagactagagataggcccacattgcttgtctttttacaattccctccatcctagaaagcatgcactttcattgttcaaaatatatcccacaaaagttatcattttaaatcttgttaacaacccttcgctcctattcaaacaacaaccatatatgtttcaacactccagtattttggtggaacaaagaaggaaaaggggatacaagttgctagcaaacaggtgggacgagaaggaggaagagaaggagaatgagaagggttgccaccggcatccaagtcatcgccgccaccgccgcgagcctcagctcgccaattgatcaaacctccctttttcgatgctactcctgctgcttatatagtgctctccctttgcttgcttgggcatggctttgagagtggtgacagcccattggcagcacaattgggttcctaacaatctcctcttcttaaaattcgacttgtttgcaagacgatggcaagtaaaattctgaaagtgccaaccgcctaggtcccatggcacttgtagctcttggcagatcaaaatgctcaagtcatccttatcattattgctcttccttataaagaaaattttcctctgcaacttagtatctttgcttcctccatagtgctcatatttccacaagcttaactaatttgcctctaactttcagctttccagacataattgcctaattggtgtagcaacaggacatagcaaacaattggtaacatttgatttgtaattttgtagaattgcttgtcaatttccaagaatgatttgatggttggaatgaaaacattcttccatgctgaaattatattcttgattgcacttggcttgatcccttgcattctccacttcttttagtataatttgaattccatccttgcagccccaagtatcttgaaaaatgttgatatccaagctgttcccaacactaacaggcctttgctcaatagtctcaaagtattgtgccatcatataggagatgaatggatgtttagctgactgcaacaagtcatttttcttatcatcacttggatcttgagttattaacaccaacaagacaatctctaattcatgcatcaccacatatgatttgcttgcccgccttcagctcaaacaatttaaattgaaacagagagcgataacaatgaccaagctccatgcaggttctttatggttggcatcataatccattcactaatgtactgcatatgaccccaacaaattaacatcttcatctttgtctcagtggaacacaccctccctaatcgaagttgttgccttatcttgtaaattgagaaccccagcagtacataaaatccaaagtgcctaatagggggaaacgtgcactacaagtacctcattgatgtgtgtgagggtgtcccgatctttcaatgagagggataagtcaattgggggagcgacgttggcgatccgactacaactatccagggatgttgcgccttagcaatcgttacaccaactccagaggcggtcgtgaatctcgacagatgcacgatcagcccaaccacgagggtatttgttcctgcaagcaatcgagaaccagcaagaacaagatgaacaagcaactcaatttgcgaatcaaagatattagattgaatcaacagaagtaacaagtagggttcagtaacaagcaatccggcgaagtagcgatgttatactttgatctaaacaaaacccgagtgttcttggcggcggccataggtataagaagaggggacgaacgaccacagggtcgtgctccaaccctaggacgtgcccctaataggcccaacttgatacacagcccattgggctaaaagaggtgacgcagcaccacggacagaaaacaatcgggagtaaaatacaattgcggccgctccagaatagatatggacatgtggttggatccatttgaaagtagatttgataagctttccataaagtacttgcatgcccaaatcgaagttcgcatgaagtcgtggcggccgtcagaagttggcgttgtcctacagtccgaatccaccccgcgcgaatcctctccccttcggatcctctccatcgttcctgagtaaaataagagtgcacgcatctccggggtataaagaagagaaacatgaactcaagaaagaactcacctaatagttgagttgacgtgcacgtgtgcggataataggaccatgaagttatacttgtggggtgtggatgtatcgatggtgttgatgtcctcatcactcatgggccaatatccaatattagcattttgcattcaacacaaagaatcttttcctggtagcaagctcatgcattctagaaattccaaagatggtgcaggtcacgtaactaaccaaatcctgttgttccttccaaacaaatagagtaatagccactctaatttcccaggacttgcattgctcaagtcgaatcggtggtggccatggtgacatcaaacctacacttgtccaaaaagaatcgagtacataccatggaatgtgccatacctcccctctctaaccacacaacctaaccagggaggtggccaagggtttctcttgggatgccccaccagcaacttgttgttacctttgaggcatttcatcaaacactcactgggcatcaacttgataaggtccatttcagcaatcaaccatagcgaggagacttcggatgatgcatcaggtactagaacacccttagaaacacccatcatggtctggcacgtaaccctggcgtggtctgcaccaccctttgacatcaaggccaaccgtcaaacagttggtgagcatcgccttggtactatcaaggatgttgatgttggtgccgccaatggtgccatcagtagataacaactccattgatgacacggtagaggtgacacaagtaaccacgatagccacagtgtgatcggacttggcatcgtagctggaacatatcatcgaagagttggtgggcgtgaccttggggaggtccatggtgacaaatgtaggtagcttggtgcttgtcctctctgtcttctagctctcaggcagctgttggagcaagtacctcaccaatgtgacttgaatttgccactacccaagtgatgttgttgttgaagcattcctgtcataggctctccagacctcccattatatttgagagatgaagtgaatgattcaagtcatcaaacaaacataatgaaacatccgacgcttcgagagaagaatattggagacattgctgggcctttagcctgccagtcaacttcagcctgagatgcctgtcaaaccactcgaaggcggcgaccagatgtgttacacatgcaggagacttgacaaaaatggctaaagatctacaacatctcaaatattcttaactcatactcatgtgaatctagttcccaggatatgcactagattcacactttcatcctaagcatgaaaatacatagcaaaatacacttaagacggaaatgatctaaatcacaactacttcatagttacataggccgaccggccaaataaatataagagaacagcggaagcttgactatccaatcctcaagcacaccgactaggggtttaccccatcaagttcaagtcttggaagaagcagtcgattacccgcatcactcaaacactaaatctaaaacctgcaagcaaaaggttaattcaacagcaagagtcagtacattattagaaataatgtactgacaagcaccaagacaagcctaacaccctacttgcaaggcatataatcaagaaaggcataatatggttctttttagcataaagcaagttttatttgcataaaacacattcaaatcagatttgatttcaaataaatttcagcaagctagtacttagcatatgggcatcaaagtaggcatttatcatgtataattattcacctaattgccatccatggcagcaaggagatcattctcaaatctcaacataatttgaaggtaaattcagcatttagaagaataaacacaagtctatactcaacacatatccacatgccgatcataaacgcgagcacggctaatcgattagtttttagactctacagagtttgtacagctttacccacatgatgtgaatcgctctagttcgtccggtacccgtcagtaccaccatactctacacattgagtacggtctagaggtcacaatgaggcttttacattaagtattgtctaaccttgcatgagcacgatacgtgttcctccatcctagaccatacttgatatatgatctagaaccgttaagtggcgggcccatgccttaaacttaacgccgtggtgacggatacaacgggaacccaccacgtggcacaatatcgttgtattggatagacttagacgcccatgccgtgaggcggaacagtacactcgtcccctcacggaaatcacacatgtatggaatttatcatcctacgatcacacgcttaggaacagtacactcgtcctaagattcaacacacacatgggtagttcctttaggtagcccacagtacactgatggcctctacctatactagaacggcctcccgaacgcaaggtcagacaagtgcttaacttaataggccaaggttccccataaaaacacatgtggatgtacggtaaatataatgaacagacattgagtgaaatccttagatcggtttaggcacactctccccctatcggtacacaactaattaccatatgtgcaccacttgaggcccaaacctaaaatccatgttttccatcattttatttgtcaaatacttcatttattcatccctgtccagaatcttaataaaatcatttttcatgttaatatgagcccaagtgataagtaaaaccattctaagcatggctaagcagtatagtcaactagtgacaatgtaactcatattccaagtagtattaggatatgattcctaaggttaggaatgaggatatggatatatgtggggttaaggagataatgaaaataataggagtttgtctaacaagtttaacaaaattttaatttattagtatacaattgacatgcaagatttgcaaacatttttaataaccaccaaaacataggttcaaagtgatcaaagagagggaggtgggacttgccttgcaactggaaaatgttagcacctaaatcacttcttcatcggttaagcaatcatctatacaaagtacacgttatgcaattaaatactgaaatatgcgaaaaatccaaaatgctctaaaatgcatgatttgtgaacagtggactggtattggtctaaaaagaatttaggtgaaataatttttattttatcactttttatttgggagttatgaattttagaagtttactcgatatagggtagtatttacctaggtagtgttataaaatatttttacaaagtgattcttattaactttgactccacagagatgtagggatgtgttttctaagactaacacatttggtttcacatttttttggagttacaatgattttcttatgaattttacaagttataacgtgttgtaggcatatagtgtcttgagagttttatgtccttgattgagttgagtaaaaggaataatttggttaactaatccaatttttagttcataagcttatggtcttattatcatggttcatatttttatagactaggggagctctagtctatgctagcagtatattatattaacctagaaattactatatgagctatgttcttctaagttttggtggatggggatggaactatggctccactggtcctaataaattttatttggatttatttggagcatatgtattgtataaccactattatgtgtttagtacctatactaccaaattaaggtttagagctatgatctgaacagagggtgccatatttcactctaataggttgaagtatattactttctagttttatagaatcttggttcactccatttggactaaatatgaattttctacaaattttacaaattgaaggctgcttaatgttggttattccttacttaaatatttagaggcttttattatacgataagtataaaattttattttataacttggaagtatatgttttggtgattctacagaatttgggtttactcaaaaaggatctaagatgaattttatacaaacctctaaagttcagcttatctaaaactagtaattttaaaggtaatagttttagaggcatttgatgtaaagtgtgtatatgttttatttcactttgtttttagagaacatgttggtggatctgtagaaactaagtttgctctaaaatgagttgaaatgaattctgtatgcattttatgagtttgtataaagcatgatttatcttagatgaattatagaggctaaatttgtactgtgagtgcaagtttttatttcataactttaaattttataatttggtgatcacagaaatttgaatcatctcaaaataagctatatttgattttatatggattttacaagttctaggtatctctcttgtatattctcagattttatctccagggggtccactgtcagtctcttaccgtcttgcaaagaagtccctatactttatgtgaacttcacttaggtccatgggtctacatgtcattggtttgtatgttttcatatttaaccctatgattgttcaaattttcaaaaaagtccctgccttcctctccagtcgggcagagacagggcaggccatggccgagctcgatctcaagcttgccagcggcaaacggtggctcgtttgtgggtgcgacctaaagacaaaatgaaggtcatgttattgcgattctattcctctactttcctcggttagtggacatcggagtaacgccggcggcgagtccgagcggaaaacgttttcgggtggtggtgcatgtcgtgctatagacttgatctacccaaagagatgcatgcatgtatgttttataggctgcaggattctcaccgagatgctagacaaggttggcgaagcttggtcgtccgtaatagctcgcgaacaggtccggcggcggcaaactccttcgggttgacggcgacagctcaaactactccaagatctagcgtgcatgtgtgtccatgaggttattgaggtcccagggatagtgtatacgcgaataatcggacaatggctcaccggagaagatggattcggcaaatggcgacggtgaccggtgttgaggaggacgacggccgatctccttcctcgatgcgccattcttcaggatttttgaggggaaatggagaggacgacgacgcgaagctggtggcgtggtggctcgctccggcttggtctaaatcgacggcaacggcgacgatgtcgctgcggcggcgcccggtgcacgcactggaacacccgtgggcacggcgacgtttccgtcaaagggtaaagtggtaggcatgaagtgaggaatacggaacgagaaagagttggtgatgacaatgtctcgacgacgggttgcggcgtccttcttcttggcggccggcaacgaagagatggaagaggagagctggagctctccctctcggtttcttcggcttagaggtggaaaatgatgtgtggaaatgcagctgggaggaggtgaagcctcggctcggtgctgccacgtcgacgccgtccagagtgcgctcggcttcggcttctctttctccctctcgttctctctggtcggttgggggtgttgcatagggttggagctagtcaagacactgtcaactgggcccagaacgaagtacactaggctggagtgtgggggatgggtagaaaactgtgtgaaagagatttttggacgaattttcagattattttctcttccctaacttgttaattcatagattaatttgtgttgcatatgagttcatgtggattttattggaggtagatgaatgtacctagtttccattttctttgattgtactcatagtttagattactcacaaaaattaggagaagatgggctctttagaaactagtttgaatttctagaagacctaaacagtgaggataaatcctggaaaaattatatttattcatgataaattacctagtatttgaataaattatttcactcatacacttttatacagtctaatgcatattttggtgagggtaggttttagccgattagaaattataattagtgtactatttgactggtttgactgatttattcgaggtatcaaaatttagttattaaattgcaccaaaaatatagtgagttgtatgtgttgagtagagcctacttgaatttttcccatgattttatcttgcacaagttattttagataattagcaagactaatctcttaaatgtgtttccctttcctaaatgcatgtaaatgtttataaaagttatattcggactcttcttaacctgaggtgatgttgatatgttagaattacagtttaccttacacatgtcataagcttcttatctatttatgtataagtttactttagtattaaattaagagaatgcttatagagacgattaagatagaatttaccctatatgagttaatttatttgttcactttcatgttcatgacttgtcttcagatgagtggaaaaattagttttgtgaggcttgacattggccttgttgatatattttaaggtgtattatggttcctatgtattttttttccattagttagcactaggttctaatggtttagttgtttgtctagattttagttattattcatgagacctattatgaaatgcaaatcgaaaatccaaatgcacatgaaggactcaagtcaaaacacgtcatatgcaagtatacatgcttacacttgtgtttgcatttttttcctaggttataaataaaaaagttttaatttgccctcaaattttatttagttgcatgagttagatcaacttcccctaggtttaaaatggaaatttttggttcacaaaattgaagaactttcctttcaactagttttgattgaaattccttaatcctagaattcgggtatgttacaattccgtcaaacacttgggggacactggaggagacgaggtcgggggtgttgaaaatgatgcagaattgaagtcagcggtggtcgccttgatggaggcactcatctccttgaagaacttgttcctattagcttatatctcgtccaacttctccaaaattcaatcaatcttctcttcacacgtacgcttggcctccatttgttcaaacttcttcaatatcagatctagagctttgtctagctatttccctctttgttcatgatggaattgatggggacgagttcagatatcctctaatcttccttggacatgtcaggctgactaggcattccatcgaataggttgtgggcgtaagtgtcatgggcaccacccttgcccaaatccaacaaccacttgcatggggtgttgctgcaatactcccccatcgactccatgctagaaatcccacgaaccaacagctctgataccaaattgttaacaacccttcgctccgattcaaacagcaaccatatatgtttcaacactttagtagttttggtgaaacaaagaaggagaaggggatatagattgctaacaaacaggtgggacgaggaggaggaagagaagaagatcgacgagggttgccaccgaccacccaagtcatcgccgccgtcgtcatgagcctcagctcgccaattgatcaaacctcccttttctggtgttgctcctgctgtttatatagtgctctccctttgcttgcttgggcctggctttaagagtggctgacagcccataggcagcccaattgggttcctaacaaatcttcaccaagaaattggggaccttctaggagttttcagtaggacttgttctagcattcattaatcaattaaatgtaagaaattcactaattaattaatcacgatttttgtttacatcaacaattgcataactaacttaaatgaacattacatatccgaataagcaacttgtactatatataaaatatccacaattccacgccacgttgaccatctcaatcaggacagagtatatacgtcaattgtacaagtttacaagacaactaggagatgcaaagcacgcaagacaggaggcagcttctggaaaggaaaacatccacgtgggtcggatatcatattgttaataacccttcgcttcgattcaaacaacaaccatatatgtttcaacactccagtattttggtgaaacaaaaaggaaaaaggggagacaagtcactagcaaataggtgggacgagaataggggtggacaagaaagctcgaaactcgtggctcggatcggctcgtagcaagctcagctcggatccattcgaaatcgtagtcttaatgagtcgagtcgagctagccttttagctcgtgagcttaacgaggtagctcgcgagctgctcgtttagctcgttagtataaaatatcaccatatcttaatgaacttagtgtttctttactagtgcttagtcttttagttacatcaaatctattcatatttagtgagtattatattagttagtgtttattattacgttaatacataataaaatgttaaatttgaaattattaatatgatattaatgagatatagctcattaacaagcctaacgagcttacgagccagctcgtgaaccgagccgagctagccttttagctcgctaacattaacgagcccggctcgttaacacaactaactcaactgagccaagccttaacaaaccgagttggctcgttaacacaatgagctcaaatgagccaagccacccctagacgagaaggagaaagagaagaagatcgacaagggttgctaccggtcacctaggtcgccgccaccgcctccgtgagcctcagcacgccaattgatcaaacatcccttttctggtgctgctcctgctgcttaatagtgctctccctttgcttgcttgggcctggctttgagagtagctgacagcccacaggccgttcaattgggttcctaacaaatcttcactaggaaagtggggggcacctaggagtttacagtaggacatgttctagcaatcattaatcaattacatgtaataaatgggaccacatatacatttgttgataaattttctcctaaaaatttaacagatgtaattatagtacaattatagtgtaattacactgtaacttgcatgtaactacagtgtaacttgtatgtaagtttcacgtaattttgaatcgttaaatctattactccctctattttataatataagtcattttagcattttccacatttatatttatattaatgaatctagacagagtttatacgtcaattgtacaactttacaagacaactaggagatgcaaagcacgcaagacaggaggcagctgctggaaaggaaaacatccacgtgggtcggtcttattaagccacgtgtaccgggaaaccgatcccgtgccgcgtcgacgggaacgtcgcgaacagcatggttccgacgagccctccggcgagcggcacgtcggtgagcacctgcctcgtgtcgtaggacatcaccgggtagaagcaggcgccgacgttgtgatcgaacatggcgacggacaggaagacgatcagggacagcacggcgtggaagaagtcgatgaacctgaggcggtaggtcgcggccacgtccggcggcggcggcgcggtgccgtcgatgacccacaggccggcgcgcgtggccaccacgtaccgcaccgtccctttcccgtcgtggaagctgtccgtgaagcagaggaagaagcacgccgcggcgcagagccccaccagccacgccgtcatgacgcggttaacgtcctggcacttgccgccgttggtgaacaccggggacagcacctcgaagacgagcaccgcgcccgtgggcaggtgcttggcgagctccgccgtgctccggaacgcccgcgtgatggtccgctccagccgcgttgtctcgtcgtcagagccgccatcgccgtcgccgcccgccagcagcagcagaggctccgtctctggctgcacgttgtggcggttggttatgccaactgaaacgggtacagccgagctagaagctggcggcgcggtggcagctgctgccgatgaaacgctggccgccggagatgacgtcgccggcttctgggactcgagatcaatttgcttgtttgatgccatggcagatcaattcgatcttgattgatggaagaatatgtgcctaattaaatggtaagggtggatttatggaaggctcactttgtggagtgcacgtacgaattgtttaaagcacaagtaagatgaagccggcaagaaagcttaattgtttaagacttatcactggcacaagataggtcatcagtaagcctcatagcctcatctgtatcgggatagcgtaccggcacgaataccaaaagtcactgttacgaaaaatcatatgtatcgagtcccttgccatcacggatgacagtcacggatgatataccatgaagatcatcataggcttatcgtcagatagttgtttgtgacaggaagcgatcaaaagatttacagattatatatggagatgagattttgaatcttcttgatatgtgcttatatatattctaactgcaacgactgaaacttttgggtttgtttttgtgctaatagcgggaatggaacgttaattagatggccaaccgtagtttttataattcgaatggtttgatcgtgtccaaccttggttaagcatagtctatatagacttgtagcttgactttggcaaaataaaatatggcctcgtacacagtactttaattttatccgtataaaattaaatgtggaagtagcttgatgaggcacataataatgttttacgatgttggcaagctgcaactatatattctaggattatcggggtattcacttgttctcagcttatgtcacaaagattactttttgaatgtatcctgaatacaggtctgaattttggtgatctaccgaaataatcctgtgagcgaagttgcgtagtaaggaaaatctcacattttatatggtctgagttatagaaaaccacatgtgtaaagacatatagcacaaaaccacatgttttaaatttatggtctaaatgattcacaaaaccccacgtttattaaaatctagattaatttcagcatatgttaaacaatattttaaagtagtgaagatttaaattatcagtccaagtcaagaacttaataattacaaaattcgtataaactctacgaattagaattttaaataaattcgtgctcaaatgcataaggatggggttggtgaaactttagaaccataatgcacgggataaagtgtcgcacgtcttcaacttttacctaaaaacatggggtttttgaattttactaaaaaaaagtgttagaaacaaagattgttgcaatggatgatgagaaactagggtccagatcttctgttatgtggaagtaattctcgatgtggcgaaaacttgacacatacgatttgatttccgatcaacatggtttgaaccccgtaatggcggcaccacgtctcttcaggttattaaccgtgcaattcccggttaatctcatcgcgaaggttaatccctgcatatgaatcgaagaacactagcgggaataatgtaaattgcaactgaatatgtgaatgataaggatatcaaagttggggttttataaactgaactaactagtagtgaaactgcaatgatagaaataatctaagtaaaacctaactctaaactatgatggctactggatatgtatacatacatacatacatatatacatacatacagaagttaaattgcaccggttctaatggttgggggtcgagatatttggtattgtggttgaggaatacaaattagatttgacgactaattaagggagtcgaagtgaacttattatgtgttctccacaccggacgatcgtatagttaagcccacaaacaaaataaaaatgctggaagcacattagtggtactaacggccgaatacttggggcaagtctgttaaccagcccagcactatatcagcaaatcaagacatggattggcacaaaatgatatctcattcaaagcccataaaagtcacttcaccaagccgattaacggttgcaaaattttagccaaaaaagggaaaatcatccatggaaaaataatacttgatacctcctttgatcaagaaagcatctacacagccacgttttgcaagcatgattaattttcggcaaaatttgttacaagatatacaaaaatggtgtaattagccaggggacactgtaagaacacgtatttgccgtaagacattgcaaaaaatggtaattagctaatagacactcgcaccattattttattattttcggaagaataggttagagaaacaaccattaaggacaagtttgcacttggctcaaatgaatccaacgtgggccccacatttaagcccctctccctctctttccatatgggagggcggaccagcgagacaaggccccttcggccggctgaaggtaggcggtggtggtggcatagccgtcggtggtgaccacgacaaaactctcataggtgccggtttttaatttgtcggcacatattaggttttttatagtgtttattgatatgaaaaaaaacgaagaggaagaaaacacgaaatactattggtccaattattaacagtgagatgaaaaagatgtatttgtattaaagaggtctactcgacaaattcttttggataaaactacgtgtttagggacggcgggagtaccttttatgccatatatatactagcatcaaataaataatgtcgcttaattgttacattgtcaataattaagaagtgtgatcctcctgttggaagcttgggataaccggtcaaagtggtccaccgagagcggacactgatggcccggtcttcgaaccatgcgtgcatcagtacgctgttgcctatctcgtcgcgactagcgacgttcttcccgcagcacatacagcacatacagagatgcggaccaggactgtaaatatatacaatgcaaatatgcaatagttttctggctggtcccatctcttactcaaaaacatatattcatccaacgctgatgcaatgccaatccggaattgctatacatatgacgccatatttctttcccgtttacagtcaattttttcactgtgcaattagttcagagattcgtgcatgtcgagactctaatgccatcgtaactactactattgctgatactatctcaaatctctaatcattacggagtaaaaaacaagattccatgcacagatggcatgcaaaaggacaagaaaaggagaagcgaagatagggagctcaccgtcaatgtctgtttttaattacactgcagttacagatataattacagtataattgtactatagttacatgtgtaattcctatgtaactatagtagttacacctctcttatataccacttacatatgtaattagtatgtaattttgggatttacatatgtaattttagttcttacatatgtaattttggggcttacattgtaaatacactaaaattatatatgtaatttagggacttacaatgtaaatacatgccgactattttttgataaaaaatatgacgccataaatatagctactccctgccaatctggcacgcatgtcgcaagcagtctctgccatcattctaaacgaactactaccatcaactcggtatcagaatataaaattttacgagcttaactcggtttttgaaaatagatataattaaatgagaaaaatttgtgattggataaaaaagagttaggtagatggagtgggaagagaattggtggacaaattattatattttggcaaaattggttacaggacacttaaaaaaacgtgtaattagccgtgagacaccacaaaaacatgaatcggctgtagaacattgcaaaaagtggtaattagctattagacaccggacatattattttattatttttagtggaaacggagagagaaacaatcgaaaaaagccagattgccctatgtaggccaaggatgtcagcccctctaatttcttgtcctcttcgtcccgacgatcctttacaacgaccggcgcggcgcgtagagcagtgcgtctgggtcaagctcgctcgccgtgttgaacatggcggcacgcgcgtccttgccgagcttgtcttggtagaaggagccgtgcagcatctcgttgttgacatcgtagtgccggaacttgccttgtaccgggtgagcaggacgttgatgcggctgctcacggcggcgaagagctcgtcggcgggaagcgccttcacccactgctgcactgcgttgtccacctcacagaagatgcagtggccgcgcacgcagatgccgtgttcagagcagagcgggaagctgttcgacatcagccgcagccgcacctccacgcgtcggccgccttcaccttcaccaccacatcgcgcttgcgcacctggatgacgtacagcatcacgcgcgacgccggcttggactcgacgcggaacgacccgccgatctcgtaccaccgctcgtccagcgccaggacctgcccgccattgagccactggctgtcgacggcgacggcgacgttgatgttctgcggcttgcggtggcggtggacttgccggtgcttcccgatgacgcggaggagtgcgtcggcgtggcggagcgcgctctgctcgcggtgggtgcgtcgccgccgctgccgccaacgtcgcaggtgggagcgaacggtacgacggcagcatgcgacgtgccattctgctactgccaggtgaggctgaggcagccggcatgcgcggcgctggcggggagggcgatgaggaggctggagagggagtgctcgcggccaggggtatttcagtacttttaaaactctttctctttccgtttctactaaaaataataaaataatgtctcgagtgtcctatagctaattatcactcttttgcaatatcctacagctaattcacgtttttacagagtcccacagctaattacactttctttagtgtccggttgcaaattttgccttatattttagaacaaattaaaaaactaaaactattatattttgagaaggagaagtaattatattagccggctaaacaagcgccagctagtctagactggccttctcacacatcggtaagttttgctactggtctccactacgtcctataaaaaaataaatctagtattagatgtaacacattttaggactacggatctggactaagatatgtccagattcgttttactataatatgtaatatttagttatatatttgtttttttggcacggaagaagtattatggatgcagaacctcgtaagtactgttgatacagtagtgtctaacatgtgagtccgaacctacatatcaaacatctcctgctaactatcaggactgcagacatttactttaacctctgatcttttatatctttcatatttccatatctactactttcccatttaaaaatacaagcatttttattttttagcaaaatattagggttaatgaaaatattccatgtaagtcctatcggtgatcaaattttgaattttgaattgtttagattcctctttctagcacctgattaattggctaaagttgtatggactttcttgtattggattgggtgtcctagaaatgcttatattgttgaaacgaagatactacatattttaagtcctataaatgcttaattcctacaaatgttcatattttaaacgaaagatattttgtagtaaaatatttttctataaagtaaaatacctaagtcaactttcgtgatcatctttattaagtgattagcaatcattattttcttgcttgcatgtctgttcaaattttgtgagaagacatgagttatgtttactatagtaattatatcttgttactatgattcagtagtaatattatcgtagaagtgcagtagcacgatacattactgtgaaatttataggtgttactgcacgtttttagtaacatcatgattaaattaacatatggtagtaacgctactagtataatactactgcttgtgcatagctaaatttttaaatctaaatcttgtgcaaaatacagtgctaaaaagtgcatgtgcatgatcacaagttgacacaagtgctaaaaatacttctctttattcatataaagatacatactagcaagccaattacaagtgaacttttagaattctaatctttaaataacaatatctctcacacctaatcggatcaccaacatcgctgcatccaatcgacttatcctctcatcgaaggatcgggataccctcgctcatatcaagtggagattgggaaagacggtggtggcatggaggggaggctgatgatggcggcagcctagaaaggacacggaccagagccacggcggcgacacaagggtgaggtacgcaatgccgacgctggcacggaggtggaggatgggggcgggggcggcgtgaaggggaggccgaagagggtgagtggacagggcctcgattgaggtgtccaaaacataaggatgatacgatggcctagatcgaagctaatcggacggctacgaacagttgtgtcactgttttactgtagcaacgggaggaggccacgtagcaactggaaaaataataggttttatatgatatttttatccagatatcttccaagatagaaatgttttatctctttgcaatcataaattgcatccattttttgtgaagaacaaatcaaagttcaaaacattactatgaaattgtacacttaatcattattttactattgccactttgcttaaaacgttctaagctagacatcataaaaaaatatccatggttcaaacccttacaaaataaaatcaatttgcatgctttgacaaaatataaaaagtactttggactatccaaaacaacgtgttcatttctttacaaaagggaggagtgacaggagtcatccatcactaacatactttgatagtagaagtcatcaattcacattttgttgctgctaaagggtgaaagtgtatctaggcctccaacttattgtggtaattaataaatgctggttagagaggactaatctggtttgttgagtttgtattagataattagtcctcgttattgatgaaatgaatggttcccagtagatccaagaaaaccgtttcctttgctattgcttttgagtcatatgaaaatctctactataaggccttattcggttaatctccgtaagagagggattagagagaatttattccacatatattatggtgttaaattatttccccttaatcttcttcaaaccgaacaagggctaaagggatgccatttttgaaacttaaggttggaagttggtgctcaaaacttttgcaaagtattttttattctctgtgatttctgaaaaaaaaaactaattgggaatttggacggtcgcatcggaatatctgaccgatcagaaaatccgatttgagcaaacttctgatccttgatttggtttgagaaacttattggaaattctgatcatgtcaccggaaattccatttcgtcgggaaatcagaaattttgaaagttctgagtcacggtttgattttgaagaaaatattggatattccgatcgtcagacggaaattccagtagtactggaatatcccaaattctgtttttaactcagtctgtgcaggcaaaaactatctgaatatcctatacgacatcctatacaatttgagtttggagtaattaactcaggtgaatcaatctcaagatgctgtccaggactgcagggtctccactcaggacattcacagtgcgtcactcgcatatgaggaacctcgttgtaccacgtattctagaactacaagtccaaaatccaaattcttcaaagtacaagtagctctactagtaaccttaattttatattgcagcccctagtactttttctttcagttcacatattttcgttaatttgtgtggaggtccaaaatttgcaatcaacacccttgaatccaacaaagaatataatatccccctttcgccctctctcccttatcctcacgcccacttcctcttcccctcacgccggtgcacccgccgcccgggcagcgcctcgatctcctcccctggctggtgccctggctagcgcccccggctggcgcctctcctcccctttctcggccgacacccctgggcggtgcctctcctccccactgccagccctcactccccacatcagcggcggcggaggaccccgaggcgagtctcggcgacggcgtctgtgtagtggcctcgcacggccatgcggatcgagcctagcgcggctagtaagctctcagcagcgtggatctaggccggcctcactagcgggcgcggctgactaccccaaccggcggtagtcctcgcggagccaggcggagcagcggcagcgctgtttggagtgacaactcgccgaatctccctttctctctgagttcgccggcgccaaatcgatcttcaccaccgccgacgctttccccattgagcctgtgagcttctccggcgaggacggcgtccggtcgccctcctccctgggcaacgcagcagtgtggagtatggggatgacgacacatccctctcatcttctctctttctcccttgctgcacggctcgctagtgtgggccacttatgcaaaaactgacgacgaaccggtggcaaacttgggctacgcggtcttggcaaagctccgctggtggaggaggtggcaccgaatattctgttcggcgtactcaggctaaatgccacatgggagcattgtgaatggcctcatgaaaccagaccttgaaagccacaagcccacaacaccctgcccctcaatgcacttcattcaccgcacccacgttttcaccaaaacacctgactagatcactgacaccctgcagggttcacgctctgtacgatggatcgaccactgtaaaaatcaatctgccaaacagcgatccggccagccacactggtggagaaacttttttactcccggttggtacccttgtagtcctgggtttccaaccgggagtagtaatccgggactaaagatggacatctttaatcccggttgaaatagccgagactaaagatccatctttagttcagattggtaacaacaaccgggttggttgttgttatcaaccgagactgaacaggagtagtgggcagtccagatgatccccttttcttttttttcttttttattttctcccgaatcgagtggcatgcacatccccaaatcaaaccccaaatccccaaatcaaaataacatcccaactccacatcacaaattttaaagttacttatactcacaaatcaaatacatcacaaatcctaaaaaaagtacaaagcaaatcaaatacatcacagattatacatctcagatccatacaaatgtccaatgaattacaaaattatacatcttaataatcacagattatatataaaaaaaaaagctggctgcctcctcccgccgctcgtcgccgcgaggcgcggccccgctagccgccgccgtgggccccccttcccccccctcccgcggccacaggccgcctgctcggcgccgcccacctgcccgccgctggatgggagggaaggagggggagtagaggggaggaggaggcttggatcggatgtgaggaaattggagagggacgatcttatctctaaatagctggatgggagggaaggagggggagtagaggggaggaggaggaaggggagaaaggagaggaggagaggggaggggatgaggaggcttagatcggatctgagggaattggagagggacgatcttatctctaaatatttagtctggaacttaaccgatcagagatgggagtaaatatatttactctaaccgggactaaagatagatttttagtcccggtttgtagtaccaatcgggaataaagatctaaataaactttacttccggttgttactaccaaccgggactaaagtgataatctttagtcccggttgatactaccaaccgggactaaagatcctcagccccctgacatggctctgacagagcataaaccgggactaaaatgatctttagttaccgggactaaagatcaaaatttttataaccgggactaaaaacaatttttagttccggtttttattagaaccgagactattgtagaaatcagccgaccgagcaaaagatcatttctccagtagtgccagaccagacgtttaacccttcatccgtttcacagccacgctcacgtatcagctaccccggatgactggtgatgaaattggtggtgcgcagcgaagcaaaaacgtccagaatccagagggatttagggtggattcaggtgtgggctccgatatcaccatcagccaagcgcaccgggaggggtcctcccctacccggcggcagcatgattgcgcagggcgaagtggccggcagggcagggcaggaggtgtgatggggcgttgatggatatgacctccccctcccgggggtcacgtcgttgcagcgatgcgacgggctcccgtcgccccttttggtttgggtttatttgtgtagcggtaaagcgtatttgcgttttttgcaatgccctcttgaattggtttcatctcttgttattaacagttcatcattaagtctagctgtcgtacagccgtagtagctttgctagaataggcctgactgatcagagtgttttgttcaattgttgcaatcatgggtggcggacgcacctgctcatgaaaatactatgttttaggggataagaataatgacataggagttatctgaaatactacatgatcccccccctctccccacccacacacacccttttttttaaccaggaaacaaacgttattttgtttttgaaagaaactgttggtcagtagcgacccgactcaaatagtgtcaagcataaaaatgtaatgtttaaataaaaaaatgagacatgttataatctatatggtgttatcattccacttttcttctcgttttcatcaaacaaaattttagtatattttctttctttggtaaaattactatttgataactagtcaacatctcgtatgttggtgccaaaagtataaatattaaaattttaatcatataccaaatacatcggttatatttagaatcatagtgacttaccctctatctcaaaaaaccttacgtttatatacatttcctattaattgcagttaactgatatccaagacaatatcagtcgattgcctcattcgtcggattattgtcatccgatggtccatgacatgtcttctgcctccagctgaatcaacttttatatctcattaactatgtgctgtcgatcaatcacccaaccactagagacgatgttaattgaagagggggagaaaaccgatgacttcctcgacgagccatatgccgccgacgcccacaccttcagcaagcttacttcatattaggccgagtttacataaaaactttttctttaaacttctaacttttctatcacattaatactttcctacacacacaaactttcaactttttcatcacatcgttccaattttaaccaaactttcaattttaccgtgaagtaaacacacccttagagttttggaattggaattggagatgcacaatttttattatggtgtccaatccaatctaaattctttgaaataaaggttcaaggatgattttactctacatatgtttagagtaaaagaagtagaaagacctatttggaaatcatgaataaacacaatgatgtagtagcattgtaaattatttccctttttctctttatatatatatatagagagagatagcagaactattctacaaccggggttctataccccctccctcccaaaagccaaacccaccacccatccctccttcccaaggtctaaaatccacctcccatatcagttaaagggtggtcaaaagcctcctcgcgctaatcagacctcggtcaatgcgcctactaacttcccccaccatgcatctcttctcagctctcgtcgtgcatgaacggtgcagtaacatgatggccattgtgcactaacactatgttttatatatagtaacaacgctaaaaaatagttaatatatagttatgacggatctacttttaataagtatttttttctagcatcatggtacaaacgtttttttaaaaaaatagtacaacacgtgagagattttattcttcaaagattcacttcattggaattcgactctccacaagcggtaataccatagcatagcattattatttctattgtctgttatgtattactgcaatcccatcacgacattactgcaatagtgcagtaaggactaagtttcaagtaacacaacatgttactgctatttcttgataatgttaccgtaagaacatatgttaacaaccaacactactacgtaaagcatttttccgtgtggtcaaaatgatttttccttgcggaggatttgtccgtctgcacccaaatgtctggaaaaatcaatttttttgcttacgggtggcccaaccgcatgggataatcattttcccgtgcggtccacttatcctgtgcggtcaaattataccgcccacatggaacaaaagaaaaccaaaaataaaaaaaaaacgaaaattgtgggcctgcacgcaaccggccaccgcaactcgtcggatctgggcggggcccgttcgtcgccgcctcgccggtcgctgcctcgccacgcccgcctggtcaccgttgtcgctgttgtgcccgtccgctgcgacagcgaaggtgaaggtggcgctgttgggccgctgcggggagtccgggcggcagagccagtggatgatggaggcggcctcgcggacgcggcggcgcaaaaggaggtgccctaggagcggcgcggcgaggggcagcggcaaggtgcggagtaggtggtggcggatggtggtgaggaggcggccggcggcggggacgttccccgcagagacaacgacgacggccgctgcctcgacgacgtccgccgccttgacgacgacaatgtccgctgccttgacgacgcccgcttgccgccttgacaacgcacgcaacgatagcgtcgtcgtcgatggagccgagcgacgacgtgcgcgacaaggacgacgaccaggaggaggtctcgccgccgccttcctgttcggcatctcatccggtcaccgcctcatccggtcaccgccgcgcccggccgccgccatcgtcggcccgatagaggggaaggggaggagttaaggtggggaaaggtgtggggatgccaggtgtgtggttgggaaaggagaataaaaggaagagataaagtagagagagagatgggagtggttgagggagaaaaacggaaaaaaggaagagagaggatgtgaaaattttgaagtgggttggagggaaaggagggaggtattttcctgtgtgtaccacttaaaaagcccacacacaaaaattgatttttccgtgcggtcctcttaagtcccgtgcggtcggattaggacgtctgtacgggaaaatcgattttcccgtgtgggcgaaagcctagcgcctgtccccttattgtcccatgcggttccacttacagaccgcatggaaacaaaagggggcggcgtccagaaaaatctatcctgtagtagtgcgaaccaccttgcttaatactagtcaaaacgaatccatcgtatccaatcttggtcaaatccctaagtggacgcaacattcgtttcgtgaaaattgtgcagtaacactagtgcttgaacatatgcattttgtagtaaccaagcgagttacgacagttccctgaaagcgttactgctaaaaggaagggggagtatgtagatggagggaggaggctggttttcttgaggggagggaggataattttctgggaagagagagatatatcgggaaaagatagagcagagggatcatgaggggcaaagagagattgggattatattttggtactacagtataattttgttactatatttatttcacgatgttaatataggtttggaataacacatagtacaactggtagtaacatgtgagagtaaatactataatttaggaatggtagttgtatggacaaaaaatcaatagtgtggcggtggcttctactcatgagaattaaatgatgatgtgtcttatgttactctagtaatctataattcacatggtgatgttgctgtagcagtgcattaatatttttgcgatagtgcaacaagacggtttcaagtgtacaataacaaccattacagtatcattactacatgtgccaatactatacggattagcacatgttagaagataaaattttactaaaaaaaaaattcatcacaagaaacatagtctactggttaatgatttgtggtgattaagttttttttgaccgggaactatcagagctttgcctagtagtgtattttcattaaaaagaataaagtatgtacaagttgtggtgattaagttgaagatcttacgttcatttccgattgaatgcaattttaatttatccaatagaaaacgaggacagagagaggaatcgagacttctctctcctcaaaagaagagaggcgtgagactgagtacggatcgggagggaagaagggagcgcgatagagagttacgtgaccacgactactacggatataaccgttgctcacatcatgtatgaacaagatgatatcaagatcaagtattccaagtgcgggaaaccgattcggccacctcctacactgctgactttaaatggctgtcgaatctgcatacaatctccgcttttgacccgagagtacttgatggaaagctctcagagtcctctttgcaacgcatccagcctcatcgccaaattccatcctagtcatctgcagatgaagaaacaatgtgctacgtcacctgtcatgggcctttgggcttgtaactttgtttgagacccggcccaagtggggcccatgtggggtgcatcccaaccaggggagcatgaccttaggcacccccaggtcctccttccctctcttgggccgaatccggcccatttccctccccctctctctcctctccctgcggcccactcggcctctccccgcgcgcgcgccactgacgggcgggcccgcccgccaccctcgctgacgggtggggcccacccatcatccccttcctcccgccgctccgcccgcgcctagcgccgccgccgccgccaaatccgccacgctccgccgctcccgttcaaaattgaatggggaaatatttcccccgattccctctccctttccccacattttcctctctctctctctctctatttcagatggaaaccccccctaatcccgccggcgccattaatggcggccggatctcccgcaccggtttccttccccgccggccgccctctctcactcccaaccctatataaaccctccccgcacctcccttgtctgtttccgccactcgccgccctttctccccgccggaatcgagctcgcaccgtcgccgttgacctccggccggccctatctgctcgccgggaccatcgcccgcctcggcgtcgtctcctccggcttcgccgcaccactgccgaccccgtccaccgccttgccgagctcgccgaccgccggaacgccaccgtccccgtcaacccgagccgcgccaccgcctccctccactctggccgcctcctccgtcgccgccgtcaacccggggtgagccgttgaccgccgcctctttcccccttcccttcccctctcttggccgccgcttcgccgtgcctatggccgctgccggcgaccataggggcatgggcgctgcctcccgccggccgcgccgacgtggccgcctccgagcgcgccgtgtggccgcctcgtggggcccggccgtcagccgcccatgctctcaggtgcggctgacgcgtggggcccacggcgccggctggtgagctgcgggtgctcccggtccaccgtggaccgagaggctgccgcgtggggcccaccacccctgtggacccggccgcgcgccccctcccctcggctgacgcaataaaccctatttttaattaaaatttaaatgaagaaattcacaaatattcacttaaagagcatataaacttcaaatggccataacttggccgtttgaactcgaaattggaccgttcaagtctctaatttttccttatgaagtcaagaacccatttttgtactttgtttcttcttgttatatggagtttattagagtaaaatcctttttcttttcattggtcgtgtagacgctgcagcttcggaagatccgctctacgtggaggttgaagccgacgttggggaaagcgagcaaggcaagtcacatcatccttgaacatattgaatcctaggttataaaattattttggtttaaattactgcattatcgctttatttaaattcccgcgttatcactgttttgtttagccatgcctatttatctttgttatgaccttattattattattgtcattgttattattaccttgttcacccttggacaaataaaaccccaactagtgggtactctattcatggttccactagtatgaacttaggtagatgcttcgcggattaattaggcaacattaggtggttttataaccttagactttgggaatgctcatatcatttggacactatagaatggttggactatgtggaaatggacacacaccttcccctctgttcaaaacccccaaaatggttttcgattgggctcgaggtgcgtggttttgatagaagcacctcggccactataaggaccggtcttcgggcctctgttgcaaagcactaccgtactttcacatgtctactgggtaaggcttagtttgtggcttagtctggttataaacaaaggtacacggatggagatggacgaagtcggggcttgatggacatctctaggacaaataaaggctacacgagctgcgcccggtagtcgagatgtcatggcacagggccggtgtcctgctgctaggggctcaatcctgcctacctgtcccgggggttccggccgtaggcggggttgggtcggtactcttgtttatggctaggatgggttgggaactatgtcacgtctttcgtccgtatgccgtggtggtatgtggcacgtggttacacgtgaggaagatgtgtcttgtgggtaaagatgtacacctctgatcagagtataatctattcgaatagtcgcgccctcggttatgggcaagcctagcaatgtacccaagttagtgttttaaattcttaaaacctgcttaacaactaaaatgtggaatggttggcctgggttggcttgggacgagctgggacctgggtttggttgccagttcggtctgaatcatcgtaggccttgggttaaggcaggttcgtgtaggttcacggccttgtttaataacattgtgtagctctaggatcgtgtttacaaaatggccctgagcaactaaaagtctttttaatgctgtttactgcaaaccctaacccctttattataactcccttgtactcctttgcatttattctgcattcgtgggtgtgtcttgttgagtacggtggttgtactcaatcttgctcaatttttccccaaacccagaagaggagttcctggaagatgaaggctttggtgtctagctcgtgcctgccgtcaagtgcccgtagtcgtcgccctagtcttctactgttttccgtttatctttgtgtgtgctgggccttcgtcgcccatgtaataaattaactatttacgcttccgcttgttaaactctgaattgtatcaacttttagtgtaccttgcctcctgggacaaggaataataaacgcacgtaaggaatgcccgttgggttaattccggtcgtgacatgattctagggttttgtttgattaaagtttaaccattgctacttgcctgcagcgggcgtgtcagctagacttcccgtctgcttgttcttcgaaaccccaacttatcatttgtattcaattcctatttgcaattcagattgcttttatcttttttgcttgtttttttgatttgcttgtaggaataaggttgatctgcaccggcaagatcaataacccacagagaggtgtatcgatcgcaaaggcacaacacaatgtctcgtacggttgtaatcgggtcatcaatgtttctcccaaatcgtatttatcatcaactcaccgaaagatcgggccaacaacagccttgggtgtctcgagtggagctcagggttcatcaagtggtatcagagctttcgttgctcggtatgtttttatctacatattaccagaaaatagccacaaaaaaatattgcatccattacctagccatctttgtgccactgcattgttcttttcagtttttgctttgttgagttttctgttgcattgtcgcgtcaagttgctggacttagcgtagtacgtttaggctttcgagttcttgtcatgtctattaccactgtcgtcgtcgtcgccctgtctttgttgtcgtcgggacctatgaaaacaaaatcatctttccgccagggttctatttttctagttttcaaaagtttatgtcggttagttttagagttgttgagttgcacctagggtttgtagatcctgccgtgtgtttgtttttgccgtgcatgtgtacgctagaagaaggaagggggagagatttttgtagattggattcggcttccataagtgaggacgaaggaaggtgaaagtcatttctttgattggatttggtttccacttgtgggggcccaggccgaaccttccactctgtcgactccctccctcccagccgacaactcccctacctcccactgtacctccacctcccaaccggttgtgccgagttgcaccttggtgaaattttttggagtgtcagattgaagatccgtttgcaaaaatggaacttatgcaatgagagcattacatttttgtatagttctaattttgggtttggacttttgcatttgagtccctataatttttgtatttacatttgagtccctgtaatcttgcattcaggtccttgagtcatttttgctaaaaaaagtgagaaaaagcagaaaggtgcttacaaaattgaaaaaaaaattccgcaccaaaaagaaaagaaaaaaaaaggaagaagaaaagaaagaagaaaaagaaataaagaaaaaatagaaaataagttgttatctttgagccgaatttgatatatcagagttgtgcttgaattatttctagtgctatcttgtggtaccgttcgtgtctaggctcgcgtctctagtccgttctagcctaggaccagcacggtactgactttgaacgattattcaactttgtattctctaatttgagcatctgttattcctttgctacatatttaagcctaccaagagctccacagatttgattgcagccgcacagcaagtgtttgccaaggcatcgatacatccaacctccattagggtgcttggttgagtcggtgtacgtcaccattccgctagctttggtaagaacttgtaagagcttggtaaaatgcttaagtgtgtgtgatattggagcttccactacctagtagttgataggagtgtgcatattcttgtgtatgtttcttgtttgctactaaccatattgattgggagctagcagtagacaatgaatttgacaaatatgatttttctaatgctcaaatgattaaggccgctagtaataagttcacctcttctacattatattggtggagttatgtgagtaacaaacctgaaaattgggatgaatgctaaaacatgatgagaaagtgttttgtgagtttatattacaaatgtactcttcatgataaactagaacatctgaaacaatgtgatagaactgttagagagtacatccatgaatctaaagtttgtatcatctacagtgatctaaaagagtgagatgaaaacataatgcgcagatttttcaaggggcttaattctgaagttcaggttatgcttactaatgtgacataatcatattgaacacctattcattcttgtttgtagcattgagagtcagatcatatcaaatgcgagtaagcatgaacaatgtgatttatctgctatttctgaatctcctatatccttatgcaaagatgatgtgcaaacattggaggaaaaatcttttgtctcccctgttactaacgttttgcagggagttcagcacattcaacaaaaggaggagaatggtgtacttgagaagaaagatgatgaagcacctgcgatatctaaagaaagtttgcaaggtaaattaaatggtgctgagataaatgaaggtgagtattctcaagctgagctacacaagtccacttttcatgctatagtagagcaaccattagtggaaccatttgctgagatgtctttgtcacaagttgatttacttgttgtttcttgtgataaagaagagttgtgtgataatgcttcacttatatccatgccacaactagtgaatgaacatgctattcctactgttaattcttattgcgctgattttaagcatgttgttcacattgctgatgaagtagaggaacgtgaattgacatcttctttaaatactttgagctatgtttagtttgatgattcttgtaagctcgataatttgaaggagaaattacttgctaaatctgatttcccatgtccaactaaagctattttttatatctttggcgaatatgatcatagaggattatatttggtgcatagaatttttatctgttcggatttagggagacatgttattgctaatcacactacttcgagtttctctagttttgatcggatgaaataggttgttttgtatggactatgtgaagagcaccatatggaaaaaccgaggatggttttccatgaagaaggggaggatgatgtgaccaaggctactacggataacatcatggatgaacaagatgatatcaagatcaagtactccaagtgctgaaatccgattcggccacctcctacactgttgacttcaaacggccgcaaataaagaaacaaggtgttgtgtcacctgcaacagatgaagcctcattgccaaattccatctcaatcatccgcagatgaagaaataaggtgttacgtcacctgtcatgggcctttgggcttgtaattttgtttggttcctcggcccaagtgggacccatatcaggtgtgccccaactagggggggcacgaccctaggcacccctaggttgtcctcccacctccataaatagctaggtaccccttaagggattcttgggttttgttagattaaagtttagccattgctacttgcttgcagcgcgcgtgtcggctagaccgcccgtctgcttgttctttggaaccccaacttattatttgtattcaattcctatttgcaattcatattgcttttaccttgttcttgcttgtttcttcgatttgcttgcaggaataaggttgatctgcaccggcaagatcaacaacctacggagaggtgtatcgatcacaaaggcgcatcacaacatctcgtacgtttatagtcgagtcatcaacgtttctcccaaatcgtagttatcattaactcaccgaaagatcggaccaacaacagccttgagtgtctccagtggagctcagggttcatcaaagagtggatcgagaggggattgagggcatgaaagagcgcgaggagagagtagagagaagaggaggaggaggataggcgcacatgaggggatgggagggaggagtgatggtgggacagaggtaaacaatagttattctaggggtcggcgtatagtcttgtccttaaaatatatatatactagcaaaaatacatatgtgttgcgacaggtggagataattttcacaattgataaaaattctaccaatttaaacggcaaactaaaacaagacaaacaaaacaatggtaaaacaaagtcagaaatcatactccctctatccaaaaatctaagacctatttctttttgcaccaagaccaaaaagcaattaattcattcaccatgtgataaaaccaatggacatgcaaccaataagtactaaaatgacttcttggattctgataaacaatttaatttagcacataatggcggttgtcgatttctaggaacagcaataaaatttatctggtggggaaaatcaaggagagatggtgacacagatgtttatactggtttaggccctcgatgtgagctaataccctagtccaattatatgtggattggatctatgtccggtatgaagtggagaatgcgtatgccgggttgtgatgaccggcttgccccagatctcgtgacccctaccccctcttatataggatgaggaggagggtttacaaggaaagtatctagctgattacaactagatctccctattctatctataaaagataggtatatttccaggatttatatcttatcccaagaatatctctttctttatttaaaggatagccgcatgggcctagggctcttggcccaccctatgccacatggcccaaaggcctctccttgggtacccaggtaccgtgtaactcatagtgactagctacaaataggacttagacttttcgaaaaaccaaagaatagaataagtctcagacttttggatggagagagtatatagtattgaacccggttgcgctcgcttcatacgtcatcacacgaagaatcccttatgtacacatttccatagcctcacaaatctattgggtgaatattccataagttgatgcatgtctattctgctatacgtcatttattaaagattgaagttttgattattcaagtagtgaaagtttttttttacttgtagatgaaaagcatttgcaaaataacaaacttgcgacatacacaccttaatggtaatttcaatagaaaaatatttgtgagtagagaaatttgaaacagaaaaaaaagagaaaaggaggaaaaagggaggagattggaaacggaaggagaggtcaggatgatcgggagaagagaaaaggagaaataggggaaaaaagagagaaaaagacactgattaggggaggggcgtgtggcgctgagtggaggcacgctggatggggcggtgggatggtgtgggctggctggttgggtgcactaggagagggagagggagagggaggcgttgggctaggaagggggtgtataatagttgttctagagtcacgtcgaaatggataccgtgatatagaaccaactcaaacacggatgacgtatcaaaattttggtagaaacatctataatttttataatgctagtagagatatatattaaaataattggggtaccatggggtcccggacctagcaatcaaattgagaatatacccaatcggactgaatctgaatttctttaaaaattactaacatgtttgaacaagtttgaattgaatttggatattttgttagattttgattctaggtatgtactatcaaaacatataattagttagatatgtataaatagattgtgaatttgagtaggaatcaaattcttatatataggtatatactccaaagtattttttaaaaaaaatcagatgtttgagtcaatttaagtattgcataccttggtgcctaggcaccatattgccccatctatatagagagcacagtaagagtgtctcctattgtttattgtaaaaaaaaggtggtacgaggggtaggggtggtgaggtgtggttttagagggatgtctagggtggtggaagaagggcggggtgctgatgatgatagcacggaaaccatggggatgggggtgggcggtgagccagtggcaaaggcggggttgcctcgccgctacttagagcaaggaggagtaaggggagtgagaagggagatcctagttggttgggtagggcttgccagcaacgttggcgactttcttgcaccggcgagccagggaggggggcgccccactgacggtagggagatgatggcacggggagatcgtgaactgtgagaaacttggaaggtgaggcatgatcggagaggttcattagcaactgtaagagcaccggaagaaagaaaagaaagaaccaaatcttgtggccggaggtggaagaagacctcaacaaccttagatgatgaccgatggaggagagaaagtcaactcacaaaacttaaaaaaaaaatcaatcgcctaactcataacaagcacaagcctactccttccgtcccatagaaaccaacctagtactagatatgacacatcctaatactattaatctgaacatatatttatttagattcattgtactagaatgtgtcgtatctaattctaaattcgtttatttttggaacggagcgagtagtttttgatcgacgggactacacaatgcgtgtgcactaattagttctaatcactatcatcctgtcaaatgaacttaccatgtataatagatgaactataatgttatctctatttttcttcttctctctatctctcaccttcttccttcaaggcttcttgaaagaaaaagaacgcttggaaattgaagtgcatcaatggctcggattaaaagttaattaacagggacaagacaaacgtcactagaggggaattttcgtccatgggaaagttcagcccatctccagccatgcccgtcctcaagagcgatggcgatcactgcatttggaggtcagtcgatatccagccgcctcatctatcgacgagacaagacgacgatcgatttgcgacggcagtttggctggcgatgccttcctccgtcaagcagcactggcccctcctctgctagccacgccgccgccgattcctccgccccgctcggccgctccttccgtctcgctgctaccgcgcgcgcgtgcccaaccgcctgtgaagcgggtccaaggtacgcaatgctaactgtgtcccctccctttgtccgccgcgatgccgccttcctccgctaatgaacactgaagctcgcttttcctcctctgatgaacaccggaagtctggaactcgcgtcagcagttcgctaatgacgccacactcattcacttccctatggacggaaatacccctcgataacttttaatctgagccggtgacatgctttaccctctgcgtgcgtttttttttggttgaggagcgtagaagcacacctctgtatgcatttaccaatcatttttatttttcaaattgtctgtactccatataagattatagttcattatagcctagttttaaacttgctctaacgatattttgcgcggctgataattagagccaaccaatagtccaatagtagtattgtactacgaatgtcatttactactggtgtctaaagattgaattggccgacatatattcattgatagcacctgcatcagactgtagaagcgagtgcacagcctgttgagaaatatgttgaaaggtgcataactctcagtcattatctaaagaaacatcacccagctcaagaaacatcacccagctctgttctttggcctcctttgaattttggcaaaggaattgaatttgaagttggtcttgtattttgtgtttcat

SEQ ID NO: 59594 - DNA, 4795 bp, Oryza sativa
ttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttggataccttgtgagctgtcacttgggcttattactcttggagatcttctcatagacggttaggtgtttcccgtgagcttccaaagatcttgtggatgtcccgggaaagtttgtgaagattttcctcacctccggaaggaaacgaggtaactgagtaaagattcttgtgctgagttttcagaggttgtcctaggcagagcaacttgcacttgtggtcttttctagaagaaattttgagttggatcttggtggtcactcaattctagaaaatgacctagaagtgttgagttgaaggttgtggatctcttctgggatctttgcataagtgagccaaggggttaatcgagacccggctctttggagcacctcaacggagagtaggattcgtgtgatccgatcttcgggaaaaaatcgtctttgtctctcttgtgcatgatctttgtgtgaatctgctgatattctgcgatctttatcttgttcccctatgtgcctaaacttctcttgctaggacctgtttttcatctcagtttaatttatctctgctgcccggaagttcctggctcaagaactccggaagttctgggctactcatgctgcccggaagttccggtgttcatcaccaggaggttccgggccctgtcaattgaaccgatgcaattgttgagaaaatttcaggaaagcctattcaccccccctctaggctacatctctgcacgttcactgggatcgttccctgtgacatgtcttcgattataaaattttttgccgcatcaaagcaaaaatcatcagcctcttcgttacgacccgcgacttccccgtgaaaagtccatatcttgtaataatccataaatccacgctctacaatgtgcaaatatcatttgggtcttgcatcatcttttcgttcctgcaatcaaagcatggacagaaaatgtccctcttgttctccctcaaagcatgtgcatttgcctgatcaacaaaattggatgctttcttcaagaacgccagatgaattctttttgctggtccatctaccaaaagaacatatttcatgagtcgaattgtactatatttaacatatgaaaaaaatacaacttaaacggacattatattgctattcatggtctagtggttccaataaaattaaattaataaattaaatattacttagaattactagatttgcaaacctaatatatttgtcgaattccactgaaaaaatttgaaataaacagagggaactaaacaaaaattaaattaaagttctacggagaatttaaacatgcatgcaacatttgtaatcaataataaaaactgtccatttccaaaaaattgtaaattttcttagcctttatccaatgacaaattaaattaatggaggcaaacctaaaaaggaatcggactacggaatactttgaaaaacatgtgatacaaacaatacatattagctcaaaaaataaataaaaaacaaaaagtgcctacactctccatttataaaactgtaaatttcttcgcattgcaccgataaaaactaacaaaaatagaagcaaatgaaggagaagatcaagcattacaccttatatatggatcaaaatcaaagatttgaggtcgaaaaccttccccttaatttttcaaagtttacgagagaaaacgccggaataaaagcggcatggtcgggctagagtgtacatagaccgacatcatcgcgtgcagtcggattaaatggcctgcacaggataatgcatcttctcgtgcgggcgccggcccggcgccggtcctcgagtttttttcacgcggcgctagttacggccctcctagaaccaaacagggccggcgtttaggaaaatgatttgtgtagtgttacctactctgcctattgtgtattgtgtagtactccgtccattccaaaatttaagactacaaagctatatttggagagagcgagagagtagcgattaattgattgtttttttattaaaaatgaaccagcggtgttgctcacgcccgaccggcagtgataagccagcagtagcccattacgtggtagcagtagtgattgaattattttttcagcaaaatttttaacaaacatctaactatatcaggccagtaatatactagctacatgctggtaaggcagaagatatggctttaatataccagtacgttcacctcatgtgcagctaaaatatttcagaaatcggaacttgcagtctacagaacaccgtacatgctcgatccacatgggcagctactacgtaccacagctaatgcaaacaaacaatatatatggcgcacaatatatatagttattaatgatccaattagttaaataatcactgcatcatgcagtgtagcttggtcgtgagatgcttggctgcgcctataaatacgcgcctcactcccaatatccgcatagacgagagcaacaaattagcagtagcctttgaatccattttggtttagtttgttgatcctcgagtaaacatcacttaaaactagataggaaatatggaaggtgcgaagagtttgatcatgtgtgctctggtgctaagtggtgtagctaggaatttttttgttgggtagtcctatttcctgtgagggaggaaaaaaataggtgtgaccaagtaaaaaaaaataggtgtgaccaagtccctagtagatagaaaaagaatgatgaaaaacaagttatactacaatatttacaaaatttgtccctgcttgtgccaacttattatactacaattttaatatcgccatactatctaatatgcatttacaaaatttgttaaagaccgcccaattcgaataaaccatcgtaacataaacaccatgacagaaaaaaagacagctagctctaatctaatcgtataaacaaactcaaactcaaagcttgacaaaaatgcaataacaaatatataacactctagagttattaggttaactaacaagtttaagaagcatgatatatcagtaagtatagttcgttttgcaaatgatccatgaattgtaaagactgaataagagcaaatcaatttaagagtataaatctcaaaggtaaatacgaaatgctttagcaaactttgtggccaaagaaatttattttgatagtggggattaaggtctctaggctagaatctagggtagtcctgtgtccatatggaccaccagctagctacgcccctactgcggtgctaggcttactcctgcagcaggaaacattccatgtggaagctacgacctgctgcccatccacctcggcaagaaaagtcttcaacttatgctgataccgtgccccaatggacgcttgtgctaaactctctggctgcaaaaatgttgatgggagttgccagccaccttacaatcatttcacccttcaccgtaactcgggtaaaacggacttaactattaactctatttctctattcttttgtactgttaattaatgttgcaatatttatttctaaactccccatctcttagttacgatttcacaagcaaatttcttatataaccgccagtaaaaaaaatagagtaccgctataaaaaatattttttctaagtagtgcgtggcacattacaaggattcggccgcgtccagttataaagtttgttgatgacaagaagttgtacgttggtcagaaacctgcattagcttgcaaatacccaatcctgatgttctcatggatcgctactgttgtgctcgagtgggctctaatgctactgatatgtttacatatatgtacctatactaacatgatatttactagatgcttccaagttaataaaaatatctagccaattattagctggatatgttatactatcatatccattgatcactaaatctacgtgtgtttgttatagacaatactaaaatctgtctatcctaccccacttctgaaacccccatctacttctaaatcccatctgctctgaatactgttccatcagctattttcgaaataatgtcttaaatttctttatcaaacttaataagcagtattatagccgatgaggcatgtttagggtcttttattctttgatctatccagtctatagccgatttggtctaactccatcggctgagacgaccaacgatacgctatcagccgatcaactatcggctaactctgcttctatctttcttgctgattgcagaatcaaatcagctatcaagcccttgacactctcgaggctacccttggacctgcactggagttaagcagatctcccaggccgctgtgttttccatcaaaagcacgtttaatggagcaactcatttgcacatgattggacaagtattaggtaaaaaggattttttttaaaaaaaaaactacttccactatttcacaatgtaagttgttttagcattttccacattcatattgatgttaatga

SEQ ID NO: 59595 - DNA, 6269 bp, Oryza sativa
atagaatttcgtttgaaaatcctagattccaaacagggcctacatggaccagccagtatgttagtcccagttttggcagttgcaagaagtgtatgcaagaaattttctgttacttggaaaacttatgttccatgtatagacattggttgctgctagaaagcccctacattatcttgaaaaggtaaaaagctataaatttagcacatctattttctattatatttatatactaaaagtcgattaaacctcctacaaacgctcataagacgcatgtggcatcttacaaacgcccctaagacttcccagtatacacctaggaagcctagcaggttaacgcacaagttcttagtgaggtgcatcacgtcgattgcatggcagacctataagacatcccaatagggtaactcctaaaaaatagacttcttcttccacatcgccacatgaccatcttcacttgctataggttggctgccggatcacttttccaaatactattgtcagatctttcaccatagcaaacacgatttttccgttacgatatttaggcttagtatggtggtctgccttatcttcaaaatacgtactgtcagtatcatccatacagtgggtgtaagccttatactccttgtttgattgtcaatcgttaatggttatgaacagcaatactcgtaggttaaattgctcatatttgtcctcattccacacaatgacaactttttttctttcataacagtttcagatcttcaaccaatggttttaagtacacatcaatgtctttactaggttattttgggccttgaataataatcggcatcatgatgtacttccgcttcatgcataactaaggggaaaggttttagatacacatggtcacaggccaagtgcaatgaccgctgcgcatctctccaaatggatgcattctatccgtacttaaacaaaaccttatgtgtcagggttacagataaggcatacctcctatcctacgacttatgaaatatatcgataaggtataccttcgcgcatacggattgttcccgtaaatgtcacgtggaaaccacttcgaattatggaaaatatctctacgagtcaagtgatttccaaagtcctactcggaagggatagattttctgtaataccatactaggtccgatatcgtcaaacctttcttggggatcaagatgatccacggtataaaagggaccccctgggaagggttcaagacatcgaattcaatcgccaacacacccaccaacgcttacgaagccagattatgcggagccaaatcatcgggagatttcgtcgaacccctcgactacgatctcgtcgataccctctatttcgactagtatctttgtcatctgttctcatcataatcaatctcatataaactggactagggctataacctgataaggggcctgaactagtataaactttgtcttttgtctgcttgatgtcgaactacgtagaccctcgttccaacataccccaatactctactcatccggtccgcgagtatcactcgtcgacagtggcgcgccaggtagggggacttggtgctcaaggatctaccggtatgacttcaaggctccccgacaacagttccaacactggcgtcgatcaaggaatccctgcctcgagatcgctggtgtggaatcaagtcggatccatcgtcttttcggtctatatcgtcacaccgatctcgactggcccaaacactatcgggaacgagagaggcatggttacgactccgagaaacgatgccccgccgacaattcctcccactcaagtggagaacggaacatcgacggtcccaacacttgggaaaaatcctcaaatggccgaatttcgtcccttgtacaaaaaccagagctgacaaggaatactacctaaaagctgacatccaagtatattctcgaggattgcccggtgatactccacgtgaaagctgaactctacgcctgctaggagtgtgggattcaacgcacttcaccgacaggagtcacataacgcccaattcacaaatctaggtctcacgaccttacaagttgcaggatctttctcacaactttgagaccaccgcatcatcgtgtccaacaactgcgagttcaaactccatgtgctcccagggacccagatgcgatgacgacatcagatcggttcgtaggatatgtcgaagctaatccgaatgaaccatttgtgctacacctcctggaagactacgagtcctattcggagtcaccacgggatgtaaacgtggttgacaacactgaaacaagcgcgtccacagcagcgagaacactcactcagcagctacgaaccttagatgcgatattgagtgaaagtcctttcgacccggtcacgaaccccgacgtcaaccaatgggctatgcggctgcgagagacaatgactaacctcaatgtcgcatttgccgaagcagctgtcaacccggagcagcatgaggacggaggaccaaccgcaggagatgcaaacggagaaaatcccaacgggacacgtccctccggtgaccactcaccccgaggaagacgagatcctactccaccgcgtcccgcgaaccgcgatcttcgcgatcatttggactatcggcggagggacaggagagatcgcgacaacaaccggtgtcgttctccttcacgccgtggcgataacaccgccgcccaacgacatcgccaccacactcctccgcggcagagaagggacgacagtcgaggaggcgccccaaatgaagatcaggatcgacgggcccacagcggccaccgcaatgacgctaataatgacaaccggcgagatcagggagctaatcgccgagatcaggagcaaaactgtggcaaccgacgagatcgaaactcccgatctcccgctctcggtcgagatcgaggacgagatcatcgttcgagaagccgggctcccgaacccagcaacccctcatcgtcgtcatcatcatcatcagaccagcctcctcgattacgtcaacatcgcgggccaccttttgctataaggcacagatgcagggcattcacgctcgaacttcgagatgtgcggtggcccgagaagttccgaccaggtgcaatagagaagtacgatgtaagcacagatccgaaagaatttctgcaagtctactccacaatcctatatgccgctagcgcagacaacaacatgctggcaaattacttgccagctgcgttgaagggatctactcgttcatggctggtccatctcccgtcccgctcgatctcatcatcggaagacttgtggcagcagttcgtcgccaacttccagggaacctacaaacgccacgcaatcgaggacgacctacacgctttaactcagaaccaaggtgaatcgtcgagggactatattcggcgcttcaatgagtgcaagaatatgatccccgagatcaccgatgcttctgttatccgcgcgttcaaatcaggtgtccgagatcgatacaccacccaggagctggcgacacgacgaatcacgtctgcccaaaagttgttcgagatcatcgacagatgcgctcatgcagatgatgcattaagacgcgaagagggaaagagcaagacgagcgaagagaagaggtcgagtaacaaggatgcaccagaatcaagcaagaagagaagtcgtaaaagtgggaagcgcaaaccctcgggagaagtccttgccgctgagcaaacggacatggttgagcagtgcagtgtgacaagcggagcctcgacattgttctactcaaaatgccaggaccaaaagggacaatcactatccagggcaatgctaaattggcagtgcagtgtgacaagcggagcctcgacatggttgagcatactcccaacccacccaccacaaccgagcagcccaagaaagtgagcaaacccagcaaaaagtcaaagccagacggtgctatcaagataatcccgttgtctagctccaaccccgacaagatggtcaggataggggctacactgggtgacaaataggaactcgcgctcatcgccttccttcgcgacaatgcaaatgtgtccgcttggcaaccgtacgacacgccgggagttcccagggaggtgattgagcacaaattgatggtgcgacccgacgccaagccagttaaacaaaaactgagaagattcgcacccgactgaaaacaggccatacgagaagagctcgacaaacctctcaaagctggcttcatcagagaggttctccaccccgagtagctcaccattgcagtaatggtacgcaaggccaatgggaagtggagaatgtgcgtcgacttcaccgatctcaacaaggcgtgccccaagggccatttccctcttcctcgaatagaccaactcgtggactcaacagcaggatgcgagttgttaagcttccttgacgcttactccggctaccaccagatcagcatggccaaagaggatgaggagaaaacaacattcatcacgcccttcggtgtattctgctataccatgatgccattcggattaataagcgtagggaacacatatcagcgtggaatccaaggtgcacttggcagtcagcttggataaaacgtcgatgcctatgttgacgatatcatcgttaagaccaagacaggcgatccactaatcgacgacctgagggaaacgttcaacaatctctgcagatatcgtatgaagctaaacccggagaagtgcacgttcggagtatcatcggggaggctactcggcttccttgtctcaggacaagggatcgaggccaaccccgagaaggtcaaggcaatcgagaacatgaagttgcccacaaggctcaaggaagttcagcggttgatgggatgcatggcttcgctaagccgcttcgtcgcaaggatgggagaacaaggacaagctttcttcgccgtactcaagaagcaggaaaaattcaagtggacccaagcggccaagaacgcgttcatcatgctcaaacgctacttgtcaaacccactgtactcggttctcctcaaattaatgaagaattatttctatatatcgctgctacaccttattctgtgagtacggttatcgtcgtagagagggaaaaagtacaacaccctgtgtactacgtcagcgaggccctccacaaaaattagatatccacggttacagaaactgctctacgtcgtggtcatgacatcaagaaagctacgccactacttccaagctcacaaggtcatggtcgtctcctctttccctttaggggaagttgtcagaaacaaagacgtcgtcggccgcattgctaaatgggtagtcgatttaagccagttttatgtacagtttgtaccaaggacagccaagtcttagctgacttcgtagccgactggactgtcttagctgacttcgtagccgactggactatccccgaagatagaccggccagccaaatagataatgagacttgaactatggcgttcgacggcacactcaacagccaaggagcgggagccgggttcatcttgacatctccttccggagatcaattcaaccatgcaatccacctcaacttccgggcaacaaacaacacggtcgagtacgaaggcctactcgcgggaataagagcagcagctgcactcggtgctaagcgactaatcgtaaaaggagattctgagttagttgcaaaccaagtacacaaagactacaagtgctctaaccccgagttagccaaatacctcgccgaagttcgaaaaatggaacataggttcgacgggatcgaagtacgacacgtctacagaaaagacaatgtcgaaccagacaacctcgcacgccgcgcttccagacgagaaccacttgagcccggaacattcctggacatcttgacaaaaccctcagtcaagaatacgcacgacgaaagtaccacaaccaacaccgacatcccgccgggggctacaaaagtcgcatacgttgttgcaaacatcaagacaacaaacgacttgcgtactccgctaataaaattcctggaatcagacgagctgtcggatgacgacacggaggcagagaaattatcccgtcaggccaagatatactgcatgatcggcagagatctatacaaaaaggccccgaactgcatcctcctcaagtgcgtctcatccgatggtggaaaaactctcttccttgacatccacgaaggcatttgcggatcacacgccagcggacgtaccttggtcggcaaagcctttagacaagggtttttctaaccaacagccttaaaagacgcctgtgacattgtgcaatgatttg

SEQ ID NO: 59596 - DNA, 5722 bp, Oryza sativa
agttttagtaccggaaggagtaattacttagtaattagcagcggtgttttcagtctgtatgtggtcagataggagccataatcagatagaatttttcaaggagttgattcttgcatagtggcaccactgccagacaaatttgcgaatgtgtaatacaaatttggtgttgtagtggttgaaaatagagtttttgcaatacacatactcaatgtagtaatatttgtctgggctctaaaagttttttagctctgccagtgcctgtatatgcggttttttgcacgtagaagtgcttgtggagctaagatagctctgctggattgtgccacctggaatgtttgccaataaccaatttttgccctttgtgatcaaaaaatatgtggtagtcatagttgctttctagaacttgactggtacgctagtacagccaccattttcctgatgcctccaattcataccacactctcgagacatagccaggctgtctggaattcttgtatcctctatagcaaaattcgagctcgatttctatattaaaattcccagatcaatttattcatgtgtgggtgcctactttgtttctaccactacagtactatcagttctattgtgatgaagagtaggagtgacattctctttttctttacttgcaaaataagtatctcgaggtacctaaattttacactattttttctacctcgagatagtatttgaaggtaccaattttacagtagaaaatctctcagtactttctcaagaatgggtaatactcattggtcaaaagatgcggtgataaatatataaggatgtttatttacaatctctgcatcgtgcccatacttctcaacgcaaggaacataaatagtttcaataaatgaaagaaaatatataattattagacagcaggacagacaaggtggtgaataagtgtgaaaatcattgatgctgagagtggaaggtgagtattgttatgtaaatgttaataattcaaacaaaatctgtttgcaaagtgcaaaactgatggatgctgaagaccaagcagagcttctgctctccaactctccgttcctgaagaaggaaacatgcaagaactttgtagttcctccctcagaaatagtagaagtgaaacttgtagttacatctttcatggcagataggctttctttagcttgtgatatactaccagatgattcatatgcgcttcatgcatctcaactcaactcagctgcgcatttgctttccttattattatgttgtctctgaatctttctgtattacctgaatagagcaatgcaaatcgtcagcatttctaaagttcaaggagaacacaagttttattttatcctcttgaacaagggtgtagggatgtttttgcacaacacgaattaataataacataagctagcttgaaatctgtagtcaacagacctcctaattaattaaaacacaggcttccgtcacacaatcacaacagtgtgcagaacaacaatcaaatttgtgctgggccaaagaatcattgagatttgtgcaactgcctatcattgagtcattggcagtggtcttgtggtgcccatagaagttcatgcagagctcgatcctttgtgacgtacaggccataccacctagaatttcttcctacaagaaatgttccatcttgtcaccgagctagtggttgtgttcgtaggtgatttcatagaacatgaattgtatgctagtacagccaccattttcctaatgcctctcattcatatcagatatgacacacttgaatcataacggaactctttcggaattattataacggaactcctctattataatccccacgcagctccatcgtttttccttgtgtggtttttgctagtttacttctaccaatactggtatattgtgatgagagtaagagtggcattcattgtctctcgcttttaccagtaaagtacagctcattggtccaaagatgggttgatcacttgctgtgatattaattgtgcttaaaaataaggacaaaggactgaacaaacaagatttgtcacaactcacaagaaaggaaagacgaaggaacatccctttggaacattgttttccatgatgtgcgaaaaaggaaacaaaaaactacatcgtttgcacaattaagatgatcgataccaggcagtgcaagagacctattaattattacaaattattcactacaaaacctgaacaagctttgggtggttttccaacatatatagaactcatacaagcacaaggcatcatgtgcacaggaccccatggacatactctgccaccatcctagtgatccatgacccttggcaaatgaggttacctcaaccaactaattacttggctacgggtgttccaatatgcacgtggtcacaaggtaaccatgcttagatggaagtacctaaggagttcgtctgccactgcccggcaaccccaggaagtgtcccaggcttgtcctagaatgtgtaatagaaatttggttttacgcagtgattgaaagtaaacacggaatatccttagatgtgactacgaaattagggataggcgtaactccgtattatgatcttctacaaaccacttttcatttcaagcataccaacaccacaaggtgggttttaacatggcttcacaggcccattttctccagttttgatagtacaatagtgtaaataggactatcaatacctaacctaaaacggtatgtataccatggaggacttatcagtttggcatgcaaaaccgagggccgccgagcctcatgagcccggatcctctgcagccgggcctcgagaacctctcttattcgtcacgatcatcctaatcgtagcaggaagctcttggctgtcctcattgtctcgaccggcctccgccctccctcactaacgccgatggtgttcttcggcttcttttccaagacgctggccgaagaagttgaagaggatgccatcaatgtccttggctgaattgtttcgtgaatttgacaaatcttgtttgggtttgtcctggtgaaattgtatttgaatttctgaattggaggatattttgatcttggttttcattcttttttaagccatttttttcaagcagttgacttaatagtgtcacctgcaaaaatcaattttcataagcggggttcttagggtggccgcctaagaaaatcaaatgaatgtcttgtagatttttggagtgtgtagtttgatcgtaggtgaagtttgggccgccttcgaaaacatgttttggtcacctacaataacgtattccggagtagtgtcatagaaccacacacaagaacaagatttcatgaatacatcatttttgtatctgtctctaggatctagatcctctatttaaggatcacttttcctttttatagataaatgtagctttaatgaactcaaccaattacatcaagataatgcaatcatactgagaacatatagtaagatgcatataaccaaacacacgcagtctcaactttatataaaaaaggagtgcaagaagtattatagaccatcaatcctaagactgcaatgccagccatgtccctagcgaggtaaaatactctttcaccaccaactccgagcgtacacatgccgcaacaaccaaatcatgcgaaacaggcttttgtagcacaacccaaatacacagctaatggatagttgagaaaatatcctgcaaagaagaggaaacaaattttctatcaaaaaccacatcattcttgcataaccatgtcaaccaacaagtagcaaccactcctaaaagaccatatcttctgaaatccttgtgaacatttcaaagccacctagtaacacatatgcgaaacactatgggggtggagggattgctagctcgacatgtataatataacaaacgaaatgggctaaatggcattcaaataataaatgtcttattgtctcattattctgacaaaaataacaattttgtttaccatgttagttatgtttagctagattatcctagttaaaacaactccctgtcgtaaatatcaaaggaaaatctttactttaagatatacttttaaattccagagacatatatttaaattaggcacatcactatggagtagtgctagacaatagtatttcatcgtgaactccccattagtagtcgagctccatttaaaattatcttgcccctgttttagttatacagtagcaaggagtcataataaactattctaggccactaatttcaaaccaattatgttccttctccatgaaaaaattggagggtcacttttcctgcaacatgtaaaaaatactatatcgaattaatgtaatactttgatctaagtggttcattccagatctaacggttaaaaatgccagaaaatgcacaatactatttatctttgccatagcaatcagggaaagacccttcttatattgaacactctttactttgggtacctcaactacgacgtaagggctatctatattggacactcttattggtttctactctagcctaagcattgacattgctgatgattggatagtggggaatgttagaccgtattgttgttaaagagattcaaggatatgactgatcttgtatcacattccttctttttcatctctatcttctactctatataaaccacataccatgtcttgacatatacatcattcatcatttgtagtacatctcttccctctcgtacaagtgttcaacgttgagttcagttgtttttccagtgccattgctgcacatctccaaccatggatggcctgctagcaatatagtagtgttagattgcctggaatggctgttgcagtcagttaaagaagaagagggggaaggactgaacacacgtagtacttggtgcgctgtgagccgctccttaggatcccggacaaggaccttccgaagcaggtccttggcaccttccgacacatttgtccacggatccgcgtcaaattctagcatgccatgcagcaccttgtcaaataccccctgctttgtatctgtgaaaatacggcggtaacaagcaattttgtgtcatagttcaagatacatgctggaaaccaagtgaaaagtggtgtgtcaatagtgtgtgcctaccagcccagaatggtggtacgccacaaaggaggatgtagatgatgacgccagcgctccacacatcagcttgctgcccataattccctctcaacacctctggtgccacgtaatacatgctcccaaccacgtcagtgaacgtctcgcctgaacgactaacacaatgcagttcttcgatggtgaaggtgtcataactgattgattgatttaacttggccgaagaatatggagaggccaaagtcaatgagtttgagtggcgcatcctcctcgttgctaacgaagaggaagttctcgggcttgaggtcgcgatgcatgacaccgagagagtggcaagactcgatgacagagacgatgatgcgggcaacctcagcagcctgcctctctgtgtaatatcccttgctgatgatgcggtcgaatagctcaccgccagtgcagagctccataacaatgtgcaccgccatggcatcctcgtagctgccccggatggagatgatgtttggatggccagcaaggtggtgcatgatcctgatctcgcggcggatgaactccacgtcgtcatcaatgacgagcttctgctttgcgatcgacttgcacgcatactcctttctggttgccttgtccacgcacaagtatgttg

SEQ ID NO: 59597 - DNA, 6423 bp, Oryza sativa
aatatcttcccaaccgtaagttcgtttgactccgttcaacttccaaaattcctcaaatctcgagatctatctaatggcacgcttagaggtcaataatagggctttattctcgccgtttgctgagttgtcccgtttcgcgtgtagtttcggagcccgaagaccagcagtgcgaggatttcgaggatcaagctcaagatctcgagcgaggcaagccacctttgaacatcttgagcctatatttgaacttaattatgttgcttgaaaaatattatgcattgataggatcgcacttagtctgcttgtcccgtctgcaaggcagattggcagacctacctaacttgttgcatttgacccttccattgtaattgttataccatgttcccttgtacccacctagttgcgcctcggtaatcgtgcactctgcactggtatcgacggtcgccctcaaacttaaaatctgagaaacatcttgggtaaaacttgggttttacaaaagacttggaaaacccgacacctgggtcggtgcttgcgaactaaatgaatttccaaaaccgcggaccggggaacgtaccgggtgtacagtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtagccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggtttgatgtttgaaaaatctgcggctgatgggatcagccaggcccgggtggccgtttgaaagctgttggccgggtgccaatcttgatcaattcaaaagactgatacattgcacatactccgaccggacgagacgcactgtctcatccgtgttgtttgagaagcactcccttagttgtttcagaaaagagtttaaataaaatcaatcgaaaaaaaaatagcagcctttccttgaagcctgcattaaacacttatttcccatggcttgctgagtactcctgtactcacccttgctctatataaataatcccccctagttgctgaagaagatgaagcggatcccgctgacgaggagttcttccaggagcaagccggctacgatgagttttagggtttcggcctagttcccaagtcgcgcctgtgatgtttggtccaagtcttggcttccgcttcccttttgtaatgcagttgtgagctcgggatctgtccgcagcccaacatgactgtactcctactctataataaagagacctctgttcctgtgatactagcactgtttcctgggactggtatcgattaacaggttaatttggagcgtcacgggctagttccggtcgggactagttcggggcgtgacaattaacatatgtatatggcaatagtggttatatcatactttaagagaaaatcacattaacaggatatttatgagaaacttagaatgcttaagtaaatagctacacatactgatggatctgttcaactaacaaccatagtttaaaggtattcggcatatgttgcaaggcatctgtataaagcttaccaatagaactctaattggaaaaataaaccaacgggtaacagatccagagaaacatcaccccagaccgaaggaaaattactataagagcagaaagcatgctcatagcacaccaattatattgctcacagaacagaattcatgtgaatgctatcattatgttgcttgtaatacaatggtggatagtaaaatcatcaataatttagtttaccaaagatctattaaggaccgcaagaggtggacacaaaaaaagcttacgatactttggctgaaccctttctaatcctgtaatttaaggtgtacctgacattaaaaatgcagcaactttcagtcatataaatggtgaaaataattaagctgtagttccactcttaattactgaaatactaaaattatatgttaaaatacttcagttgcttcaattagtagctgtggtatgagacaatacacattaatagtggccggctctcttgtaagcattctatcgtcatagtatacaagcttattacattttctcatactattatagtagtgtgagatgcagttatgcttggagctagctaccatcaatttaacgacaaaggtcccaagtatgtaaatcctcttctagtagaacatatgctgtggccattgcttcccatgtggccatccttagctgcatcgagccctctaacaattgtagacaaacctaagtttaggaaaaagaaattcgctaaaacaattctctgcataccatgaaaatatgattggcttcagatgtagcaaatctgccatcataattttctagagatgatattagcccatatctacatatctgaaagagctaaagaacaaaaatatggccggagcaaagaacagctcaggaagagacatgtctcgtacggcagaagcaactatgatggcatagaaaaaaaggtctgttcaagtacaaaattttagcccatttgaaagtctacatgtactacttttgttgctacccttcacacaaaagatatgctgctgatagaatgtaaaaagaaactatgcccatttccttgtttccaacacaatcttctagaaaacatagcaatataaaatgggggcaccaggagtagggagaaaaagaaagtatgtttacctcacattagtattccttagcctttcacccatcctttgctggtgtcatccactaatccctatgcatgtctgtagtaacagcaacattttttttgtgaaagctaccattgtttatcacttactgcaaataatagtggaaataattcatcttacctcgtataagcaggcagcatcctgttctcttgaaacaaaaagcatctactggcagaaaaaactgggggtttgttcagctagcataaaaaattgggggctctgtgggtatatccttgagcaggaaaacttaccagtagatctagggtgcatccactgaaaatcgaaaaggaaaatcaagaacagtgaagaatgttgtggattcatagaaaaagaacagtacaagagagaaacttaccctaataatgaagtaattggggattttgatgcagtagcttcaacctcgaacagggatttggttgctggagttgccggagctggtggaggctgcaactttggatctggactgagagatctggatagagaggcaggggagatagttagtgggcgcggtggagggcacgatgatgccggagatagggtgggagggtgaccggagattctagtggagagaatccatggtggttgatttgggggattaatggtggtgaatctgggggaaggaggcagtggaaagggggtgaggagaaagaagaggggtctgctggcagctgaatgggtatctgtcctcagctcctcagtcctcactagtcttgagcctgaccggtcaaagcacaccacaattattctcgcgcgctcgtcccgaaatttttttggcgcggcagcaaaattattggcgcggtccctggaagcctcgcgggaagcctcgcgggaacccaaacttttcttctgacggacaaaccacgtcagcgaaattcatttatcatgacggttccgataaacacgtcagggaaatagaatatttctgacagttttacaccacgtcaggaaaattcgtctagtcctgacggctgaataaaatcacgtcactaaaatattagcccgtcagagctagttgagtttctggtagtgcggtgaggaaagagttgaactggtatatgtgttattgaagatgtgacttcctgctatgtaccacaaggttgctaggtgtttttttctgccattaccctcggagaaaatattttatttccaaacggtaattactaccatattttcgtggtagtcttttcatttattcatgtaattaattaggacaataatgcaggtgcaactgccttaatttgtcccatatatcgaataaaggttcccaaaaatggcatctggtaatatcaccactaattttctaatactgaaattgaaggctcgacacttggctcgatgcttggattcaacgttatatataaatataaggccatttccaacccaataactaggatagtgtctatagcattaaataagctgtcacataggatgaaaactgatgtggcaagtgaataaatgaggaaagagaagaaaactatgtcttacatgagacatggtttctacacaacatccaagacattatgtgagataagtagcattaaatttaagtatgaaatagtagtgtttgcattggaagagtagtgtctaatactagtttcttgataatgtggagtttatggaaactatgtctagtgttttgggttgggaatggcctaagctcgctatacattggtaaaactctgtctctgatgaacaatatatggccctcataacaagtacttccgggggagcgcgtatgtgatctaactaaacaggtatataatagtccacgggaactggtgactttccaggaaaacttaaaaggaaaaactaagaaatatactccctccctccgtattttaatgtatgacgccgttgactttttaatcaacgtttgaccattcgtcttattcaatatttttttaaaatataaaaatatttatatcatgcttaaaagacatttgatgataaatagggtcaccgatgaaataaatggtaataacctaaatgttttgaataagactaatgggcaaacgttaattaagaggttaaccggcgtctacattaaaatacaatacagagggagtatttcccttagggcacacgatagctagacttggatggaatcaaagttcccaacatgctgccagatgttaatgtggaggatgtacatatataagtacatttaaagtagccatatcacgatggaccttctgttataaggagatcttttggatataagttctcgacaaaaaaaaaaaattattcagcctagcccgtcggctagcatggttactgttttcgtgatgcatctcattcgtatcacacgcatagagatttttctggttttatcgcaccgtagtctggcctccatccttcctgttgtgaaatgctacaaaatattctatgatgtgtagcatcacaaacaataaaaaagatgttccttttttacaagttagctatataataggagtaaattaattaaatgtttagagatgggggtgatatatataagggccggaggatgagagaatgcattgctttttcaacaccctccgtatctcagatagcaaaatacatggttggtccttaaatatctaccagagtatcatttagatccataaacttataaagtacacatctatatctataattttggttgatgtatcacccaaggtctcaagaaaacattttttagataatggaggatttatttaaactcagttaattacatcaagatggtacaatcacactgagtcacccccggtctctgcataaaatgacacaaccaaaaaaagaaagaaacaactaggaatatctcccaagcataaaagtttgacagaaacatcttagtgcctatcaatccatagactagaccaaaacccatgttcctaggtaaaaaaaactcctgcgccacctggtccaactgtcgtgataccaccacaatagtatctcgtgtcccggtttatggaggatagcccagatacgtagccatcgggtaactaaagtgataacctgcaaaggagaaaacaccatcttgttatcaaaaattatttcattcttgcttagccaaatggaccaacacaaagttatcgcgcccatcaaaagcagattcctcatgtctttaggatacatgatagccaactcccaaacatatgactaacattgcgaggatgttttaaattataagctagatgaattacaaactacacctagcaagataagcgacactgaaagaataaatgttggctggtttcatccttgtgacaaaaacaacatgtcttactacctttccaatttctcttagtaaggttgtccttggtgagcaattacgcctagcgttgataccaaaggaagattttttactttcaccttccaaatgcgtctattgatattcggaaccccggtatgtg

SEQ ID NO: 59598 - DNA, 3735 bp, Oryza sativa
gcctctccctcttagaccgtgcgccgcccggccgtcccgtcgccttccccggcgtcgcaacagcttcttctcccccggcctgccctccgtttcgcgcggtgaccgccggaggcgcgttcccgccgtcgtccagtggcgttgccgccactgtaccacctcaagccgcccttgccgcgccgctcaggtgcgggccgcccgcgccgtctcctccctcggtgtcgccgcgtcgacctccaccccggcctgccctttgattcgtccgaagaccaccgtcgtgccgcgccggcctctccatcctcctcgccggaatttccccggtcgaccgcgtcgccgtcttctccggcatcgcagcggcaaggtcgtcctcggcatcgcttcccctccatccaaacccctccgcggtcccatcatcgtcgcctccgttcgttctcgtcgtcgacgtcccgtcggtcgcccggctcgtcgtctcgtggcgccacctccgtcgtcggcatcgctgcggcgtgttccacgccgtcctcgcatctgtgcagctgctgccggctgccctcgtcgcctcctcgccggccccggtcatcgtcgtcgtcgtcctcctcttgttgtcctcatcgtcgtggcgttcgtccttccgtcaagccgttcgcgttcaccgcccgcgtttcgtcaagtgtgcagcatccccgtcgtcgtcttcgtcctcggctccgcgtcgtcaagccttgtgccggccgcgtctcgccttcgtccaaggatcaccgccgaagtcgttccctcgccgttcgcctccatcgtccccgagctgtctccgccgcgcccgttcgtcgttgtcgttcccatgcctcgtcgcgtggtggtaaggatccctctccctcgctgccccgtcctcgtcctttcggtgccgcccatgcccgttgtgcggttgtcggccccggtacccgtgtatcggtgtcggcagtcgttcgcttgtgcgtgtggtgaccgtgttagtgtgtccgctcggtagccgcgtggtttccacgtgtgcagcccgtgtggtgtctagtggagttcgtttgtcggccactcgcctcggttgacacacgggatctgcttctgtcgacccgtggaccgtctctgtgtacccggtctaccacggtcctttaggttgacatgtggggtccgcatgtcaacagcgcagccttcctgtcttttccagactagcgcttacacatgttttatagttgcaaagcctaattacaataatccgtaaatctccatgtaacaacattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcttgaagcgtggttcgcggtcgtcaccgaaggttcagcaggccgttctctgtgagcaaggcaagtcacatcattcttgagcatattgaatcccagtctataaaattattttgatttaaattaatgcattatcgctttatttaaattcccgcgttatcactgttttatttaaccatgcctatttacctttgttatgaccttattattgttattgatattattaccttgttcaccctagaataaacaaaaccccaactagtgggcactctattcatggttccactagtatgaatttaggtaggtgcttcgctgattaattaggcaacattaggtggtttttataactctagactttgggaatattcatatcacttggacatattggaatggtcggattattgtggaattggatgcacacctccccctctattcaaaaccctcaaaatggttttaggctgggctcggggtgcatggttttgttagtagcacctcggccacataaggaccagtcttcgggcctctgttgcaaagcactaccgtacttccacatgtctagtgggtaaggcttagtttgtggctcagtctggttataaacaaaagtacacggattggagatggacgaagtcgggggttgatggacattctccaggacaaatgaaggctacacgagctgcggcccggtagtcgagatgtcatggcacagggctggtgtcctgctgctaggggctcaatcctgcctgcctgtcccgggggttccggccgtaggtgggttgggtcggtactcttgtctatggctaggatgggttggaaactatgtcatgtcttccgtccgtatgccgtggtggtatgtggcacgtggttgcacgtgaggaagatgtgtcttgtgggtaaagatgtacacctctgatcagagtaaaacctattcgaatagccgagccctcggttatgggcaagccgagcaatgtacccaagtcagtgttttaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttaaaaatgaaactatttgcgaaagtccctttttcctcctttcccctgtgctatttgcaaagtgtttattcccttttcttccttcttcaaatttcaactagtactagatggtcagctttgcgaagaagaagatgtcgtcagttgtttgccgaagctccggaagactgcaggatccgctagcgaagcgaaggaagaagtgaagccagctgtgaaggagtgaagatcttgggaacccgtcgcagaacctaagccaccctgtagggtagtgttgttagtcgtgtgttccttgcttgtgtgtgtagcgcgtggtttgcatcggtgggttgtgatgtaaccatgctaggttgattgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccaagcatgccgcttagttcacagcta

SEQ ID NO: 59599 - DNA, 4511 bp, Oryza sativa
gaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacaaacctaccccccttaaacggaatctcggccccgagattcggaggagctggtgaagaggtacggatgggcggctttcaactcatcttccctttcccaggtcgcttcctcttccgaatgatgactccactgaactcggcaaaaccgggtgacctttgaatttctattgttatagaagggctgaattgaaccgaagtggagctattccctggggtatgaacccgcatcggtgtgctaagttcctctcttattaacccatgcatcccgacaaatttcttggagatgaaagaatgcgttgcaccagaatcaaaaagtactgttgcagggattgagttaacaggaaacgtacccagtacgacctctggtgctgcttgtgcctcctccgcagatgcgtggttgacacgagcctggataaaccttggtccggcacgcctgggcttcgggcatttgtcagcgaagtggccaagctcgccacagttgaagcaggaccctggttttgctcccgtctccttcttggcttgtgcgggctggcctgactgtgccggtgccatcggtgggcgtggagctgtaccgcggttgggctgacttccatggtgattctggctgccactggagccctggtggaagttgctggggttgaatgggcggtgttgacgaacaatcatggtggtaggtccaccctgctgcccgggagtgaagcgcggcctctggtgacttccctgatgtgccctgaactgcgcggccttcctcttcctatccatcttgttgcgttgatcccctggcggattgccttgtcaaccagcctctcaaagtcggcgtagtccccagatatcagttggttggtcagctcgtcatccagacccgccatgaacttctcctgcttctcggcgtcggtgcggacatcctctggtgcatatcgcgcgaggcgattgaactcatggaggtactctgtcacagtcctgctgccctgatggagcgcccggaattccctcttcttttgtgccacgaccccgtctggcacctgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctatcgcatggagccagtcatttgcctccatagtgttggtggtgctggagaaggtgggtggcctgacacgtagaaactccggcaacttggactgagggggagggggaccaaactgctggtgctgctgttcggcgtgctgcatcatcctctggtgcatctgctggtgctgctgctgcatctgctgcatcatggctgccatcatctgagtctgatgtgccataacttgggcaagggtcggattctcgggaagtggtggcggaccattgccagaatcactgttggggtgcacaccatcagcgcgttcttcaccgttgctgccctcgcctgtcgtgcggttgccagtcctggtgtagaccatctggagggaaaagcagacgggggagaagaagaaaaacagatgctcaagaactaagctttattatataggaattaaaactgcaattgttctgatctgaattaaaacacttaaaaagagcaaacaaaaatccttattaagacagccatatcataggcacatgatatcgaccgtcgactgaccccaaacaagcaacctaaacacacaaactaacaagcagaaactagacaatcgataaactaatgggaaaacgagcctaatgctcggaacggctcctgcggccggtggagtcgaaagcgtcctcctgctcgtcacctggtccctctgaacgactcctggagcctgacagatcagtctcgccgctgccactgggagtagcggacaaccaacctccggtaccactggctggacctctggcggctgatgctggagcgaaggagagagtgaacgcgggagctggagctggaggaactgcgggaactgccggagctgcgggcggaactggaggtgctgcgggagctgctggtggaggtgggttcctgggcgcaagctggatgcgcacgggtgcagtcgtcctcttacggggcgtagtgcggatccggactcctcctggtgctggaagacccttcaactgagcattctccttcttcaggcgcgctatctcgtccttcagagcgacgatcctcatgagcttcccatcattcaaggccttggtcgccttgtgcaggtccgagtgcatctggtccaatcccctcatcacagcacacatgtgaccgaaggtggtgtcgttctcgccagctgtcggacggaaggagctgacgccatcaccatgggctcgacgggggtggtagcggtacgccgtgtcgtggaagatgtagtcgtggcgctcccgtagtctggccatcatcaagtaggctgcctcctgacaggcgtgatctgctgtgcctccagatgcctcgaccgccatgttagcgaggcaagtccccacgtaaccatggacctccaagcggacacggtgaggaagctcgccactgagcggcggaatcgtcgtgtactccggcgcgtcggggtagcccaccaccagggtcatgcgtgccaactctgccacgaaatcaatcatgccttctccgcggtggttgggtgggtgaccggccatctagagaagacaaaggagtaggatcaatgcatgctcaaatccaaatttaaataaagcaataaagactcaaataaaggaatcaaataagagcaaaattttatgcatagatcattttacatgagcgcgaataaataagacagactcacataacgataaaataatgggaaattagatacataataataataacgaacaaagcataaacaccttgcaacccatgttaccgagctaggacctaatgcatttcacccctcaaaccccaactgactgacgaataaatcccaataattttactaaaaccctagactgactcgttttgaaaaactcactttaaacgagcgaccaagatttttcccttgaaccacaagaacagatccccattttcccggaacaaaatccaattgcaaagaacatatgcaatgaaaaggattcagagggctcttaggtctttccatttggcttgtcctacggtcaaggtcggctctgataccaacttgtcacgcccagaaattcccgaatagaattccaagcagaatgtgtattaaaacccccgtccaggaccagccggggtacacaaacgacaatgttgacatacagatccacgtcttacaaacattataaaggtcttacagaaatgcagcggaaaacaaaagataactggagctaatccttgacttgaactgcagcgggaacaccactccacaggcatcctcgacggcacggacgaagcctactcctcggagaacctgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagcccgtgcccacgctggcttgtggaagtacgataaattcttcagggcaatccgcgaaccggccttaactgccatgggtgcgactagaaaaccatgcacccacaagccaccatgtggt

SEQ ID NO: 59600 - DNA, 10215 bp, Oryza sativa
ccctgtgattttctctcttttctgttcctccattcttattgcttgtccgtttcaagtttctatatttggttgcaaaaacttgatgcgattcattgcaatgcgttctacggatatctattatctagctcttcaaatgctttaaattcgtgtcggtgaggaagtcctcgcatttgtgcaaatatggtgaagcatgtgtctgcaccaacgtcatcacatatttatcctttatggagaagacatagtgtcattatccgaaatattacaaatgcgatccaaaatagtttaaaagacaaagaatgaaaatggaggagaaaaatttgcttcatgtatgcactctaagaaatattgcttcatgcaggtggtaaagctccactccacatatgttgttggactaaactctaactgcaatacattcttattcatctataccgctagcgaacatgtacatgtgtatatgtgctgacttctgaatattcatgcgtcgaaaagcatctagctgcatcatcattcagctgaagattttcaagagtcagagcagcaaatgagtctgtaatgatgtggcatgctgtgcgagaacttggtttctatcagtggtcagagagaaacaatctgtactgacttgggagacttcaggttggtgtggagcctcctaagagatttgtttgagtacagtgatgagataatttcttcacaagttcacatattcccttatgcctcctatccatatcgcattatatgctaatttggttttagataatgatccatgccactacacctaggggtgtatcacaatgtagtgtacaccatgaaacttcgatctctctctctcctccttcctgttccaaagtctttgttggatgcctagttcttgctagttgctatagttagaatgtgttggtgtggtggcaagagctgctgcatgcatgctaaaataaggatgcatgccaactcataggcaggtccttgaaaacaaccgctaaatgggtttgtgggctggccggcttgtatctataatgctaaaagggttttttttaacgagtgcgaagttctatcgatagagtagaaaaaaattacaagattacaatcccgggaggtcgtaactcataaccaggaaaacaaaatagtatacaaccacccacacaccgacagtgccaacacacagacccaggagaaggctagcaccggaccggctgccgctaagcatgaccgaccgccactaagccaacaacggaacacagccgagatcgcccaaaactcgacccttataaccgacacaaaaccccgctctatccaaatcttcgggattgaggaagagaggtgagacagaagaatggaactgctctccccctaggccctccgacggctaacttgcggaagctaggaagccgacaaaagaggatatgaatctagagcgaggttgcaccaattgcttgggaggtttcggcaaggggtgcctagacaatgtctttaaaaagagaagcgacgaaagcaccgccgccgccgtccgtcaaggtctccaagagaactgagactgggctttcatccggcagccacactagagggggtgagacggcatgacaacgccctcaagaggggagtggcactcgaacgccaccgttgttggcccggccaaggtcgggctgtgttttcacccgttgtccacctcctgctgatcgaaagctgttctccattgctccaaccactgacccttcactgtcagcgcgtgtacaccactgcaccgacgcccctcgccggccaatctccacgtgcctccacgcaggcctcccactcgccgcaccggacagtcggcaagccgctaccaccaccagccgcgccttcttgcgccgtactggcttccgttgtcaccgaccacacctcctcgtgccgtgccgacctccactgccagtgtgcccgcctccttcctccagcacacgccggtctctactactagctgcatgcgccgcgcctcgccggtcgcgcctcgcctgcacacccacgccggcctcctccgctctattgcccgcccttgccgcgagccgctcgcctccgccgcgccgtctcctccggccgtcaaatccggccgcggcggcgtcggatccagccgtggagggccggatacggccgcaggcgatgcccgagacatgaccccaagccgcgccgctgcgcggcctgccccacgtgccagtccgcctcctcgcgccgagatggggcacagccgtggggggtgtggccctgctgccaccatcccggcgtgccgcgcggtttccggtggcagcggtgggggaaagagggtttcgccactgggtcatccgcgcgtggacgacgtgggggggggggaggttaggtcatacatatatatgtactactagaagatggattattgaattactaaaggctttccttgtaaattggaaaaaaatgtttagggggctaggcaatgaaactctggagtagttaccatcattgattcatcaacctccagaatttctcatgccattaatccatgttcgccaagtgcatcccatatttgtacttaactctgggcaactactctgaagatcccttgtatcatatatccaaagtgagcaatcattttcgcatctgcagggatagagaatttcttttgcctttgggacaagaaatttcccgtccatgatcctcacagaaataattctagggtatcagatttatttgctgaaaggttggccaaccaattttattaacatcaaagcagaaacaaaaagaaagatgacacaacatttgcagtaggttgtcaaaactgggaagtcatgactcatgagacgcccttaagggttaaaatccaaaactaattacaagcgtctacagcagatacagacagctgctattatcctcgcctttaggagatcacttcatgaaagaatgcagatttcatccttgactacagtgaacaactccaccaccattttcatttccaccatgaagatgtgcacatgtctttcattccaaactagccagcacaccgtcacctaaatagttgcataaatgttgatcaaaatttgacacgacagattgtgatgatacaagtcagtacacaaacatgtaaatatgaattcgctctgaatatgtatgcatggaggaacataaacaaatcattcttcatatgtcattgcatatgtattattcacttgttgattttgtaatttttgtttcacaatgtatacatcgatcctatacctgcatgtctgtgtagtgacttatactattgtaatccatctcgtcaaaatttttatacaattagtattatgtagtgtgaaagtaattggtgcctttgcacctaggcggctaggccattctacatatgcagtgagcgggcccattctacatatgccttttatcagctgtatgcccctgattccttcacgctcatctgagacccaagcctccatcctacacggctgcaaatcttgtggtcagttgctggccatgacaaactctagaatacatgttttggaaatacatattgtgccctccacaggttgccttgtgccagatcaacaaaacatccaactgaaactacaaggttttatggtcatatttttcctgatgcctcctagtcatatcaaactgagacatacactaagctcgatctctattgatttcttttatcctcctcctcttaccacatactttcttgctttttcacttgctacagtacttacctattatgtctattgacatttgacaggaagtgaatttgtgatgcatagtgaactgaatactgaaagaaggggtggtatatagaaggaccaggaaatatgatgcggttattgcccttctatgttatatatacaaggtggtcataattaaatttctctcatatagtatcatcaacttcttgggttgatctgaattaaatagtgaaaataaatgtgctatgatttctacatagactttttgtaccattaattactcacccttggagagctagaaataatgaaggtaaggttttgaaacttttatatgacttgaagttatatgtaccgtagtacgtctcctcagaactaagggcaagttttataaaagatgtggtggtcacctccaattttatccaattatccatccctagcctatatagatgtattgcatttaataccctagtcccagtacacttgccaccaatcaactcctctaattttctcttgttcttgaagtttgtgtggaggttgccccttgcgtgaggggtggcttctcctctctcttctcttctctcttccgcatcatcatttaagcatatagtggatgcaatggaaagttaattgtgttgggcacaaccaccactgacaggcagtcaggcatatatacagaggtcaccaggttttgtaatggtatgaaaaaaatggacagagatgaattgccttgcaacaagatgagcagcactatatttcttttcctgattagaacaactaccaatctgtgaaagaactattaacatatacatggaatgcttccacctgtatcggtgttaatctctcatcatgccattaggcaatggttggtaactgcatctgctagatttttaattcactatcatcccagatgtagctaatttctaatccagcctcgcacaatcattgaacacaaccgatgccggggacctccacaaattgcttccactggcggccacagctagctctcagctgcaaaatgtatattcctatcctccagcttctcgtgaataaactggaaatccttgtaataatgaatggttgagtgcatggcttatgcagagaccggaataatatattcctttatctaaaaaatgtgcacaatgctgtgccatggctagtactcgtgttggggaaaaggatagaaggtactcctgttcagctagccacggtagctagccagccgctgaagtaagccataagggaagatccatactactggtcaccatgactgtcgtgacaatttttaacggtctactacgggagtggattctaatccctcgaggggatatcccatcgtatatctttttcttctaaatttgatgtaaatagttgtgaaaaaatctgaaaaaaattgacaatgtatagtataatgatacctactagttcacgaaaattcagtttcaacttcgatctacacatcgagaaacaaaaaagacaaatttagatataaacagtacgctactattcatatgctgaatttgtcttttttatatctcgacatgtgagttgagtttgaacttaagattttgtggagttgtatatatgtgttgtatgaatgttgccaaattttttcagaatttttcataaccgtttatatggtttttaagtaaagaagggaacatcccctctcgagggattagaatagtttcctaagttgtgctcaactaataaagtatatggccacttctttgccgctgcttcccacttccatatcacaaaggcaagacagctcaaaatgtctatcttccatcccccattctcttgttggttgttgcttgctagttgctcctacttgcaatgggaagccaatactagtgaacgaaggtgcatacccaaaatttgaagggttatatcagagagttagagaagctttttattggagatggtacttactgctatgtactagatggttggtgtgtgcattttctaccattttccccagaaaaaatatatgctaattttcgaacgataattactatcatattttcatggtagtatttgcatttattcctatatgtcaatgcacgtgccaaaaaaattctcatatccaataaggggtgtgacggttccccataaaaaatggtacatagtaaatacaccattttctaataaataagtaactaaagggctcgaggaaaaaaatgccatacacctagttttataaaacaaaaagagagtgttagtagacaatgaaaaatctgctatatatacattagtaaaactatggctttgatgaagaatgctcctgataacaagtagaatatagcatatcgatcggtaactgaaactaagcaactgaaccaacaattaattacacggtatacagacctgcctggaaaaaaataggaaaagtaaaatatatttaccttaacatgccctgtggctaggtagatcgaatgaatatttgacatgctggaaaatgttcctcaggagtaagggatttcctactagccatcatgaccttttgttataagatgatttggtgaatcattgtacttgtccgaaattctatttggcttggcccattggctagcgtggttaccgttttcaggatgactctcattcgtataacataaacaaaatttcccaaattttgcctcatcatatttatccttggccccttcatttctgttgtggtatgtatatcaatctctacaaacatactattaggtgtagcgtcacaaacattataaaaaagatgccccctttttaactagctagggaaataagatgtgaatgtttaaagaaggggtgatatatatagaagggtaagtcgatatggaggagagccgtattgctttgtgcactgcagtactataggatcactctttaaatctcattatctctagacttcaattatttagtgcggtcagcaatgcgcgcggtggcatcaccaccagagctgcagcaaggagcaaaccggggacaaatgggaggggggatgtagaggaggccagccaggccgggtgccgcaccgagacgttgatgccttttgatgctggcgaggtcgggaggcggcatggtgaggatggaggaggcgggggactgcatagtgtgaattgcaaagggtgctacttcctgcacataaacataaaacaaaacaaaataaatagggaggcgggggactgcatagtgtgacttgcaaagggtgctacttcctgcacatgcataccaatgtcacaaaacataaaacaaaacaaaataaataggaatactgaacgaataggaaaatatttcttctttcatagaaaaacaccaagttctataatagtagtttccatcttggtaaacatgaacataaaaaggccagattctatgaataatagttcccatcacgagtagacataaaaatccttttagcattactggtaagctgataagtagggccaacactactcaacgaccatgaatagataaccaaattgcactttctttctgctacacatgatacttaattattcaaatggaataagaatcgagaaacaaaaacaatcgagaaccaaataacataacaacattatgtacttaaaagttaaccaaattgaaacctgaatagataatagaaagttaggcatcatataagcacgaaataatcaatattaataattactcatcatgttaataatcgacaacaagtgaattaaacatagtagtcatccatttattacatgtcaatcatattcatcatgcacttgccttaattgaatataacccagcatcacgccagcggcgccaaaaccccccagacctaaaagaataaaataacagtaaaaacctacttccgaactaacaatatatatgctactagctaaatactccatgtaatccctcagaacaaactagagaaatctgaaactcggaatttgaacaacccggctaaaactctatttcttaccgttaccataaattacttttaaaccagtaaactagacgaagcatttgagtacctctcagacatctatataaagttatctacaagttttgtgttatacaaaagatatacttcaatttccatcaagctcagatctaaagaaagtaatggcagtactggttttcttacaggtcaacaacactgattttcttacaggccttaacccgattgccacggcttcgtccgaactccgattatggcaatcatatattactaagcagcagaacaaacaatatgtgtcacaatgaggtgtatgcaaaaaaaaaaaaataaagaaagaaaaatctgttactcaggaaatttcttccatgagaaaaaaagagtaaagagctggataggtttttgtcagctttccttcctctttgtacagtcgttgttagctttatcactgcttaattctagttgtatcacatcaaatggtaaaaaaaaatatcgaatataataaaaagcaaaggaataatgacaatggaggaaattttatttttatgtgtcacatttgttcaatcttaagaaaatatttgcttggcacttaacactttttttagaaacacattacatacacagatgtccacaacgcacgtacagtcacctctatgaacgcacacacgcacatcgtaccttgcatatcactgaaagaataattatccgtaaatgggagcatccgtgttaaatctaaaatttgaacccgggtggattggttccaccacaaggaacctaactagttaaactatgctcacttcgcgcttcgaacttaacacttagttgactcatccatctaattaaaatatactttttattcatatgcaaagtacagctaatgaacatgtacacgcatatgagctatactcgcctatataggttcacttccgaatattcaggtgtgtctaaatagcctggtcgatctctttcatttgcagatttcatccttgattacactgggaaagtgcaccgaataccattttcaactatgctcttactatatttagtagaattgttatatgacacatggttttatttatgggagaactacgtcctcgagcctgaggtctgaatttattcataatagtactcctattgacttcggctttagtgatgaacaaatttgctttgtcgaaatccttataatgagtagcatttgctgctgccgaataaaccaactttaagatgggataagatgctcgataaggcatgaggtttaatatcataacagtttcttcgtagtaacaccaacaaatctcatccataactctttgtactttgaaaacggacatgtggatgtgttttcgtgctttgaaaaccctcgtacttaagtagacgatcggttggtatacttttcttctgagtttctttggcccactcttcttcttctttatcctaggggtatactttaacagtttgaaacttgtcataaataagattattccccgcttacctatttcttttttttaacacatttgtttcgttctagactagccatcacaccatcatcaacaaggaatcaaaagccttctcataaccaagcctcgtcctgatcttgtggtcttatgaacttaacatgcagctagccggacatctttcattgcacaaattcttagaaaaacataagtatgtacaccttgaatgccaattctggaaatatcgtgtcgtccactgcatgaacaaagcaagcaactgaagctataagcttggatggccaaattttcccagatgccccctagtcatatcaaactgagacatacactgagcttgatctctatcaatttcctatctcctgcttttattccaccatccttactttccacttactatagtttcctattatatctattcataagatgtgaaatgtttttgatgcatagtgaactggggtactcgaagtgaggtgctatatatataaaggggagaggaaatatataatgcctcgatgcattaagttcatctaggcatagaccccgctatgttcatagatggtggtggtaattacatgttaattatgctttctacatatagactttttgtagcattccttaatcacccatgtgaagaggtaaaaacagtgaccataaagttttgaaacttttatgtgacttgaaattgtatgtactatataatcaagtcaccttggaactaaatatagtggacataatagaaacactgctaaaaaaaccctcatagggactggccttataggtgctagttcatttaaaaccggcacctatagacttttttccacctccgcacgttgaaaaaaaaagaacaaatacctttataggtgtcggttcattagttaaaaccagtaccaatactatatgtgccggtttttttaaaagaactgacacatatatataatatattataggtgccgttaaataaaacaccgacatctatattatattataggtaccggttcttttaaaaaaccagcacctataccaaaccgagccggccgcctatatctactcgcgtgcgtcttttccttatccacaatcctacgcgtctcctccttgtccacaattgcgcacgtctcctcttctccgtcgtgcccttctctcccttccttccgcccccttcccc

SEQ ID NO: 59601 - DNA, 12249 bp, Oryza sativa
agcgcttacacatgttttatagttgcaaagcctaattataataatccgcaaatctccatataacaacattaaactccggatgatcatatcttggtcatacgaactctgaatcgacccgttcaagtctcctaatgtttgttataaactaaagaaccgtgtgctttctttttatgtattggttttgcttctttataggcttgtagctttgcttgtgtgcttcgcgtagcttctgttgttccggaggttctcgaagcgtggttcgcgttcgtcgccgaaggttcggaaggtcgcatctctctgagcgactctagtcacatcatccttgagcatattgaatcccagtttataaaattattttgatttaaattaatgcattaccgctttatttaaattcccgcgttatcactgttttatttagccatgcctatttacctttgttatgacattattattgctattgttattattaccttgttaaccctagaataaataaaaacccaactagtgggtactctattcatggttccactagtatgaagttaggtagatgcttcgctgattaattaggcaacattaggtggttttataactctagactttgggaatattcatatcacttggacactatggaatggttggattattgtggaattggatgcacacctccccctcttctcaaaaccctcaaaatggttttaggctgggctcggggtgcatggttttgttagtagcacctcggccacataaggaccggtcttcgggcctctgttgcaaagcactaccgtacttccacatgtctagtgggtaaggattagtttgtggctcagtctggttataaacaaaagtacacggatggagatggacgaagtcgggggtcaatggacatctctaggacaaatgaaggctacacgagctgcggcccggtagtcgagatgtcatggcacagggctggtgtcctgctgctaggggctcaattctgcctgcctgtccgggggttccggccgtaggtgggttgggttggtactcttgtctatggctaggatgggttggaaactatgtcatgtcttccgtccatatgccgtggtggtatgtggcacgtggttgcacgtgaggaagacgtctcttgtgggtaaagatgtacacatctgatcagactaaaacctattcgaatagccgcgccctcggttatgggcaagcctagcaatgtacccaagttagtgttttaaattcttaaaacctgcttaataactaaaatgtggaatggttggcctgggttggcttgggacgagctgggacccagggtcgggttgctagttcggtctgaatcatcgtaagccttgggtgaaggcaggttcgtgtgggttcacggccttgattaataatactgtgtagctctaggatcgtctttataaaatggctttgggcaactaagtgacttttaaatgctgtttactgcaaaacttaacccctatattattatcccctgtactcccttgcattaattatgcatctccggtgtggcttgctgagtactgtggttggactcattcttgctcaatcttttccccccttcagtaagagaagctttggagaagaagtcttaggtggagtcctggcttataccctagttgagcgccatgaagatggagccgtaggcccgctagtccgctgctgtttatttttgattgtcaggcctgaagtgcctttgtaataatgtaaatattatcgatataataaagatgtgtcttttatatcatgtttgtgtggtgtaccccggcttttcctgggacggggattaatacactagcgtttgggaaaaggcaattttctcggtcgcgacacacaacaagaatcttggagatattcttgccttggagtatgattggaatgaggaggtcattgcacagttctatgcaacagcattctttggtactacaaggaagggaaccccatatgtgaagtggttgactgagggtgttaggcacaagatttccatggcacagtttgctgagatgctggggttagatgaagaggatctcaataggcccaacattcatagtgaagcacccctccccatgatcaagaccatgttcatgtatgcaaaggatgctcctaggacttgcatgggatctactcatggtttgcatcccaactataaggtgttgtattccatctttcgttggtccttgcttccaaaggttggagatgctactgctttgtcatccaagcatgctcatcttctcagtcgcatacgctaccatcagcctcccttcagtgtgatgaagttgatttggtatgagatagccaacaccattcttgagcctaagcggggttgcatctatgctcctttcattatgaagatgattgagacagtcaccagggtgttctacatcaaagatgggcgccacaatccttttcgccctcgtgctccaccttcctcttctccagtgctacctagatctgttccttctacttcagctggtctttcttctagtgcctcaccaagttcctcgagttcttctcccatcaagaaggcacttcaggcaatcttctgtatgtgtgctaagactgccaagaaagtgaagaagatagaaaggcgtcagaaggaagatagaagagaggctagcaaagaagtgtcagatgattctgaggatgaggtctatgttgatccattggaggcttatgaggcagcccgcaacgttgctggtgaaggtccttccacctacttcaatgaagaatcttctcattctgatgatgatgataatgatgatgatggtgatgagggtgacaccgaggcagctgctgaggatgctcccactgatgttgatgagggtgataccgctgctcagtccgatgagtctcatctttccggcgataccgagattgttccctctgatggagatgaagatgagtgatcctcttcctctcatagtttctcgctttttggtgtcttgatgccaaagggggagaaattgtgaattgaagggggtcatttaaatccttttgctaccttgactattgtctggtcatttggccggaagctccgggtcctgtgatccagaggttccggccaggcagatttcctctctattatctctctctatatggacatgtaatcgtattctattatggttggatgtaatgactattagatgctttattttcgtttatgtcagtaagttagaccatatggatgttgcattttgatgtgatgttgtgttcttttcatctttttgagtgattggcttgtcatctagtctttctttttgcatcactcatcattcaagcacttttatctacatctcttatttgatgaggatagtgtgaagtttcttttgagctttccttcatcttatgcataatgtattcatttcaagttcattatatgcatatctttagggggagcttcacacttctctcatcattctaaatttaaatcctattatttttttgtgtactttaaccatgttgtcatcaatcaccaaaaaggggagattgaagatgcacttaaaccccctagtgggttttggtgattaatgacaaggtggttaaaggggactaacatgtttatcaagtttattcacaggagtttagtcccaaagcaagttgtgatggttaagaatgcaaggagaccccccaattcgaatgttcctaagtgcgaaaatcaccgtaggtgattagactaggtttttcactttcgaaattgagtttaggaaaaaccgtactattaagaggggtttcaagtgtggttctatggtatacaaagtgctcttagtcatatccatgagtcaaaagatttttggaatcatttttgaaaaatgattttctccccaggacagagagggctacccggaggttctggccgaaacttccgggcgccgtttaattgcaaaaattttcctaagtgctgcccggaagttcctggcacttttgcccggaacctcatggcaggtttccagttcaaacatgtgagtaacggctagatgacgtcacctagcggttatatatatggatttcatccccaggtcaccctttttccattccacttcagttctttcatgttctagggttttctagctactcccaagcttcctttgcttcctccactcaaatctagagcctatcttgtgagattgggaaattagatgagagtgtaggagtgttttggagatggcttgaagattaggtttgattgagcactttggtgtcacgtcctgataaattcatcccaaaattaaaattcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagaagtccttttccccccctcccttcttgggccggctcggcccagtccctccctctctctctcttcccccgcggcccatcggcctcccgcgcgcgcgcgccgctgacaggcgggcccgcccgccgccctcgctgacgggtgggtcccacctgtcgtcttcctcctcgcgccgcgccgccgctcgcccgtgccctagcgccgccgccgccgcggatttcgccgcatcccgccgtccccgcgcgcattaaagagggggaaaatcacccccgtgattccctctcccgtttccccctcttttccctcttctctccctcggattcgttcgaatcgcgcccgcaatcctcgccggcgcaatcaatggcggccgagatctccgggcccgtttcctccctctccggccgcgctctccccctctcggcgctatataatcgttccccgagctccgctcttccgtttccgccgcttgccgctcgctctcgccttcggattcgtgctcgcgacgttctcctctctctccgccgtcgccgccgaccttcggttagccgccgtcgtcgctccggtcttcctcccgactcggcgccacctccatcggcttcgccgcgttgtcgccgaccccgtccgccccttcgcttcgcccgccgaccgccggagctccgtcgccttcgtcgtcccgaaccgcgccgccgcgttcctccgctccggcagtcgtttccgccgtcctcgttgtcccggggtgagccgtggaccgtccctctcgcttccctctcctctccgctctctcgggcgccgctccgccgcgccggtggtcgccgacggtgaccatcggggcgcgggcgcgcgtctcccgtcggtcgagccggcgaggccgccttcggccgcctcccgcggctgccaggtggggcccggccgtcagccgcccgcgcccgcgggtgcggctgacgcgtgggacccacggcgccggccgccgccagccgcgtgcacccggtccaccgtggaccgagaggctgacgcgtgggccccactcccgtggacccggtccgcgcgcccttctccctcggctgacgcaataaatgggtttttaattaaaatttaaatgaagaaattcgtaaatatccatttaaagagcatataaacttcaaatggccataacttggccatttgaactcggaattggaccgttcaagtctctaatttttccttaagaagtcaagaacccatttttgtgctttgtttctgctgttatgtggagtttattagcgtaaaagccttttcttttccgtcggtcgtgtagacgctgcagcttcggaagatccgctcttcgtggaagttgaagccggcatttgggaaagcgagcaaggcaagtcacatcatccttgagcatattgaatcccagtttacaaaattatttttaatttaaattaatgcattatcgctttatttaaattcccgcgttatcactgttttatttagccatgcctatttacctttgttatgaccttattattattgctattgttattatttccttgttcaccctagagtaaacaaaaccccaactagtggacactctactcatggcaccactagtttaattttaggtagatgcttcgcaatttaattaggcaacattaggtaattttataactttagactttgggaattttcatatcacctggacactatggaatggtttggttattgtggaattggcttcacaccgctccttctattcaaaatccccaaattggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggattggagatggatgaagtcgggggtcgatggacattctccagggcaaatgaaggctacacgagctgcggcccggtagtcgagatgtcatggcagagggttggtgccctgctgcttggggctcagtcctgcctgcctgtcccgggggttccggccgtaggcaggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgtttcaaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgtttaataatactgtgtagctctaggatcgtctttataaaatggctttgggcaactaagtgacttttaaaggctgttactgcaaaactcaacccctatattattatccccttgtactcccttgcattaattatgcatctccggtgtggcttgctgagtactgtggttgtactcattcttgctctatctttctccccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttaaaaatgaaactatttgcgaaagtccctttttcctcctttcccctgtgctatttgcaaagtgtttattcccttttcttccttcttcaaatttcaactagtactagatggtcagctttgcgaagaagaagatgtcgtcagttgtttgccgaagctccggaagactgcaggatccgctagcgaagcgaaggaagaagtgaagccagctgtgaaggagtgaagatcttgggaacccgtcgcagaacctaagccaccctgtagggtagtgttgttagtcgtgtgttccttgcttgtgtgtgtagcgcgtggtttgcatcggtgggttgtgatgtaaccatgctaggttgattgcttaatcaacttgcagaataagtgaaacaaacaacacatcagcaagaagagttagttcctttaaggtcctgtctctagttctggtctattctttcctggcttgtttcctctctcacctcaatccctgtaacagatgtttaacagagaaaaaggaaagaatgtcagcgggtatgcctcaagtaactcaagttttcaactcaatccaccactggcctcaagagagttaaccagggcacacccttggtccattccaagcatgccgcttagttcacagctaccattggttggaagtcaagaccaaaatcagtatgtgtttgatcgagcatttgccacccaggtcaatgagcttccaatgccagaagaggatgtccccttttgtcacgattgtagagaacaaggacactatgccctgaattgtccatgggtatatgccaaagaagccccttcctttggtttagcagggcagacatcgctaaaccagcctcctcacaccaagacaagcttgcagcctagtgtgcaaagcagagagcccaatgaagagaatccattgaatcctgggaattgctctcctcctagcctttcgtaccacgtggggtcacgtactaagcacgccaaaggcaagaagagtaagaatcagaagagaaaagcgccgatgcgaactgaagaagaagtacgtaagatgactattaccagcaccgaatggtctacagcagggataactattcctagacgtcaatgaggaaataccttccgaggtgcacgacagttgacccagcacctcctaagccatggtggcagagtatctgatagtgaagggtcagatcaagtctcctcggattatgaagatgagtcccccccacatctcggcgaggaagagatggaatcaaaagcatgcccccgttgtggagaaattggacacattgctagcatgtgtctcacactctgccctcattgtgaagaagaccatccaccaggggagtgtcccacccgcaaggtcacatgttttctatgcgaaggtacaaaccatgtgcccaaggattgccaactcagtgtgttgttgaccaagaccgcagaaatccaacgaacgaccctacgattgtctcgtcagctagtcagctccaacagcaatatcgacgatatcatccacagcaccaatgctcctcctgctgcacctgactctgcaataaatcatagcaataataccttcagcaccaaccattctcggcaccgacagcctcagcaatgaattgtcgtcgatggaagaagttgtttctctccccgacctactccaggccgagcgaagggaaatcaacatcaggagggtgataccaagcagaagaccgttacccacttcaaccagcaatcagaaggaatttttctcctgtgaatgatagcaatacgcagtcctaccacatcatcacagaaccaatcaaggatgcagtcactaggacaatgccagctatatctctcctgaatcaaaatgagcagccccgtttgtggttttcagttcgctacttatcattgtgtaatagaaagtttgcagcaatcatgtaataaataaatatattcatgactataaaacagtgagcttgctatgtttatggatgattcctgttgaggatacaatgtaccgatgttaagcaccttccctttttgtttaagacagtgccttgtattcatgtaaaatgggagaaatttgtaataaaaacaagttctaagaggattctttcggaagatgctgatatgggattatgtgtttactgtcaaaggagacctagggtctcatttcaaaggaactatgttccaacctcgagttaataaccaacctgatgatagaaaagaaaatgccgagtccgggaagatatctgttgcttcaattgtcaaggaatgggtcatttcgccgacaagtgccccagaccgagaaacatagctgccagcacgtcagtccacgcaactccttgcaatcagaagcttgctcctcagcgaattgtcatccatgcatcccgaagcagtcctatagaccgcgttgcaacagctccaactccagcgagtgcattaccacaagttgtcaatgctcaatttcagccccagccatcagttgacaagacagaggccagtatcggcattgtacctttggatgttccagcacagcagccaaagaaatcaagtacaagatgaagaacccgagcgtaagaaagttattgtctgttacaaactgtagtacctgttaaggaagcagacatgccaatcgccaagtggtcactggagcaaatacagtacctgataagcctagcgctagtcagaagcaaccataatactcttatatcagtgttcaaatacttttgttttatagttgttccccgtcaatcatgtaataacagagaaacatgagataatgaatgagtttgataagcttatgaaggatccatgttaagagtgcaagtgctgtgagttgtgcacattttgttgttgattagggagacctagggtctcatttccgtaaacccaaaatctgttaggaatcaaatagtctagcgattgatggcgaagaaaatcaagtgatcaaccaaagaggcatttgtttggactaagagtttcagatgtgtctcttcggatcaaaggcaacaatcgtcagtctagtctttgacgaaccacatcaaggtttcacggaaaggcagcaagccaaaggacctcatcgtccccagaagcgtccgcaatccacatcaaagaataccacctgttagagataagccggaagatgattgataaaagagattggcaaagatgttctccagcatgaaagaagtaggccgaaaggtgattgataaacagaaacatgctctgcaccgctcaaggaagacccctgattgtaattgccccgcagcagtcaccttgtcattaagtaagcaagatgacctaggtaaaagtgtttttatgaaggcaaagagtgaaatcttcaactcggtatcagatgctacacggagtgaaaagtgcaagcaccggttaccaggcaatgccatgacttgggagatgatccaatgggaaagaacacatcaaggttaaaggtgtaaaggaatacgttgaatgctaactgaggacaacctgaagataataaggggaagtaaactgaatgtaaagaaagtgaatccgagttgcttgttcgtgagggctattcccagttatgaatcaagtgatatgttcgaagataatctacagaggtcagattaaaagcacatctaacaacgaagcctcagatttgacagggtaatgattagacaataacaaatccagcaataaagccattggagaagacgtcaaagtatgtcaagtgggataaattggttctcttgggaagcataacttatagttagagtggttgacccttgcatcgaatagccgaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactgaactaccgcaacctagtctgagtcagccaaaaggtgcaccctggtccaagtcaggtgaagagaagattccatctgcaacaggagatcgagccaagcagtccagagtgaagaagtttgttaggcaagtttgttatagaagacggagcggaagaagtcagacaagaagagaagaccgcccaacctatcttcttgctagcctcctcgaatctcggggacgagattcttgtaaggggggtggatttgtcacgtcctgataaattcatcccaaaattaaaattcattctctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttgaaaaggttttataaaaagaaaaatccctaaaagaagtccttttccccccctcccttcttgggccggctcggcccagtccctccctctctctctcttcccccgcggcccatcggcctcccgcgcgcgcgcgccgctgacaggcgggcccgcccgccgccctcgctgacgggtgggtcccacctgtcgtcttcctcctcgcgccgcgccgccgctcgcccgtgccctagcgccgccgccgccgcggatttcgccgcatcccgccgtccccgcgcgcattaaagagggggaaaatcacccccgtgattccctctcccgtttccccctcttttccctctctctctccctcggattcgttcgaatcgcgcccgcaatcctcgccggcgca

SEQ ID NO: 59602 - DNA, 9840 bp, Oryza sativa
gctagggtcaatcgtcagccgtgaaagggggttgcccatccaactgatcgtaagcctcgtcagtcttgtccccaactccgacgatttttgttttgcctgggagaaccacttgacgcttagctcatcaggccctctacccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgtgatcgacccagacggtccctgtcacaccctgaaaattcaaaatatataaattgttgtttaaatggaatttctagaatttattttaaaagtcttgaaaagaaaatctaagtttaattaataaattccaatataaaattgggccagataaaatttcattaaatactttgcttaattctataattcctagatttttctgggatttatttgagttaagaaagtatttttaataaatggaattgcatttaagaaataattttaattgaaaaaggttttaaaaagtcttcttttggctttgggccgaaagtcggcccaaaaccgttctctctctcctcggcccagtccggcccagtccgcagccgcgcgcgcgccctcgctgtcgctgacaggtgggtcccgcttgtcagtcgtcgtcttcctcgggccgaaaccctagtttcgcgccgccgagctgccgtcgccgccgctttccaaatccggccgttcctttccttctccggccgaatcaatagaggggaaatgatctccgggatctcctctaccttttctcctttggaatctttggttaaatcgctttggaaagctttggaatcgagttcgattcggatcggttttccctctctccaagccgaaggtttccttcgccgttgccgtcgccgtgggcctttgccgccgcctccgagcccctttaaaaggacccccggtgtctcctctacccgtcgccaccctcgccttcgcctctcgtcgccggagtagccctagcgccgtgtgccctagctttgccttcgccgccgccgcttcagccgtgctccgccgtcgctccagctgtcgccgccgctcgggaagaccgccgtcgtcatcgccaagtcgccgccgtcctcgtccgccccttcgcagccgtcggaacccgccggagcttcgtcgccgtcgacaacccgaaggtagccctaaaccctaaaccctaaaccctaaaccctaaaccctaaccaagtcgccgccgtcctcgtccgccccttcgcagccgtcggaacccgttccttctcgtcgccgtcgtcgtccgttccttctccgccgccgttttggtcaccggtgtgttcgccgcgttgtcctctacgtgctggtgccctccgttggtgccgtggtgccgccgttcgccggcgagtgtccgccgcccgagccgtcttcttcgccgagccgccgccgtcgttggtgatgtcatcgttgacgtcatcgggatcctctcccgtgagccggtcgtggaccgatcgatctcggccgtccgatttggatcggaacaatctcagccgtccgttcgtgtgaaccgccgcccgtgcgccggtccaccaaaccctagcccgctgacgcaataaatccccttttccttttcaaaaataattcattattgcgtcataattcaatttaaaccgatttaagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgcttctttttgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatctattttcgaatgtcattgggtggaattgacctattctttgttatggcccttttgtacattgattaccttattccttgataccttgggttattacaatttgactagttgagctttatttatattggttcaactagatattagatataattgcttagccctgcttagaaacattagtacacttatgggataactaatgattcactattatttcatgatggcttattgatagttcacgatggtcaatcgtgattagttaattaattaatgtgccaactaaaacctggtaatggttggttgtgagcacatggttttgatggtcgtgctcatgacaattaaggaccggttcacgagtttcggttgtgaaacatttatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcaatggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtctcacacctctcatcataataaaagatgcttaatctggtaataatttgtttagctcctggtttggaatggtacattcctggtttggagatagaactgtgcagccgggatggttgttcagaatggttgggcctatacaacagggtatgttgtatagcgttggattaatattgtttaattacttaactgttttatcaaattctcaaatgtttgctaaatgctgcttttgcaaatgcaaccctattatgccatcctttgttatcttgtgcacttgcatatttgctgcgtggcttgctgagtatgtcatatactcaccttgcaatcattcatcagaggaagagttctacaatgaggctgatggtgtggaggattaggtgtagccttggtcaagctgcctgtggagtggagccgtctgcgccgtttatttaatttccgctgcttagaactttattgattgagaggaactatctacctctgtaatgacattttattcgcttattaattagagtaatatttgtactctattatcaatttgttattgtgtgcctcggctgattcctggacgagggttcacacacatgtaagcgtttggaattttggatagaaattccgggcgtgacaagttggtatcagagcctctttgaccctaggttatgccaaatggttacccatagaagccctctgaaaaatattggaaaagtagaactgttctcctccctttctcttttaattaaaccaaactaatggcacatgcacttcataatctcttttaatggttctcattcaaaatttattccagtgttattagtactgtacatctattactgtactaatggctcatttaccagcaaaagttttacaatactgttttatttaatcttgctgcaataaaataaatttagtatgttgattttataactttcttttgaaaccagttattcaaaattacaaaatttgtgacctcgtttccaactattttaatttatttcgcaaagcttggtttactttatttacttacctttttactctgattttctaactttattcaaattaatccaaaaacttgtgctattaattggataaaggtcttaactccctcctttcacttgtctttagatgccgcgttacaagcctgagtacctgtttggtgttgagggttttgtccaggagttgcgcacgatgtcctttgtcattggatttgggactgcccctttttatgcccagattcctcatgaccgtcatgaagagaagtgccgagtcaaagtcaccttgaacagcaatagtgaagaggtcccctcagtgatgtttgaagctggaggaagaaattacatccatgcatgtcaggaagtggcaaggatcgccataggagagctccgtgatcgctacagtgatcaattggccgacactgagtatcgctaccatcctcgccaaccccagggaagtgaccgtggcagttaccttgagactgaaggaattgagaatgatgttaccacgaaacatttggttgagatgttgtgggctatggatgaaagtcgtgcggagactgtgttagcagctcaagatcgtgaagatcggaatcgtggtaagatttgcaagctagaagacaaggtggatcgtttggagaaggaattagccgcattgaagggagaagcaccgccgcagaaggcctggattcgtcttaccgcaaggaagagagctctatttgtccctcgctatcaattggcgccaaaggttcgtgtggtggagaaagaagttgctccagctcaagcggatcctccggtcatcatcataagtagtgatgaagaagaagaatccaagcgcatcaattccaagattgagtgggtagcaactcaagatgatgaagacgagccctcaatcgacctccgatgcttggaagaactagagtgacttgttaagtcgttgtcttagatcgatgtgttagtttgcttgttttaagtttgcttgtgtgtgtgtggctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctgtcctaagtagttcccccgttttctcttcttgtgccctgtccatgccagatggtgaacactcgtagcaatgggaatggtcccaacaaccccaataacaacaacaatggagagaatcccactctggcccaagttcttgctcaacagactcagcttatgaacatgatgatgcagcaatttcagaatcagcaaaaccaagggaataatcatgcacctccacagaacaagttagcagaatttcttcgtgtaaggccgcctgttttctctagtaccactaatcctgttgaagctagtgattggctgcatgccatagagaagaagttggatttacttcagtgtactgatcaggagaaggtctcatttgcatcacatcagttgcatggccctgcctctgaatggtgggatcacttccgccttaacaggactactgatgaacctatcacttggcttgaattcaccgctgctttccgaaagacgcatataccatcgggagtagtgtctctcaagaagaaggagttcaggtcgcttactcagggatctcgctctgttacggagtatctgcacgagttcaatcgtcttgctcgttatgctccggaagatgtgcgcaatgatgaagagcgccaggagaagtttttgggaggacttaatgatgagctttcttacccactcatggttggagattatcctgatttccagaaattagtggataaggctattcgtcaggaggacaagtataatcgcatggagcagaagaaacgtcggattgctcaattcaagacacaacagggaaataatcagaagccgcgtcttactttaggaccccagcccatgtcacagggaggttcttcgtctgttgttcgtccgcagcgtcagttcttcaacaacaatgctggcaacaacatccgtaatcaagctccacgtcctgttgcagctccagcacagcaacaacctgccaagagggagcaaggcaacaagcccgtggtgtgtttcaactgtggagatccaggacattatgctgacaagtgtccgaagccccgacgcgtgaaggttgtccctacccagaataactctgctgtaccagcatcaaaggctcgtgtaaatcatgtcgctgctgcagaagctcaagatgctccagatgtgattttgggtacgttccttgttaactcagttcctgcaacagtacttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcaaggagtaccatttctggccaatcttatcttgttaaaatccaaagaccttgatgtcatcctagggatggactggttagccagacataaaggtgtgatagactgtgccaacaaaaaagtaactctcaacaggctatgatggtcgagttgtaactgttcatgcattgtcatctgagtctttaaggtcaagactgaaccagataactttggaagagattcctatagtccgggagtatcctgatgtgttcccagatgatttacctggtatgccgcctaaaagggatatagagttcagaatagatttggtacctggaacaactccgatccataagagaccttatcgaatggcagccaatgagttggcagaagttaagaggcaagtagatgatttgctacagaaaggatacatcagaccgagttcatcaccatggggagctccggttatttttgtggaaaagaaagaccatactcagagaatgtgtgtggactatcgtgcactaaacgatgtgactattaagaataagtatccactacccaggattgatgatttgtttgatcaacttaaaggtgccactgttttctccaagatagatcttcgatcagggtatcatcagttgagaatcaaagaggaagatatacctaagacagcttttaccactaggtatgggttgttcgaatgtaccgttatgtcttttggacttaccaatgcccctgctttcttcatgaatttgatgaataaggtgtttatggaatacctagacaagttcgtggtggtctttattgatgatattcttatctactctcgaaccaaagaagagcatgaggaacatcttcgtcttgcattggagaagctacgagaacatcaactgtatgctaagtttagcaagtgtgaattttggttgtccgaagtgaaattccttggtcacgtcatctcagccggaggagttgccgtcgatcctagtaacgtggaatccgtaaccaattggaagcaaccaaagacagtttcagagattcgcagtttcctaggccttgcaggatattatcggaggtttatagagaatttttccaagattgctaagcccatgacacgactgcttcagaaagatgtgaagtacaagtggtcggaagaatgtgagcggagttttcaagagttgaaaagtcgcttaatatccgctcctattttgattttgcctgatccaaagaagggttttcaagtgtattgtgatgcatccaaacttgggttaggttgtgttctgatgcaagatgggaaggtggttgcctatgcctctcgacagttacgtccgcatgagaagaactaccctactcatgatattgagttagctgcagtcgttcatgcattgaagatttggcgtcattatcttttcggtactcgtacagaagtgtacaccgatcacaagagtttaaagtatatctttactcagccggatctgaacatgagacaacggagatggttggaattaattaaggattatgacatgggaattcattatcatccgggaaaggctaatgttgtagcagacgctcttagcagaaaaggctattgcaatgctacagaaggacgacagttgccattggaattatgcaaggaatttgaaagattaaatttgggaattgtcggtagaggtttcgttgcaaccttaaaagccaagcccactctaattgatcaagttagagaagcccaaattaatgatcctgatattcaaaagatcaagaagaatatgagaagaggaaaagctattggtttcttggacgatgagcacggaactgtatggttgggtgagagaatctgtgtccccgacaacaaagatttaaaggatgcaattctgaaagaagctcatgatactttatactccattcatcctggtagtactaagatgtaccaggatcttaaggaaagattttggtgggcaagtatgaagcgtgaaatcgcagaatacgtagcagtatgtgatgtttgtcagcgagtcaaggcagaacatcagaaacccgccggtttgttgcaacctttgaagattcctgaatggaaatgggaagaaattggtatggattttattactggtttacccagaacgtcatcaggccatgactctatttgggtgatagtcgacagacttaccaaagtggctcatttcattccggtaaagacaacttattccggaagtcgcttagcagaattgtatatggcaaggattgtgtgtttgcatggcgtccctaagaagatagtgtctgatcgaggcagtcagtttacttcaaatttttggaagaaacttcaggaagagatgggttctaagctgaactttagtactgcttatcatccgcagacagatggacaaaccgaaagggtgaatcaaattttggaagacatgttgagagcttgtgctctagatttcggtggaagttgggataagaatctaccctatgcagaattttcgtacaacaacagttatcaagctagtctacagatggctccgtacgaagcactgtatggtcggaagtgccgcactccgcttttgtgggatcaaacgggagaacgtcaggttttcggaacggatatcctaagggaagcagaagaaaaggtaaagatcattcaagaaagattgcgtgtggctcagtctcgtcataagagttatgccgacaatcgccgcagagatttgagttttgaagagggagattatgtgtatcttcgtgtcacgccttttcgaggagttcatcgttttcgtaccaaaggaaaattggcaccgcgttttgtgggaccttataagattgtcagtagaagaggagaggttgcttatcagttggagttacctcaatctttggcaggagtacataatgtgttccatgtgtcgcaattgaaaaagtgtttaagggtacctaccgaagaagctaatattgagcagatagaagtccaagaagatttgacttatgttgagaaaccaatccgtatcctggaaacaagtgagagaagaaccaggaatcgagttatccgtttttgcaaagtccaatggagtaatcactcggaagaagaatcaacttgggaacgagaagatgaattggagtcagctcatccgcaattgttcgccagttcttccgaatctcgaggacgagattctgtttaaggggggtaggtttgtcacaccctgaaaattcaaaatttataaattgttgtttaaatggaatttttagaaataattttaaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataattttaattgaaaaaagttttaaaa

SEQ ID NO: 59603 - DNA, 10916 bp, Oryza sativa
cccgcagccgagcgccgcccgcgcgcgcgcgtcccgctcgctgacaggtggggcccacctgtcagtcttcgtcttcctcgcgcagctgccacgcccgaaccctaaccgagccgcgccgccgtctcgttccaaattcgttcatccctttccttttccggtgaaattaatagaggggaaatgatccccgagatctcctctatcttttcacttttggaatcgtcggctaaatcgtttggaaatcggtggattcgatctcgaatcggattcctctctctctccgaaccctaacctttccatcaccgccgccggccgccgtgggccttcgccgcggccccctagcccctataaaaggacccccggtgtctcctctacccgccgccaccctcgccttcgtctctcgccgccggtagagctctagcgccgtgtagcctagcgccgccgttgccgcagttcgtccagccttgcgccgtcgccgctccggtcgtcgtcgtcgctcgggaaggccgccatcgtgatcgtcaagtcgtcgccgacctcgtccacccctccgtcgtctctgtaggtcgccgaagcaccgccgtcgtcgtcaagccgaaggacgccgccgcttcttcctcgacgccgtcgccgtccgttgatcttccgccgctactttggtcaccggtgagttcgccgtgtcgcccgcaacccgtaggtgccgtccgttcgcgccgccgcgccgtcgttcgccggcgagcatgcgccgtccgagccgtcgccggtgatgacgtcaccgctgacatcatcgacgccatccgccgtagaccggtcgtagaccgtttagatctcggccgtctgatttggatagatcgatcccggccgttcgtttccgtgagccgccgccgtgaaccctagccgctgacgcaataatctctttttccttttcaaaaataattcattattgcgtcataattcaattaaaatccatataaatgatttaatccgatttaatctttgaaaattcataactaatttatcttagctcggattttgttggttcaagtctctaaatttttctaaaattgagatctacatgttaaaaatatccacatgtactgttcatgcttgtttaagtgttgttttggtgattttgttcttttctctttagattccgacgttcccggagagtccgattttacaggggaagattttgaagagtttcaaggccagcaaggcaagtcacacagatcccaaacaaccctttgagcatgttgatcatgtttaaagctattgtttttattcaactactgcatttatttttgaatgtcattgggtggaaataacctattgttttgttatagccctttttgttcttgattaccctattctttgataccttgggttattataacttgactagttgagctttatacattggttcagctagatattagatataattgcacactagtgggataacttatgcttcactattatttaatgatggcttaatgatagctcatgatggttaatcatgattggttaagtaattaatttgccaactaaaacctgataatggtgggttgtgagcatatggttttgatggttgtgctcatgacaattaaggaccggttcacgattttcggttgtgaaacatttaccgtgccatccacaaaccagcgtgggcaacggctttactttctgtatagtatggttcatagtagagcaccagactgtgaagtggcggagataagcccaccggggtcgctggggagtccataccttgtttataagggggtgattatgatccgggaacggtgcactgctttgaattgtgttatgcaggaggtattgtcacaatctctattcgggtacttgttaagtatcgcgacgcatggttgacatgatgttgaggttgtgtcttgtgggtacagtggtacacctctggctagagtttaaactattcgaatagccgtacccgcggttatgggcgggtctaacaatgtctttcgtgattagtttcacacctctcaccgtaataaataatgttgtaattggtaataacttgtttagctcctggtttggaatggtatattcctggtttggagatagaactgtgcagccgggattggttgttcagaatggttgggcctatgcaacacgggtgtgttgtatagtgttgatttaatattgtttaattactcaactgttttactattttctcaattgcttattaaatgctgtttatgcaaatgagactatactatgccatcctttgttatcctgtgcacttgcatatttgctgcgtggcttgctgagtatgtcatatactcaccttgcaatcattcatcagaggaggagttctacagtgatgctaatggtgtggatgattaggtgtagccctggtcaagctacctgtgaagaggagtcgcctgcgctgtttcttttattttccgctgctcagaactttattgattgagaggaactatctacctctgtaatgacattttattcgcttattaattagagtaataattgtactctattatcaatttgttattgtgtgcctcggctgattcctggacgagggtttacatacatgtaagcgtttagaattttggatagaaattccgggcgtgacaactcactggcagcacctctggccagctggccgccagcgaaaactattttttgtagtagtcacaacagttcagattggttcactagctcaggatagctcatctgtaataggcgggaagccttatctgtgtcggcgaggggtactgtcacgaaccaaaggttattaatgtgaaaagtcatatgtgtcgggtcagccaccatcacggacgaccgtcatccttatcgggcctaaataaaagacccaaactcatctatgacgggtcatagttaagacccgtcacggataagagttatccgtgatgtttcaagctcctacttccaagaactgacttttttgtccccaagagtgatgtctggcttgccgccgatctcgaccgggtcgctgccattgacttgtctacggctatgttccgagctttgagtgacaacatcaggtgttggcgtcagaacccgacatcgtcaatagcctcgtgcgtcgtcttaccggtggtaagccctttttctcatttatactttgtttggcccaaattcttactcgcaaaatgacgctttattgcctgctgccggtttactggatatgatgcaatgctcactaacattctaccttcctgcacagttattatatcttgacaacatactcccaccaacagacgttggtctcgatctagtgttcacccctcgtatacacgtgtatactaaggagattgtcgatcggctggttagtgcggatcaggaagctggaggggatggcacgcccccgttttgcaacctccctgtaagtgtttcacattccttcttccccattttcctttccattaataaaaattcatgtgctcacatacactggggccggcgtacgcgggtatttttaatgatcactaaatttgtacactaaaacccaatcataaagttatcatgagggctcctgaacaatgcacttgcattttcatttctatatagctttcaatgcacccctattatcgtatattcgttggtaatcctgcatatacatttttttttactaacgcgctgtttgtacctcacagctgcgaccgttggagagcacttgctatgctatcaagcaacccggcaaggggaaggggccaatggttgaagccatcagggcgccggcgtacaccttcccaaatatgtctgccatcatctggccacacctaggtgggttgcctaatgaacagaggagtagcttgcaagaatccattgccgagtacgacaggcaggcgaaagagagtgcagtggagatcgagcgccatttcaggatagttgttgacaagcagcatatgctatgtcagcgtgtaattgatgcgccacaagcaaacagagcagcagcaccccaacccattgtgcctcagcccgcccgatgccaagaagtcaaccggaggcaaagcaacgtgcaacccaccggcgccgaaaccaatcccaatgaagaggatgagcagcagcaatagcagctgcagcagcatgggtgcgtcgctaaaccgagtttgcttgatcaacacacagatcaccctaacgatcccacgcaagtgagccggcccatgcatgcaaattgtgccctacgtacctcctgtgcgtcatgatgcagcagatcaggcccagtcttggattgctgactcaccggttctgacacagcgcacaccacccccacggacagcgcacccctcacaactgaggaagttgccgctcaagatccaaggcgccagacaccgtggaagacacactaggcgtcgaggctgtgtgtgcgattggtattgatccagttgcttcaaccggcattcatatggaacatgctactagtgccggtgaacaacaatctcacccgacggaggaaacaactgagctgccccacgccgaagataccacgcgatgtaaggagaattagttacccattatatcgttatacatacatcagcaaagtgatatccttgtagtacatttcattacttcgcagcctcgcaatttctttccgtcacgccgtcaccgtcatttgttctaccgccggacacggacatgatcgacacacaagtgaacgagaaaatcaaggagatttgcaggctcgagggggctcctacattctccgtggttgtattctcaaacatcccattcgtcgagttcacttgtgcttcattgcatcaaatcatattctcgtagtttgggtttcctctggacacatttttttttgtcatcaacttgagcatgagcacttagggattgtctgcttggtcaaacagtacgcaccaaaagtttaattctgaggcaatatgtgaggtgttttctccagttgcaaactgcagtaagatagtcatttattaacttcactgatcaaggaaccactaagctagtggttcaaataaacaacctcactggaaatggatgagaaatcaagaaaatatcattatgagtaaaatttgaactaaactctttagttcattatttttgttaggatcatcacaaacttttatctgctatagcacaatctaccaaaaattaaaggaaaaaattaactaataccaggaaaactctgtactatacttatcacaatgacacagctggtagttatcttttaactgcaaaccttttcttacccaagtttacaactatctgtccttttgctacatatcaaaggagcagtcaactcttatattgtgctgtgctttgatggttcatacagcgatacacaggtagatggcagttaaaattatactttgtccgatcgtcctctactttcggttaacattttttccccttacacaattattgtgtttttttggcagcttttgcccgagaccatgcctgacaccaacgacgtaaattcaacgccatggtctctgccaaagcggttcatacaagagccggcaatatttgtttcgccggtggttgttggccccggtatgccgtcatcggacgtgtcgcttagcatccagctcaggcacttcttactgaccaatggtggtcgtatggacaggttggtgttcatcatcaccttgatgatgtgcatatggtgcatcatattttttcgcggaccaccttttttttccttgcttagattacgggtttacatgttaatatttctggtatgcttgcagcgtgaaactgctagagatcgacagctctgttgcgtatggaaacaatgtgctggaatcgttctccgacgggagcctgacagaggagcttttcatagacgtgttcagctcgattctattcaaggatgacatgaagtacaggctagataattatggaaaaaggattttcattccgacttccatatcagtaacgtgaataacgccaatttctactgtattcctttttttcgtacggtgcagcaacatgattgtttttctgttcttttttttcgcgagatgtgactcttttggttcacaccaacacatggccacacttttttttttttgcagtttctcctgaacattgattttatcaaacaaaatggaaagatacaaattttccactgatgctttggccggaaacttgcgcgactacatccagcattggttagttattaatttttgcataaagactaatgccatgtctacttttttcccctgcatcgagcatcttttaaacccagcaatgctattgtaagtttcgtttctttacttccaaacactgaatggacagataatggttcctgtgctccaccactatcactggtctctagatgcaatcaacattgcacacaggctggttgacataatggatacaaacaactacactttgctcggaacactggtaagcgaccaccatggtgcgttggccaaacgcatcgtcaagcgtctgagcgatgcgctgcaggcggtagtgccgaagagcttctgcaggttcggcggctttaggaagaacatgatggagtgcccaaaaatacaaatttgctccatcgactgcgccttctatatcatgcggttcatggaggcttacgacggcaacatggaatccatcgagaatctttccatcccggtaactatagcaatcacccccttacatttgtatactgactcattcgtcgttcatttccacactattctataccaattcacgtccaacatgtgttttgcagactgactcggtgattgtccggtcaagcaccctgcaccagctgatgttcagcgagtacaaccaagccgcgcctctccattccgatatctagaagttccgcggaactgatgttatcgatcctgcggcctaaaaaaacagtcatgctttacctttttggaaaaactttttcattgggatacatgatgtctttaccatagcttagaactagtgtggtctcactatatatgtttcttttggtgtttgtcactgtacatttcgaatggtactggttagtgtgatgaccccttatagaatgtcaaggttggtgcatatcctgacatgtgtttttgctcggcatgcattatgactattggtacctgtcaacttcaatccactagtctgaaaaacaaaaaccctattttttgtgtttcctcctattggagtcaatttttaactcgcctagcacaaccaataaggtcctgacttcggcaaggtacattcaatgaattcaccagagtcaacacacaagttactttttaactgaacatgtataccccactatctatgaggaaaaagaatccgtgtttccactgtgagtaaagttaaaaaaataactcctttttcatcccgcctaatgttttcaaacacttcaaaggttattacgtgaagagtcaagcaattgcccaacaaacggacgtagcttgcttcactggaagaacagaatattagttaaaaaaattactctcaaaagcacaaatcaatcttgcaggcacgaacccgatgatgagtaaaaaaaaactagtttcgcgtatagggggcaacctgtacataatccatccaagtttacgaagcattaagttaaagaattactcgccattcccatcctgaccatcgatctgctgagattaaataaaaggattcaagaaaatctatgtatacttactcgtacgtgtgcccgtaataatagttaaaaataactattagtagcaaacacactaaaattctccgtggtgtatccaaaagctttaactatcggctagaagtaaaactttaactattattgccacaggtaatatcagttaaaatttaactggcattcaaatctacaccacgactgtaacatacccaagcctataaacctgagaactaaatttaatttaaatgcatcatgtggttgtggagtgattttaattgtttttggatcttaatagtaatatgtccgtactaacgttacggtgtcataacattttttcttaataagttattaaaattcgactgcaatgaaaataattttcctagaatctgtccatttaagctttcagtccaaggtcatatataaaaaagaaatattatgatataacttaaaattatttattcaagatcatcaatgattatatctaatcaatttaatatacactatatgaaggtcatatatcaaaaaaaaatattatgatataacttaaaattatttattcaagatcatcaatgattatatctaatcaattcaatatacactgtatgaggacaatgcatatccacacaaaaaagaatggttgagttattcctcaagaaattaagatagacaagtatgaatctttttttggtaagtatgcaccgttaacgacccaactgattactacaaaaaaaacattgacttctggtaaaatatggttgaattttgtcaaaaatttaaagtcagttcgaatttttaaacttgctgaaaacacaaaaccaaacatttttgccagtctaataagtttgatttttcttgtaaaccctgctggagagtaaacctcaaatatttataacaggacgtattaacaacaaaatatataactcttcttatcattattacttcttttgcatgtcttaaatcaatctcctttactgaaacatatattgtcttttgattatttgatttgcattatcaaataccgccgtgactataatactcttttggttatcgctgattcaagcattcaagctaagtatttgtcagcaagctgcaagccattcctgatgcgtttctgctttccagcggcatacatccttccgcgagccaaaagttctatcaaggccatctgaagtataaatagccagctacatcctttgattatagttgagtcatcatgtgtacagaaaaaaagaaatgcagtattacctcatattatctttctactgctacaactttattaattttaatatgtttgcttcgtcgtagcatccgccactttggcacaaccttcatttaacattgtcaagttgtcaacctacatgctacagcacagcctcaaccctgcttccatgcatagacaagctctcttccaatgccatttttggcctcaaccatgcttccatgcttagataagctctcttctaagaaatatgtccttttaatataaagacctaatgagtttcagtgttattacatatctcttctatataggaaatatgttgttaatcaaaacaatgcaaccctgatcggcaagaggcaaagataaatataccatccagtatctcttctgtacaggaaatatgttaactaaaataatgcaaccctaatcagcaagagacaaagataaacatgctatcactgaatgtgagatacatatttatccagaacaagtgatgtcaagaaacatagctttagaaaattatctgtataatatttgtatgtttatcttccctaacattaattttctaatcgttggattcagaccatgtcccaatccactttacttcccacacattccaggccctaatcttatatatacatctcattacactatgtattgattgtatcagtacattctatgtcattgcaaaggcaagtttctctacagactaataaaatatgtgctatttgtttcttctgtagaatgatttggtctgacagaatgagaagtaaacaaaaatctgaaaagcaacatatactataaggaactgaacttcattcaactaccactacagagtgagactgattttacttggcactattatggagtaccaatcaagtggaagccgcagccttcctgaccttaccttaatatatgtggtatttgatttaacaaattaatccaccgaaaaaagtcaccgctataaagtttcagtgtctgtgatcaagacgatcagatcaatacacggtggctgccaagagtaccttcgaggggcgcaacaacccacaccgaatcagctacaagggttttttatagtatagatagaagcaacttccatccatccaatacttaacttattttatccaagtttgcatggcctagtgaagttataagtttggaatggagtatacatgtgttcctacttgccctgctgccgcacctccatggcaaacaacaaacagtactatctgatgctgtctacaaaaatcttagaaattaaatgggctgcatataactcttcttcccctgcaagaagcatttgagtgaagccattaaggaatataacaaaaaaaaattctgagaaccattgtacaaaagctcaatgaaatgaaattaaggagtacctgccggtgtactggatgtgaagaacagatatatatatcatgcaatggcatgcttaaataagtgtcctgacaatggcatctcgtatcatgccatattgaaactaattttaagcaaagccattatgccattcacttccacttcaagtacatgtatcgcagattatacactaatatcttatgagtcccacttccacttctggtttgcataaatgaacccatattcacaaactacccaaaagtaaagttggaataccttcgcctgaataccaatgtttctacttttcagcaatttggctactgaaacagaaacaaattatcaacaattccttctcagatatagttgtaaagatatttatgcatcatggttcaattgcaccttatgagtattgacatgaaaatggataagaaatatcttgcagagatgcttctactctgagtagcagcagacgtttacctgcatgataagcttccgcatccaaccagtagatgaagaaacacaaccaaattccactgcagaaatcttgcgtttgtagcaaaattccacacacggccttctacatattacttttggtgctcctcatatgcagcaggtgctttatatttcccttaaccagttgtcctggtaaaaagcaaaattaagacgccacaacatctagtcatatgtagataaatatatcattttagccaactaaaggtttggataaaatat

SEQ ID NO: 59604 - DNA, 8056 bp, Oryza sativa
tatttttctaatttggcatatttgtagtggcatggatccaattaacccgtaaaaatatgcacgacgctgtgtgtgtatttttcatttctaataaagccagggtggtacttatctcgatataaatatttggctgaaaaatatcgctgttttatattctaggattaaaaataaactttgatcaaaatttaacttgtaaaaaacagcgtactatataatgctaaattttctccgagagtaggcctcactacttagaaaaaagatttttacaagcggccaagatcattcttactatacggacggctgttccacctgtagggcctatgaaaattgacgattttcgcagacggtccgcctgggaagattattttcctaggtggattgtaccatgatgcgccacctgggaaaaaaagggagagcacacctgtgataagaaggagccgccaccttgggaaatatgcgccaacttttgatttttcccgccaaatttttaataatatttttttatcaataatgttgcaattaattaattaactaatgcatacacaatattaggaactaacaaacatttaataccgacaaaaatacatatattgcattagtgaaaagtatcgtgaatatgttacaacattttttacattgtcactgtggttttcactaacatgaactcattgtgggcctgatcgattgagtgacctctctatatatatatactcctagggaaatggttctatactcctagggagtacgtactcctgctctcatccaccgttcatcaaaagcagtaccgatcctggatgttagcggatgctattgttgaaacccgttttgattttcggtaaaaacaattcccgtaatactttaattatcccatgtttatcggatcatgaaaactgaccgcatatatcaaatgagtcccagccattcgtctttcaccggcgcgacgacgacggcaaaatctaggtgggcatctccatcgtcggtggctggtttgctgatcgccaccacgagcggcgtacccctcgtcgactctccacgacgtgcaggttcgtttgtttttaacgcgtttgttttcattcggaatttcggatgatcacccgatcgcttgttctgattccgtgccgtctcaggatcatggtcggggcaacgagacatcaggcgctggtgacatcctggcactgcttgtagcagaggcaacgggagttcaccccgatcgcagatcagagcagcccatccaagcggtggagaaattataagtagtgagggcaactccccacaattgtctcgatgatggtaagaacaagactttccagtccgatatttcatttcatattcatcaatggcggcgacgacaacacggcatcgatcgatttgcgaagcctatgcatcacggcatcatggtggcggcgacggcaccgccgcagcaatcgaaggagcagagaggcggctgcaccacagtgcgccgctacgactcctcgctaccgatgtggaagaagaatgatgaagctcctaattaactagttctttgctccatacagatgcatgacaaatacaccattgatggtggccaacaccgggcagtattcgcatagttgcatcgattagctgatgtagatgcagaaaatgtggatttggcagtatgaaaattctgtccaaagcagcttgtgcaggtcaagaattgggtgtactgtacattcatttttcttctttttcagaatggctaaatatgtatgaatccatatactgcctgcattattgcaagttctcttgtgatcagactatgcttcaatttaatctaaatcgaggaaagaactttctattctttaaaatttcatgttcacacctgaaatcagaaaatataatttgtggaagaaattaaatagtatatcagtacactcattgaaagaagagtagtacaaacttgtttagaaaagaactcgggatatactcgttccaagaaattaaatctagtatatactcagttccaggaaaaaaaaagtaagtatatcagtactctttgaaataacagtagtatatactgatactcacctaaaaaaatatactgatactaacataaaaaaaaggtactacttacttaaaaaggtatatactgctctactaatttaaaaagtacataccgttactaattgtagaaaaggtatataccgcttctaacctaaaaaggtatatactgctctactaattcaaaacagtatataccattactaacttaaaaaagtatatacttaacttaaaaaagtacatactgtactacatatatacatactggatattacaataaaaaggcatatactccagcaaacaaaaatctagtacatgctagatcataaaaaaaacaatatatactagatcctgaaaaagaaaaggtatatatatactccttcaaccttggttctggtacgtacataccgaaatgcatggatgaattattgactagatacggatgcacatcagctgatttatgtgccttcgttgcccatgcatgcgggaaaaaatattttgatttttgtttttcgaactagctcatcagttagctattggataatccactagggggagggagtacctgcacctgggtgtacagaagagtcatcatatatatatatatatatatatatatatatatatatatatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatataaggaaggtgacaataggcatcgatccacagagagtaaattaacatgagatatgcatgcacatattaattattgatcagataggtagctgcaggccagcacgacacactcgatttgcatatgttctcgtgcagttgacggcactcctgatccaaagcactgtaagttcagacttcagagtatctatcgctagctaccagctccatcgtttctttttaaatatctgtggttcagctagctagaaagaaattaagatcgaagcccaagtaccgtatcgaatctgatataaggggggaaatcagtgatgcaggcgctgcagtcatttcagcgtgtctggtggcatatttgtaggtgtataactgaggtgcacatagtagttgcaagtttcttgcctggccaactatggtaattctccatggcatatctatggaaataagtttaaatgtgttcaaaacaacatggataagtatgatccatatccatgataagcttgtcaagcaaggcaaagtatttggcatatataaaaagataaatagatccatttgagtacaaacaaggtattctaattattccttcattagaattacatgtgcaaattttgtaaaacaacatgtttgccgaaagcttgagtttcaatatattcaaagggagggagggtacttgccttgattatgatccttaatcgggttaactatttactcaacctccttattgatgacatccactagtacagaaaccccctataggtgtcggttgagaaccggcaataggtgccagtttctctgccggcaccaattggttggcaccaatgacactaggttattggtgtcggttatagaactggtacctttgtgctctccccgaatttcttttaaaaaaggaaaccacctccaagccgagccaatgctttctatgtctcacatatcacagaacgtttttgatcctgaagatttaggcccccttcaaacattcgcaaccgaaacagcgtgtcagcttgagatgcttttcgctccatcttatttcaatatgatggagcatctgattgtccacatcgtccctcagattatcgaaattggtcccctatacctacatcagatgtgggcgtctgagaggtacatgtcagttctgaaagggtatgtccgtaacccagctcatccgaaggaatcaatgataaagatattacatgaaggacaccacacccattggtataacccccgttgaacacgagggtcagttaactgggaagtggaccatagacaagaaaagattctatgataacgactacaaagctgtagcggaagcacatagcggcatgctgcaacaactcgccatcctcaagccgtacattgagggacactgttgacggtcgttagcgatcagtttcgaccgtcaatattaccaaaatagaggagaactagtatttggttagaacaataatattccactagtatttggttcactaaccttttgcagagaataaccataaagtggaggagaatcgacatcaaatcagacgataaatcaatcggacgatgtcgtgaatcagacttatgtataaatgggccaagaactcagaaatgacacgacgaattgggccaaaattcacaagtctgcggagaggagcagtagagtaggccaccagcgaagttgttggctggatgggcctgcccctggtttggctgttggatccaggttttggctggacggctgagatgaagcccctatgacggttggagggtaattccgaccattccaactgtcagaaccgtcatagtttagctataaaagggcttcatctccttacttcttccacacacctcaagcaagagctctctcatattctctcaagttagtttagtgttcttaagctagtggaataggaatagagtagagatcggaatctggaagccttcggaagagttcaggtattgctctagtagctcttctattctcttttgtaagctttgtactttatctagaatactcttctttatacaattatggtattgaaatactttccgagtatatgaatgccaactttacatattgttcacgttatacttattatactgctagcttatctgggagatgctttggtgaaggtataatgtttgcgtatgcaattactctatgccatgacgatgatattagagtagtatctggcagtttagacgtggtgtctaaattacggggtatcattatggttatatgctgcggatgagaggtgggccgctgatggtgacagctcagaatgggtattcctccaggcgtgtatatagtcctaagttactttcctgggaagggtactcctccgtatttagccccggttgtatggtcatgacgggctgtcgtaaggagcttggtcgtcaggggtggcttctcaaagtaccaggagggcatcagatagagggtattagctagtatatcaaataactagaatgtatgtatactatgtatagtagaagtataggaatagattctctttctcttttctttccacttagcttagataatttagtatgagaatgagtagtctgcttgtgtgtcactgtacccttagattatcttaacccctgcttagactatgactattacaagtaacaaataaattattagtcaagttctctataccatgatcttgccactggattaaataaatacgatacacttggaatactctcgggtgaaatgctacaatggtatattcgtgcgcttgcggatgaactttgtaaccataatatactaggagtatttctgcgccattgctgggaattatatttctagtaatgtcgttaagaaataccaacagacacatgaacgagataagagcctggaaccctagaagggcggcgacttggatctcaaaggaacataaatgcaaatttcctgaatggttgaaggaaaaaaacttgccgttcggtgaatcgcttgcactggctggcaactggcccaagtagcctcatgaactcatggcaattgtacgacatcggcggatttatgttttacacataggcaaggacaagaaaagcgcaggttagaatagtggagttcgtgtggaggcgttggacgcaataggggagaataagtcatactacggataatacaagacatttgggagcttgactatggcattaacatccaggtcccggagctatgatgccagtgggtcaaagacacaacaggcctatccatcgattactacggctttacggttctggaacgtagtaaactaagccacaaggatgatccatgtgttctcgctaatcgtgttgcacaggttttctatgtgaaggacccatctgacgagcggatggacattactgtaccgggaaagcaacacatctttggcattgataacactaaagacgcgtcagtttacaaccaatacgacgacgtcccattattcacagatctacctaaccagatcaagcgaattgagacaacccttgacgaagagaagttttcgtccgtgtggaaggatggtgttgcgaaaattgtaaaacattagtatatatatatatatgtatatatatatatatgtatatgtatatatatatatatatgtatatgtatatatatatatatatatgtatatatatatatatatgtatatatatatgttgttgtgtacaacttgtttttgtaaacgattaatgtacccaacttatggctcccttcaaacgattaatgtatcaaacttatggttccatgtttatccatactatatgtgtcgttctcaatttatatggttgaataatttatttctggtaatcatatggttgaataattaagatgaggtttgatcaatatacaagcgatttaattagatgcgattgaaattcatttgtggttaaataaatatatttctatggttgaataatttatttgcattaatcatatggatgaataattgtattgattaattaattaagttgtggtttaattaactataactatatttagttatagttaaagaattatagttaaataatttatgggtttaattaactatagctatatttaatttgtggttgaataattatattgattaattaaccatattagatgggatttattaatttatctgcatttatttttgcgtgcgggtggcttaagccgtccgcacgggataatatcatcccgtgcgtgctacttaaactgcccgcacgggaatatcgattatcccgtgcgggtggcataagccacccgaggcgataatatggatatataagcactgggcgggcgtacgaaatttgcacctacactgcccagtttttcaccgccgctgcctcctcaccgagcaccaaaagacgccgccgacctccaccagcgccgtcggctcatctcctcctcgcccttaacgccggggacctcctccccaaccaccaccgttgccgcctcctctacacctctcctcctctacctctagccatcaagatttgggccgctgctgccgcctctcctcctcgccctcaccgccggtgtcgccgacctccaccgccggccacctcctctgcaagccattggcggtaatcatttttgagttttttttgtgaaatttgtgatatgtgcaatttgtgatatgtgcgcaatttgtgacatgtgcaatttgtgatatgtgaaatttaggatatgtgcaatatttttatatatatgtgcaatttttgatatgtgaaatttgggacttagggtgatatttatgaaatttgtgagatgaccaattatcaaatttgtgcgatgtcaattgttaggcaaaaatgtagatgcaattttttttatatgtcaattttgtgatttttgggatataggatatgtggtatatatgtaatttttttgataattattcatttatatatggatttagttcctagcttatcaattcatcacataatacgaggtgctccgggtgccatgttggttcggtcgggatag

SEQ ID NO: 59605 - DNA, 20233 bp, Oryza sativa
accagttgtagcaaccgtgaccaacaaatcgagcctaaagaagatctttagtaccggttctaaaatgcatattaagtcaaaaaaaatgtgggggatacatattcaaactcaagacctctcacctcaaccctcacacacctaaccatcccaccaactccacatatttgacttggatagagattatttctttttaaactaaccctagaggcatgtttagtccgggttggtgttaccaactgggactaaagatctggttggtgtaaccaacctgtactaaattaaagatgcatttttactacctattggtaacaccaaccggaactaaagatgtttttggaacttggacttttagaaccagtactaataacatattagtaccagtaccagttcttaatctaaccgatatatttgtgtttttgtatcatgacaaaagatcagttatccagtagtggataagacatttttttgggtatgcaagagcctttgcatggatgtgaagaagttgtaagtatttgaaattatcaaaacattcattctgattccatgtggatcaataaggtgagagatgattgataatatttcctttatatggacacagaaatgcatgcattgtactgctgaggtttggctactggtgatactacaatggtagtcagtagaggcttgctcgcaaaagatgagcaggaatatgtttcatttctgcttatagaacaactactagaatctgtgaaaaaactattaagatatgtagtgcctccactgaccacttgtatcggtgttaattttctatgccactaggccattgccgataactgcatccactatgtttttatttcactctcataccatgagagattcaggtgattatttgtatccaaagactccattatttgtatcctatattcaggtgattaatcatttgtatatacatataagaagatagaaaactgcccatcgatgaaaccgtgatcctcgttttccatgctagtgtcaaatcattatcttttaacacatccttgaccctgcgaagcagtgagcggtggcggcagcaagcaaatgtatcaggggtgttgagctctagctcatgtcggcagcggggcttggttctagggggtgatagaggcagagctcggatgtgagggccagtggccggagtgactagtaaagcatgtggtcacacctttgccgatgcctcctactcccatcacaaagcaagatgatgtatacttggaatctctatcttctctctcccattttgtttgttggctattgcttgctatttgctcctacttgcaatgagaaaccatgcgctgaaaaggaagggctgtatcctaaatttgatggggtatataaagagttggaaaaacttttttattgaagatggtacaatgttttttttttgttctgctgatcgaatgaaatggaatgctttaaaaacataaaataagctttatcattcttagccaattacatcaagataatataattactctaagactacttttggcattaacataactagaatgcacatacaacctattattattacataaagagaaatattatgccgcagcagactataacacaagctatttcttcctaacaccccacagcagcaacacttgggctgcaaaacaaaaaaggctgtcctaacgatgcctccgagaaagaaaatgacactcaaacgtgctgccattgccatgaccgaacctgtaaaggccaaaacatatgtttctccttcattagagagcaaatctttgactctaggcagtgccttcaacatggaagggaaacaccattggcaggaacaaccagctaagggctgtcctaggaaaagatgatttgtagaggcatgatatattttcatatgcttataatatcttttcatattatcttttcattatgtgtcccatggagctccttatctaccgatttgcaaaataggctatattttatagatatttggttgttaaacctcgaggcattttgtggacctcagtttccgtttgaggtgtagccttatcagcctcaacctgcttcagttactttgaggcagagataatcttttgaggcagtgttctctgccacaatagacaatttggggcaagagtatctgagacatggggaggctatctcgtaatctcttttgagatagactttgaggctgatttggttgctttgttataaaaacggcccagaaatcacatcggaaaccaaatcgcggaagaaaacgccataggagatccaaacatgatgacgacaccgaggtacgatatttgataatggagttcagccgaggcatacatcttcggggcactgattacgggcactccttcccgatccagtatattagagcgtatcaaagttataacgactcacggctggtcgccgccggcagccactccctctcgctatgctaaatcgccatgcggttacaacaggcatgctcctctatttatgagagatcctaggatagactccgactcatactcgagtcctaatacctattacaactccaagtcctaaattgtaaccgactttgtatacatattcgacataaactctaacatgtttcatgttgtctatgatcctgtagtgcttttctgttgtggcatgctaattttctagtccaacatacggagtctcgctccggtgctttctacttggagtagaaactaatttgagtcgttgatcatatctaattgtaggattgagatctatttctactcccaccagagttagtggtaatatatatgtggaggggtatattcgtccaaggatcataattcgcgtaggggtattatgtaatttatcagtatcgacgccattcccatccatccccgcctctgttgccgtccatctccctcgtcgcctccgtcttccatcctagcgtctcctccccctccagcaccgtccccttctccgctccctccgtcgaagctcgtctccacgccgccttgtgagccccctccgttgccgtcatcctcccccacccccttcttcagcgagttgcctcacatcgtcgcgcctccacctgccaccgccgccacattctcctcgccatcagccttctccgccacatcacctccacctgccaccgccgccacatccttctccactccaccgccgcccccttttccactcccctcggtgatctcgcatctccatccgggatctccagagctccgccctatcccgccgctacccacgtcgacccaccttctgccgagttccacctcagaccctagcaccgcgccactcaccgccggtgagccttcgtcctcctcgctatccccttcctcgccgtcggccacctcccccacgctcggctctagccccgtccatctccgcccgccgttgctcccacagccacgtgggagagcccccaatccatcaccccacaagcggaggacgcagcctttggatccaatggcagcgcacgcctggttccccttcgtccccatgccgcctcaagcacctccatcggagcaggaggaagactcgccattggagaatagcggaaggtaatgcccggaaatttgcagtaagacgcgctcccctaatgcctcccctcaactttcaatctcaagttgttttttttttaaatttcgatttgatttctgaggctaccggtttcctgttaatctgcagcatgaaggatgagatgatccatctatatctgaacaactccaccatggcgttggcgatcctgagagaggcatgcttgctgggtgctccgaggtgccatggcattgggatgctagtgggagcattcggtatttgcaaggagcaagtgcgcgaagccatcttggaaggtacgtgtggctgcttcgttgtatcaattggatttggcgcgcaatgttgtgctattgaattatgatgtctaaagttgtcatctttctgaatgaaactaatgttcacctgttgtgggggctttagaatgggtggctattactagtggctatatttgcattgaattattatgccaccatcaattaatgacgagtagatgatgcatggtgcttctttcctttgaactctggttgccttttcaccaattatattgctcgttttggttcagtaaatgcactgtttatttcagaacaaaacggttaatgttaacagcatttttacttatttactctgaaccacctgctgatcttgttttttgctccgtgattgttgtacatatcatggttagctagctgtaacagtttatttctcaacttgcccttttgacataagtgctcatggaatttacttgttcccatgtgatcatctgatctcttatatgtagttgcctcctctttgtataaaggaaagaaacttgaataattgtaaaaggcaacaaaggttgagaccagtcaaatattgaaggggtaaataaattgttactaagggcctcacttgatgaataaaagatagcatggtatggtaattgtcctttatagtattgttttgcatggctgattttagcatgagaaaaacccatcctcttggacaaaaatccatttatatcgtggttggtacttggtagcagtggacagtctttaatcttgttcagtttggacttgatcaaaattcctgctaagtcttgtcgaaatatattcatatcttgctgcataaagtaaagggagaacattttatatgattttcataatgggaagctttggtgcaaaatatgaatagagttcattgtggttgcctgaaatcattgtattgatgtcagaaatcattgttgattcacacagataatagacagaaaagggaatgaattgagcaacccatataccaacgttacatgtccttcagttattggatcaaccacaggaaggttaaaaatattgaccatataagaggaattttgcttaagttctaaaagaatatctgaatcacatcgtaattcataaggaatttcgcttaagttctaattaactttggttgatcatgttgcctgactcactacataatatttggagtgttaatgccaattcatatagtgctctactatcactattttagtagtgcatatactgttaatcaaaataatttcattttgcaacttgtatatatatctctacatgaggactttgcaaagcaacatctcaggggcctacaatgagttgttgctcaggtaacaagtttcagtatcaaaattcataatatgttcactacaggtttcaggttcatatatctgaccaaagtactgtccttgccagattcagttccaaaatgagacacagttctcaccaggattacaggtgacggaacactttgtcgtggctacatagcacttgcatgcagaggggtagcagcttatgaagccacctcttgtttcatcagaggtaagattgagctaaagatgatgaatttagaaacttcataagctggcatgaactgaacttactgacaaatgcttaatttagaaacctgacaagatctcacgaactaacacaagaaaatctggtctttatgcacgaactttgggtgttcagccagcaggacgttgcggagctaccaggtctacttcagcatgaggaagcagtcaaccaacaatatcggcagcaagcacatgctgggaatgagactgtgttaatcttattaaatcaaaaaattagttcatgttatgccatttatttagtgtaattatagttatatatgtcctgttgtatgcttatgctgccatcggccaatctatgccgttaggatatgcatgtaagaactcagaagcggtgtatcaatcgaaaatcgattgattttttttctcacaaaacaagcatatgatagataaatgatcaattgaaaatcggttgaatttttttctcacaaaacaagcatatgatagataaatggtctctgatcttttcagcctacctaatttttttctccaaaacaaaccgttctgttttttattctatgcgcggtcgacaaaaaaaccatgatttcttaaaatcgacccaatctgaacgatcatcctgggcttaataatttttttgtccaaaataaaccgatctgctttattctatacgcgatcgaccaaaaaccatgattttgaaaaatagacccgatccggacggtctcggacttaatatttttttccataataaacggttctattttattctatgcgcgatcgactgaaaaaccattttttaaaatcgacccggtccgaacggcctcggacttatttttcttatccaaaataaacagttctgctatattctatgcgcagtcgaccaaagaaccatgatttttttaaaatcgacctggtccaaacggtctcaaacttaatatttttttttgtccaaaataagctttattctatgctcggaagacctgaaaaccaattttttttaaatcgaccaggtccgaatggtcctggacttaatattttttttccaaaataaactatcctactttattctttacgcgatcaaccgaaaattcttgattttttaaaatcgtcccgatctatacggtcctggacttaatattttttctaaaataaaccgttatgctttattctatacgtggttttttaaatctatccggtccggacagaccgaacgtgtaccttttactacctagtagatgttcgacagttttttttaaccataacattcgatatttttagccgcatgatccaacatcaacaacggtgactgttaagtggctaacgggtccacatcaaaatacagtacaacaaacgaaggatgatgtccgtaaaatctgggagaaaaataggaagttacagtgagttacagcatgtaactgcatgtaattagcatatactataactagtataaatttgccttcaatcctcaaattggatatagctcagtgacaaggaagtcatgcaggtgacgcggaagtttgagggatcgattcctatgttcgcttgtttttgctgctatttcgtttctcatcctaagcacgaatcttgatgttaatccaatgacccagaaatcgacagtttttctctgagaaatctgtcacaagttatttagggcccctttgaatcgcagggtagaaaaaatggaggaataggaaaaacacaggattctgacaggatttgaagtgtaaaacagaggattgcaaaacacaggaaaaacacagaaatgatcgtttgattggagcgcaggaaaaacgcaggaattagatgagagagatagactcaaaggaaattttccaagaggttggagctcttgctaaatttcctccaaattcacatgcaatatgccattccataggaatttcataggatttagaaagcttcaatcctttgaatcaaagggccaaataggaaaatttcctataggatttaaatcctatgaaattcctacgtagatcctttaattcaaaggggcccttagcaattccgatccagataggtatcacgtacccaaaatccgatcggcctgagatgcggtggctgcgtcgtgcctgatgcgatcaagccaaaattaccaaaattacccttaatcagcccatgccaaaattacccctaatgcatattagggagattactaatctaccctttaaaataaacggtcaagattaattctacttggagtatatactacaagtagaaagcaccggagcgtgctccccaacatacgtagattagaggacgaggagaattctatgcgcgttgatttcaaatttattgaattttctggacatgatctcattcatagaactatcagtttaatttgaagtcattcatcctaggcagtgtcaagtcacaacttagatttctcgtctgacaagcttgatttaggatctttttctggaaaactttgtatacagaagttgtagataatgttgtaagctttccagcgaatccaatattaggtcaatccgatacattcaggagaagttttgccctttgaaacttgattattctgtgaatgggcggagatgctgattcgtttttcagtgggtaatagaggtctgcggatggcagttttagccctgtcacccaactaaacttaggtggaaatttctgtgtagttagtcatggagtatttctttgttcaattcggttggttgtgaggaaatgggcagatggagcgatgtaaaacatttctgaattaggtgtttacagcaggggatcattcaggtactcgattcaatgaataatttgctttcctgtgatctgtaatctgtgacaagagatggttcattatccttcttgagcatgtgtattgcaatgggcacataccactgggaattagttggattcccctttctgtgtatcgcaattggagaaattctctgtttgtcttgcgggagggtgcacactgcacagcatgcgaggggagggaaggacggacgactctgctcttaggacgtgctttgggtgaggggaggaaagggcatatgaatcaaatttttaagtagtacagataaaattgaggattgttattctctattttgttcaccaagcgcaaaaaaatggtttgattgaaacacatggttttttcttatgtactggtttgtttgctccgttttccaaacctaacccttctaataaactactccctccgtatcatctgttttatattatatattgctttcacttttgtaaaaacaatctttttattgtttgacctagtttatagaaaaatataacaacatttatagcattaaattagttttattaaataaacattgaattcattttgatagtttctttattttatgttgaaagtattgctagatttatctatgaacttaatcaaagttatgttaaagaaatttgacttagaaaaaagtcgaactgacttataatatgaaacgaagatagtagatatttatgattttaaaatttattctacttttcataaaacacatggcacaaacaagtacatttcattatctcaaaatgaaaaaccaactacaactacgtttgattagacgacatacctactttcttctatcaaaatggagcatgaggcattgctggtctatggattacaaaacagtatcatttagagaaaaaaacagaacaaaagttcaaagggaggacgggcgatcgactacgccgcgcgcgtacggcgcacgttctttgccaagatcatgtctagatgcagacaaaatggaggtgtggctgctggctatggcacggcatggcggctggggcaagctagggttcggtagacacctctgacatcggtgatgtctcacacatcttactggaggtgatgtgcctggtttttcctcttttataaatttgtgcgttctggtagatctaagggttaaaaccttgatgtcaacgttcttgaaggcgtcgcattgaaagttttctggtattgtatcctttgtggctgtccctattggatcggcttcgatgaataggcgatgacaaaatctaggcgattgaatgcttcttgctcagtttatatgatgttatcttccacttatggttcaacatcactcatgatggtgatatgtgtaaaattcgattgacaatgattgcctacagattttagagattccgcttttagttataggaagacaatgagtagatataacttgtaagctattgggaagaaataatggttatgtacattttcaccaaccattgatagaaattccctgtctttgagaaaatatttgaagtagttttcttgttttagtaaagctgtgatttttgtagttcgcatattcatgcatcctgaaatctctgtaatgattggttgtatatttttataaaatccaagataaaaataaattttattatctaaataaattgctggcctatatgttgggttacaataaaatccgtgctacgtggttgatatcatgcatgttgtcagtggtggtgatattgttcacgtagaagtgtgtgtagtgaatacaacttaacaactgtagtaggaggaaaccttcctggacgccatcaccgccagggactgaaactttggaatgaaatttcaaaaatacccccacccccaccggcaagcacatatatctcacttgaaatttccggggttttttttttcaattgtttgtgaatttgatcaattttatttaaaattaatcaaattttcaaataattttggtcaataaaaataccgaaaattcggtaatttcaggaatgttggacccttggctcacgctctgtcgccctgatgacgcctagcgaggtaaacacctccccctcacacacaagtgtagagactcgtcgctggcaagaaacacacccaccggagaaaataatctagccctgtcgcgatcgtaacaggagacactaatcatcgccacagatcagttttgccgacagtattggttatgttggggaatctggatcctctgatatccaaatgtggaccattgtcaacacaaaacttgtgcacttctccccaaatgcctcctattcatatcacacccctctttctctcactcatcttctttgattttagccactccttgttagttgctactactccacttcgctatgtgtttgtgcagtgtggaaaatggaagctacaagctagctcaaatatgtggtggtatagaaaagagttggataagttgttttcagtttttttccctcctagtacaattgtttttagcatgtcgtgtagtagccaaatgttacaaaagaggtcaaagagagaatgaaatggagcagcacacttaacaactgctgcatgcatgtggagaaagctccatctaattgcaatatgttttttttatattcatctgcaagatatacctagcgaacatgtgcatgcgtatgagttatatgcttacttctgaatattcatgcgttggaatagcagccatagttgcatcatcatattcagctgaagatgtacaagagtcagatcagaaaacgtcacatacgagatgaatcagaaaatgctgaatcagatctgaagctgcgagaacattggttttggtgcgcatgaagcagaaaatgtgcgtgcacatgcgtacgagtcatttagacaatgctgtgagaacgttggtattggtaaattctgtcacccctgtcaacacagattccggagatgaacaatctatactgatttgggagattctttcatgggatttgttccacaagatatattccctgatgcctcctattcatatctcgtgttgtaatttgttttggaaaatgaaaccaaccattccatgcctctgcacctgagggtgtatcacactgtaatacacccattatttccctccccctctctcaatcatgttctaaattcttcttggatggctcatgctgcctgccttgctattgcttgaatgagttgtgcatgtggtggaagaactactgcgagaaaaaaaaggcgaggcggtataaatactactaggagatagatagatgaattatatataactaggaaggtggcccgcacgatgcgcgggcatttatattgttgaaagataagattatagtttatttagaaattgtctcataggtaataaacttgggatcgaacaatatccttttaaaatgattcaggggttctattttcttaatgtaactcaaaaaacattcagactcttgaatacaagatggattaagttagtacaactttactaccgctagcttaattatcaaccatatcacttgtatacataccatgcaaatatgggtacaagcgaaaattgcaaaatcaaggaactcaaaatggatcatcttatgaaggcatataacgaacaaattaatggtaaattaaaacttggatttcccccctgtatataagttcaacaatttcatattttctccatagttttgaagaactttaaaaggttttggtgcatacaaatcacctacaccatcgctttgcttggtattgcaaaatatcaacattgtttgaagctaaattctttagtttttgcaagtttcattattttcttggaacaataattgtttaaaataagactataattatataaatttaattagtatgggtagtttacttataaattttgaagtgttttgaagtaaagtttttctatcatgtagtctggttatatcaataatatagttttgttcaataaattcaatattatttacatcaccagaattaataaaaatttataaaaccatccatgactacttaaaattttggtttgtctgatttgtttatttcaaatttagataatcacatattctccttctaatcggtgtgtttgtcattattcataataaaaaaaacactccttgtacagctgacacatcatattgtcactcaatcacatacaaatgtaaaatatttgtcattattctcggaccgctcattcctcattggtatcttccactcatccatcatcttataatagaagtatacaccatattttgtctaactatttagtttacgtaagggacaacaccacgctcctcctccctcatgcatgggacacagtgtccaatttttttccaaagcaagtttttaattaacacatgtaattagaatattacatgtgtaatatatgtgtatgtgacacatggtaatttttattctagcttcgccctgcttatatactgtatagagagattaattatattcaacctgcagtgcttgattcttcttctttctacattgcatcttcgcgatttgttttcatgttattaaaaaaaccaatcgttgcccattgatgatttgacacattttcattttagcgaagcagtagcgctataacatcatgatcaccttagctaccttaggtatacgatgcttcgtcatgcgtgtagaaggtaaagacgtcacatgtgttgtatagagagacaaagaggacttccgaggctagatctcatggtctaaataatatgtccaccggtttaactaaaaatcgataaacaaatatttttattaggaaatagtctaaaataattggtacataatatcatataatggtgttaactctatttttaaatattgtagatctaatttatttacatctaattgtaaagagttatatgttgacattcaatattagtaaagcaactattatgtaaagtttattatcatgaataataataattatagtggctcaactaaatacatggaaaaatggaaagggaaaaagaggaaggtcctcttgagttgaaggaaaggcgggtacgtagggagagaagaggtggaatcgtagtttaatctaacggcttataatattggacacaccaatttatgtggaaattaagggatatatgttttgttttttttctcaaattttgtagcatttggtaacttgagagcgttttgaggaactttaatggacatacgtcgtatcgtttggttgagacacttatataaggacaatattaaccggagaacatccagcacgttttgtccctaaattgttttcgtcagttttgctttttataattttgtaacataatagttatctttatactatattgtatttatgtaatacatagaagcaattatttataatgttattcatcaactgtaaagaatggtaggcttattttctttaaaaaagcatgcatactaaattaagtgttaaatgaaaattaagacttttttaattggatataggttattgttttctattaatggatgaattgggtggacatgaaagtccactaaatgcattggttatatagtctaatatgatttggtgtagttcgagatgcggcccaggaatccaagaattgagaatttttttacggtggattaattgttttttggattttaatatttgtatgttaaaattcagcagctatcagtgagatggagtaacctcagttttgtatttttcttcagaacagaagaattaaacattggtgctaattacgtctaaatagaaaaaagtacatttagttctaataacaatgattaaaagaagcaatattaaacacataccacataactgttgatcttcgttctttctgccccataatgttttcttgtctgtaaactcaaagtagtagtccgagaaacattcttttttgcttcgacctattttattattgtatcgtgataaaaaaagattttgagatatctttcggtacacagtacttatcatgttccataactttgattatttttaaaaaatgtataatgagtttatcttaatttttggcctaaagtggtttgccaattgctttgggattgaggcatgtattgagttgcctcgaagaaaatagtatttacataatagaacaatatattaaatgacatgtttgcaacaatcataccttgcatctagtagactcatctgtataccatagaactcacagccattgtaagattaaccgcatcctatagcctaatcactcttactttaattatacacaatacttatcatgttccataactttggaacttttaaaaatatataatgagtttatcttaatttttggcctaaagtggtttgccaattgctttgggattgcggcatgtattgagttgccccgaagaaaatagtatttacataatagaacaatatattaaatgatatgtttgcaacaatgataccttgcgtcaagtagaatcatctgtataccatagaactcatcagccattgtaggattaatcgcatcccattgcctaatcactcttaatttaattgtccacctatcattttttctgtgttaacgcagtaatcaaattgtaaagtaccatgttatctgcaaatgttcatatgcaatataatatatacatttatgttattcaatagatgcaatatagtgtagccttaattaatacaggatagcattattgtgttcttctataggtgcacgattaccttcttttgccaaatatgagcagcctgaattgactaatgtcaccaaacacctcttatgccaagatgagtcgccagatagagtcgtgtattgtagagattaaaataccatctggtcgtggtgttgctgaaggagataacactggtggagaaaccctttgtagtcccggttcgtaacccccctttagtcccggtttccaaaccgggagtaccaatccgggactaaagatcgctatctttagtcccgggtgaaataaccgggactaaagatcgagctgacctttttttttttcatggccctgttgctgcatggtttatatatatatatatatatatatatatatatatatatatatatatatataaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctagctatcatttcgacgtagtagtactcgctgctagctcagaagctaaggaccggtgaattgtgtttccgtcgtagtagaattcacccttgggattaaggatttcttcgttgatgaatcccatgagttgttcttgaaccgccgtgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtttgcaaggcagtggcaatactcgcacacgtaatagccgcacaagttatttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactctccgagggtcgatgaatccagtatcgaaaaccctccgccgtcgggccctttgaatctccattctacaacgataaaagggagtatattattttctatagtctacttatatacaaggacctaatttattaaaggagacgtatagtaagaaatctaaccgaacgatatacttacaaaatccagcaactcataatagagacgtcgagggcgtccagctggtatagttcgtagattcccttgaaattgatccagagaatgtcatctccttgcaagaagtccgtgtccctgatcctcgctccgatcatctctctaccggcggcgctcatctccatgtacagctgatggaacttgtacatttgtgtgggtagggactgcagcagctcaggcttgacaagcggtttaccgagttcgtacatgtatttcacttccgccttttcgattggtgcgactcctagcaattgatccgtagttagaccggtgtcagtaataaattgttctatcgtcatttctttaccggtaaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctggggggcccttgagtttgaaggtgccggaagaggagcttgcgggggagtaggtgtaggagcacgaggaggagtcggtgcaggatcctgaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcttgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacatgtcgattcgtcctgtgtttgcatggcgtccatgctctgtgatcctacctgccccgttgaggcgcagctgctacggtttcctgacgggctcaccattgcaggaggaatggtcggctggggatcatgggaccgatgtgcggacatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgtgttcgtcctggatgctctggagtttgcagggcgagtgtcagttcgtccctatctctgtctggtcggaacgtgccctgagaggaggcttccactgcatctgttagtcgtcgcgcagcctctcgtatctgatcgccgaagaccagtgagccatcagctgggttgagcgttccaccgtgagcatagtaccagaacttcgatcgttccggccaattggctgttgccggttcgatacccctctcaatcaagctagcctccatctcctcccacttcggcatcgcgacgctatagcctcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttgcacttccgttatgatgtgtcgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgtttccttcctcgttcaagtactggtttggatcctcgttcccctcttcttcattccagtactggctgcttccctccgcgattgtgtcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattgtacaaccctagctagtaaataattatatactaagtctaattccaaataaaataatcttatattaaaactcaaataatattacatgctaagactacaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatatgctaagtgtttcgtgcgtatatgctaagtataattaagactacaatagtcaattgctacttgtcgcaccaattccatagtcaataattacatactaagtctaattacaaataaagtaatcttatattaaaactccaataatattacatgctaagactaaaatagtcatctatgctaagtgtttcgtgcgtatatgctaagtctaattaagactacaatagtcaattgctacttgtcgccccaattccgtagtcaataattatacatactaagtctaattacaaataaagtaatcttatattaaaactcaaataatattacaacactacacaatcttatatgataagtccaattacaggtctaataatcttaattaattgcattacaaatataacaatcatttatattattacgtcacttgcctgctccaattccttctagggctagctcttccactcaggcttgacggacgactccaacaacacgtcttttctgcaagataaaaaagatgtattaggataaatgcgaagtaacatatatatatatat

SEQ ID NO: 59606 - DNA, 13553 bp, Oryza sativa
aaatcggtgccgccggccgccacagccggaagcaccgtcggctgtcgtcgcgacacctcaccatggccgccgcctaccgaagcccgcaccacggtattccaaaccgtagaggggagggggttggaatagccttgccatcgttatcgtggttgccgtcctcggcgcggtagacatcgttgtcattgtggcagccgccgccggatccacctccttcacggttgtgaaggacagcccgagcaacgccgccaccggatccgcacccaccctactgtcaccgtcgctgccctccccgccggcctcccccattgtcgcggcggctgattcggcgtccacggtcactgcggcggctgatccggtctccccgtcgccgcggtggtggatctggccacccccatcgtcacggcggtggatccagcctcccccgttgtcgtggcggccagcagcgaaggaaggccggtgggagaccggggggggggggggagggaaagaaggcgtgggccatcgcagtttgccggccgcctgtcaccgcgccgctgttgagccaccccctcccctgcaccgctgcagccgagcaccgccaccccgtgccgcagccgagccaccccctcccccgccgccccgtgccgccgagtgctgccgtcggggccgccgccgctgcctacgtgagccgccgctgccggtggggtgggaggaggagaggagagtagtggatggatttggatggagaggaaccagaaaaaaaggaggaggaggagaagcgagtggatggataaggaggtgggcggcaattttttttaagggaaacgcgcacggtgattttttttaatgtgcggggattttttttaaggacgatgctgcctagtaaccgccagcgaaaatcagtattttgactggctgtcttttaagagatcgcttgtaaaaacataggtattttttcaagcggactttaagcaaacgctagcgacaattcattttcactggcggtcctaaactctccatctcttagttacaatttcacaagcagatttcttatataaccgccagtaaaacaaatagagtaccgccatgaaaaatattttttctagtagtgcgtggcacatttcaaggattcggccgcgtccagttataaagtttgttgatgacaagaagttgtacgttggtcagaaacctgcattagcttgcaaatacccaatcctgatgttctcatggatcgctactgttgtgctcgagtgggctctaatgctactgatatgtttacatatatgtacctatactaacatgatatttactagatgcttccaagttaataaaaatatctagccaattattagctggatatgttatactatcatatccattgatcactaaatctatgtgtgtttgttatagacaatactaaaatctgtctatcctaccccacttctgaaacccccatctacttctaaatcccatccgcgtgtttcatcacttcatgatgtaaaataaaagtattagttgccggtctatatgaatattataacacacaccgtgttcaattaattaatatgctgcatttacctgtagtacatgtgtatttatatattgggtatatccatgagtaaaatatttaccggttgcacatgatatattgtagttacatgtgcaaatataattgcatgtaagttaaaataaaattacaccacaattatactataatttatatctgtcaaatttttgaaagaaattcacaactacaacaacaaactttctgtacgaggacccttggcggcgtctgcaaaaatgacctccattttcacatacggctacttaatagacccgcatgcaaaaatctattttcttagacgagcctcttaaggggctgcaaataaaaatgagcctattatcgcgtgcgggcctcttaaaggtccgcatacgaaaatttatttttgcatgcagatcttttaagggtccgctagcaaaaaaattttcctcctcaccgcttcaaaatttttcacctttcatcctctcctctctctcccctctgatattttccaccctctcttccttcacctctatctctctttcattctcttctctccctctctttggccctgtttcgttcaggggtgaaaagtttttgcgtatcacatcggatatatggacacacgtttgaagtattaaacgttgtctaataacaaaacaaattacacattctgctcgtaaactgcgagacaaatttatgaagcctaattaatcgatcattagcaaatgtttactgtagcaccgcaatgtcaaatcattgcgcaattaggcttaaaagattcgtctcgcaatttacacgtaatctgtgtaattagttttttttgtctatatgtaatactccatgcatgtgtccaaatattcgacgtgacgtggtgaaaagtttttgtctagcaactaacgaaggcctttctcttcctctcctctctcacttctatcacgggtggcgaggccgacaagaaggcaccgggagcgggcgccgccgctgcattcacggccaggagcggcgggcagcgcggccgatgaggaagtgctgggagtgggctccgctgcagtgcgggcggccaggagttagcgatgccaccctgcgacgcagattccggcagcggcgctgggcgaaggccacggcggtggccctccccagcccagatctgccggcggctgccctcccccgccccgatctaccggcggcgaccctcccccgcctggatccgccggccgccgccctccctgcccagatccaccggcgtcagcggcggcttgagaacgacagcgatagctggaggatgaggacaggaggacgacggcggaccggcggtgggtatatttttcaatttttggaatttttatttttttcgtgatttatccttttcgcatgcggccggctcaagtgtccacatgcgaaaattgtgttttttgcagaccttttcttccatgccatcgtctgtggaaatacgttttgcccgtttacaaaaacggttttcatagtagtgaaaatttgtcaacaaatacatatataaaaatacatatataggtagtctctaatgtgatctataaacatgagttatggattttctgagcagctatttcggactaagccttggggatgggaaaaatccaaatcatttagaaatcatgttttcttttgaaagttggatgacatgttctgattaaagtaacattacaacagtaaccgaaacttattttacattttcatgcattgtgtatatatgtctgcacaattgatgtcccattgcagttcacccacactgcaacaggaaattattttcattatgtcggagcaaaatagtgtacttttttgtgcaccaagaaattagtgtttgatatatacatgtggtaatagagaagatgatgttgaactgaccaacgtctccatcaactaatagttgagatgcaatgtacttgctttactcttgtttactcggaatattgaggttagtcatactattattttgaggtttgtttacagggtgcctttgtaatttttttttcttttgagaaacaaagaataattagcataaatgcaaccactcgtatcaaatctaggatttgaactcgggtggattggttccactaaaagaaacctaaccagttgagctacgctcgcttagcaagggtcctgtctgaccggtccactccagcagaaaaacttgttcatcgtcagatatctgttcacaatatttgcccagtctgcccagccccaaaaccacttcatcaccatatatttctaaatatcataaccaattatctctcgtgccaattgttcatcatgaaataataatcaaaacacacttttatttcacatatgccaatgtgtatttatgtttgtggaaagcaaattatcatttgctttgtttaggctaaaaatgcatctaaggctgcgttcagatcagcgttcacaatatttgcccggtgtcacacctgaaaattcaaaatttataaattgttgtttaaatggaatttttagaaataattttaaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataattttaattgaaaaaggttttaaaaagtcctcttttggctttgggccgaaagtcggcccaaaatctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgctgccgccgtttcccttccaaatccggccgttcctttccttctccggccgaatcaatagaggggaaacattctccgggatctcctctaccttttctcctttggaatctttggctaaatcgctttggaaagagttggattcgagttcgtctcggatttgttcttcccgagctttccttcgccgttgccgtcgccgtgggccttcgccgccgcctccgagcccctttaaaaggacccccggtgtctcctctacccgtcgccactttcgccttcgcctctcgtcgtcggaaaagccctagcgccgtgtgccctagctttgccgtcgccgccgccgctccagccgtgcgccgccgtcgctccagccgtcgccgtcgctcgggaagaccgtcgtcgtggtcgccaagtcgtcgccgtcctcgtccgccccttcgccgtcgccggagatcgccggagcttcgtcgccgtcgtcaacccgaaggtttccgccgtttcctcctcgtcgccgtcgtcgtccgttgttcttccgccgccgttttggtcaccggtgtgttcgccgcgtcgtcctctacgtgctggtgccctccgtttgcgtcctcgcgccgccgttcgccggcgagcgtgcgccgcccgagccgtccgttccgccgagccgccgccgctgtcggtgatgtcaccgctgacgtcatcggggtcgtccgccgtgagccggtcgtggaccgttcgatctcggccgtccgttttggattggatcgatctcggccgtccgttcgcgtgaaccgccgcccgtgcgcccggtccaccaaaaccctagccgctaacgcaataaaccctcttttccttttcaaaaataattcattattgcgtcataattcaattttaaccgatttaagtgttttaatccggtttaatctttaaaaattcataactaattcatcttagctccgatttagttggttcaagtctctaaatttttctaaaattgagatctacatgctaaaaatatccacatgtactgttcatgcttgtttatgtgctgttttggtgattttgctcttttctgcttagattccgtcgtttccggagagtccgttttcgccggagaagagtttgaagagttccaaggccagcaaggcaagtcacacagatcccaaacaatcctttgagcatgttgatcctatttaaagctattgtttcttttcaactattgcatttattttcgaatgtcattgggtggaatcaacctattctttgttatagcccttttgttcttgattactttattccttgataccttgggttattataatttgactagttgagctttatttatattggttcaactagatactagatataattgcttagccctgcttagaaacattagcacactattgggataattaatgactcactgttatttcatgatggcttaatgatagttcatgatggtcgattgtgattggttaattaattaatgtgccaactaaaacctgataatggtgggttgtgagcacatggttttgatggtcgtgctcatgataattaaggaccggttcacgagtttcggttgtgaaacattaaccgtgccaaccacaagccagcatggacaacggctttatcttttgtatagcatggttcattgcggagcaccagactgagaagtggcggagataagcccacgggggtcgctggggagtccatgccttgtttataagggggtgattatgatccaggaaggtgcgctgcagtggattgtgttatgcgaggggtattgtcacaactcttttccgaggtaccgtggtggtattgaggcacatggtgacatgatgtggggttgtgtcttgggggtacagtggtacacctctgatcagagtaaaactattcgaatagccgtgcccgcggttatgggcgggtctaacaatgtctttcgtgattagtttcacacttctcaccatagtaaatgatgctataattggtaataatttgattagctcctggtttggaatggtacattcctggtttggagatagaactgtgcagccgggatggttgttcagaatggttgggcctatacaacagggtatgttgtatagcgttggattaatattgttaaattaattaactgttttgttaaattctgaaatgtttgctaaatgctgcttttgcaaatgaaaccctattatgccatcctttgttatcctgtgcacttgcatatttgctgcgtggcttgctgagtatgtcatatactcaccttgcaatcattcatcagaggaagagttctacaatgaggctgatggagtggaggattaggagtagccttggtcaagctgcctgtggagtggagccgtctgcgccgtttattttattttccgctgcttagatctttattgtttgagaggaactatctacctctgtaatgacattttatacgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacccatagaagccctctaaaaatattggaaaagtagaactgttctcctccctttctcttttaattaaaccaaactaatggcacatgcacttcataatctcttttaatggttctcattcaaaatttattccagtgttattagtactgtacatccattactgtactaatggctcatttatcagcaaaagttttacaatgttgttttatttaatcttgctgcaataaaataaatttagcatgttgattttataactttcttttgaaacctgttgttaaaaagtacaaaatttgtaaccttgttttcaactatttcaaattatcttgcaagtttggtttactttattcacttaccttttactttgaatttctaaactttattcaaattaatccaaaaacttgtgctattaattggataaaggtcttaactccctcctttcacttgtctttagatgccgcgctacaagcttgagtacctgtttggtgttgagggttttgtccaggagttgcgtacgatgtcctttgccattggatttgggactgcccctttttatgcccagattcctcatgatcgtcatgaagagaagtgccgagtcaaagtcaccttgaacagcaatagtgaagagatcccctcagtgatgttcgaagctggaggaagaaactacatccatgcatgtcaggaagtggcaaggattgccataggagagctccgtgatcgctatagtgatcagttggccgacactgagtatcgctaccatcctcgtcaaccccagggaagtgaccgtggcagctaccttgagactgaaggaattgagaatgatgctaccacaaggcatttggttgagatgctgtgggctatggatgaaggtcgtgcggagactgtgttagcggctcaagatcgtgaagaccggaatcgtggtaagatttgcaagttagaagacaaggtggatcgtttggaaaaggaattagccgcgttaaagggagaagcaccgccgcagaaggccaggattcgtcttaccgcaaggaagagagctttatttgtccctcgctatcaattggcgccaaaggtccgtgtggtggagaaagaagttgccccatcccaagcggatccttcggtcatcatcataagtgatgaagaagaagaatccaagcgcaaccattccaagattgagtgggtagcaacccaagatgatgaagacgagccgaacgagccttcaatcgacctccaatgcttggaagaactagagtgacttgttaagtcgttgtcttagatcgttgtgttagtttgtttgctttaagtttgcttgtgtgtggctcgcatgtgatttacatcagtggtgggatgtaattgcatgtgtttgtttgcttttgagtgttaggaagttggtgagtttagtggtgtgagagtcttcagtttgtaataatgaaactcagttaagatcaataaaagttaaagtaattctctatcctaagtagttccccggtttctcttcttgtgccctgttcctgccagatggtgaacactcgcagcaatgggaatggccccaacaaccccaataacaataacaatggagagaacccaactctggcccaagttcttgctcaacagacacaactcatgaacatgatgatgcagcaatttcagaatcagcagaaccaaggaaataactatgcacctcctcagaataagttagcagaatttcttcgtgtgaggccgcctattttctctagtaccactaatcctgttgaagctggtgattggctgcatgccatagagaagaagttggatttacttcagtgcactgatcaggagaaggtatcttttgcatcacatcagttgcatggctctgcctctgaatggtgggatcacttccgcctgaataggactactgctgaacctatcacttggcttgaattcactgctgctttccggaagacgcatataccatcaggagtagtgtctctcaagaagaaggagttcaggtcgcttactcagggatctcgctctgttacggagtatctgcacgagttcaatcgtcttgctcgttatgctccggaagatgtgcgtaatgatgaagagcgtcaggagaagtttttgggaggacttaatgatgagctttcttacccactcatggttggagattatcctgatttccagaaattagtggataaggctatacgttaggaggacaagtacaattgcatggagcagaggaaacgtcggattgctcacttcaaggcacaacaggggagtaatcagaagccgcgccttactttaggaccccagtctatgccacagggaggttcttcatctgttgttcgtccgcagcgtcagttcttcaacaacaatgctggcaacaacatccgcaatcaagctccacgtcctgttgcagctccaacacagcaacaacctgccaagagggagcaaggcagcaagcccgtggtatgtttcaactgtggagacccaggacattatgctgacaagtgtccgaagccccgtcgcgtgaaggttgtccctgctcagaataactctgctgtaccagcatcaaaggcccgtgtcaatcatgtcgctgctgcagaagctcaagatgctcccgatgtgattttgggtacgttccctgttaactcagttcctgcaacagtacttttcgattctggcgctacacattcattcttatctatgagttttgcgggaaataatgggatggaagtagaagatcttagacgtcctttgatggttagtaccccaagtgatcaagcactctctttgcaacgtagcccctcggtcagaatagaaattaagggagtaccatttctggccaatcttatcttgttagaatccaaagaccttgatgtcatcctagggatggactggttagccagacataaaggtgtgatagactgtgctaacagaaaagtaactctcaccagcaatgatggtcgagttgtaactgttcatgcattgtcatctgagtctttaaggtcaagactgaaccaaataactttggaagagattcctatagttcgggagtattccgatgtgttcccagatgatttacctggaatgccgcccaaaagggatatagagttcagaatagatctggtaccaggaacaactccaatccataagagaccttatcgaatggcagccaatgagttggcagaagtcaagaggcaagtggacgatttgcaacagaaaggatacatcagaccgagttcatcaccatggggagctccggttatttttgtggaaaagaaagaccatacccagagaatgtgtgtggattatcgtgcactaaatgatgtgactatcaagaataagtatccgctgcccagaattgatgatttgtttgatcagcttaaaggtgccactgttttctccaagatagatcttcgatcaggatatcaccagttgagaatcaaagaggaagatatacctaagacagcttttaccactaggtatgggttgttcgaatgtactgttatgtcttttggacttaccaatgcccctgctttcttcatgaacttgatgaataaggtgtttatggaatacctagacaagttcgtagtggtctttatagatgacattcttatctactctcgaaccaaagaagagcatgaagaacatctttgccttgcattggagaagctacgagagcatcaactgtatgctaagtttagcaagtgtgaattttggttgtctgaagtgaagttccttggtcacgtcatctcagccggaggagttgccgttgatcctagtaatgtggaatccgtaaccaactggaaacaaccaaagacagtttcagagattcgcagtttcctaggcctcgcaggatattaccggaggtttatagagaatttttccaagattgctaagcccatgacacgactgcttcagaaagatgtgaagtacaagtggtcggaagaatgtgagcagagttttcaagagttgaaaagtcgcttaatatcagctcctattttgattttacctgatccaaagaagggtttccaagtgtattgcgatgcatccaaacttgggttaggttgtgttttgatgcaagatggcaaggtggttgcctatgcatctcgtcagttacgtccgcatgagaagaactaccctactcatgatattgagttagccgcagtagttcatgcgttgaagatttggcgtcattatcttttcggtactcgtacggagatgtacaccgatcacaagagtttaaagtatatttttactcagccggatctgaacatgagacaacggagatggttggaattaattaaggattatgacatgggaattcattatcacccaggaaaggctaatgttgtagcagatgctcttagcaggaaaggttattgcaatgctacagaaggacgacagttgccattggagttatgcaaggaatttgaaagattaaatttgggaattgtcaatagaggtttcgttgcagccttagaagcgaagcccactctaattgatcaagttagagaagcccaaattaatgatcctgatattcaagaaatcaagaagaatatgagaagaggaaaagctatcggtttcttggaggatgagcaaggaactgtatggttgggtgaaagaatctgtgtccccgataacaaagatttgaaagatgcaattctgaaagaagctcatgatactttatactccatgcaccctggtagtactaagatgtaccaggatctcaaggaaagattttggtgggcaagtatgaagcgtgaaatcgcagagtacgtaccagtatgtgatgtttgtcagcgagtcaaggcggaacatcagaaacccgccggtttgttgcagcctttgaagattcctgaatggaaatgggaagaaattggtatggattttattactggtttacctagaacgtcatcaggccatgactctatttgggtaatagtcgacagacttaccaaagtggctcatttcattccggtaaagacaacctattctggaagtcgattggcggaattgtatatggcaaggattgtgtgtttgcatggcgtccctaagaagatagtgtctgatcgaggcagtcagtttacttcaaatttttggaagaaacttcaggaagagatgggttctaagctgaattttagtactgcttatcatccgcagacagacggacaaaccgaaagggtaaatcagattttggaagacatgttgagagcttgtgctttagacttcggtggaagttgggataagaatctaccctatgcagaattttcgtacaacaacagttatcaagctagtctacagatggctccttacgaagcactgtatggtcggaagtgtcgcactccgcttttgtgggatcaaacgggagaacgtcaggttttcgggacggatatcctaagggaagcagaagaaaaggtgaaaatcattcaggaaagattgcgagtggctcaatctcgtcataagagttatgccgacaatcgccgtagggatttgagttttgaagaaggagattatgtgtatcttcgtgtcacgccttttcgaggagttcatcgttttcgtaccaaaggaaaattggcaccgcgttttgtgggaccctataagattgtcagtagaagaggagaagtcgcttatcagttggagttacctcaatctttggcaggagtccataatgtgttccatgtttcgcaattgaagaagtgtttaagggtacctaccgaagaagctaatcttgaacagataggagtccaagaggatctgacctatgttgagaaaccaatccgtatcttggaaacaagtgagagaagaaccaggaatcgagttatccgtttttataaagtccaatggagtaatcactcggaagaagaatcaacttgagaacgagaagatgaattgaagtcagctcatccgcaattgttcgccagttcttccgaatctcgaggacgagattctgtttaaggggggtaggtttgtcacaccctgaaaattcaaaatttataaattgttgtttaaatggaatttttagaaataattttaaaaagtcttgaaaagaaaatctaattttaattaataaattccaatataaaatgggcccagataaaatttcattaaatactttgcttaattctataattcctagatttttctgggatttatttgagctaagaaagtatttttaataaatggaattgcatttaagaaataattttaattgaaaaaagttttaaaaagtcctcttttggctttgggctgaaagtcggcccaaaatctctcttctctctcctcggcccagccggcccagtccgccgcagccgcgcgcgccctcgctgtcgctgacaggtggggcccacctgtcagtcgtcgtctaccttcggccgccgccgcccgaaaccctagtttcgcgccgccgccgtttcccttccaaatccggccgttcctttccttctccggccgaatcaatagaggggaaacattctccgggatctcctctaccttttctccttttggaatctttggctaaatcgctttgaaaagagtggattcgagttcgtctcggatttggtcttcccgagctttccttgcccgttgccgtcgc

SEQ ID NO: 59607 - DNA, 43543 bp, Oryza sativa
ccgtgcatttggtccaagaaatcccactcttgtatcaatgatatgggaaaggaaagacttcaagagactcaccccaagggacattcttggaagaattgtgtctcatgagatgcaagaagaggaagctcgtgaagtgagacaaatagtgaagaatgccgctatgatcaaaaatcaagaagttgctttgaagggaaaacaagaagaagagtcaagttgtgaagaaagtaaagatgaagagatggcttttattgtcaagagattcaagtactttcttcgcaagagtggctatggcaaagggaggaaggatgatgataagggaaagaggcaatcaaagagagcatgcttcaattgtggcgaatatggccacttcattgccgattgtcccaagtcaaatgaagctaaggctaagggaggcaagaagaagccgaagcgtgctcatgtggcggaggcacacatggcggaagtgtggtactccggagatgaagaagatcccgatcacgaggtcaagctcaagcccaagtcaaaagacaaggttgaaggagaaggtggtgttgctaccgtcgccttcaagtcatcctcttcaagcaaggagcatcttttcaacaacttaagtgatgacgacgacgactcctaccactactcttgcttcatggcccaaggccgcaaggtgatgactcaaaagccctctcaaacttctcttgatgttgattccagtgatgaggaaagtgataatgaattagatgatgtacttaagagctttagcaaacccgctatgcaacatttggctaagtgaatgagagctttagatagtaaagaacaatcactcgaaaggtaagaagaattgcttattcttgagaagaaaagaaaccttgccttagaggagagcttaactaaagaatgtgctaaaaatgaacaacttgctaatgagcttaatttggctaatggttctttagctagccttagggatgtcaatgaaattcttcaagaaaaatttgttaatttagacaaaagtcataaagatcttgaagttcaatttgacactctttggaatagcacctctcaaccaaatgtggtttctaattcttctaaccctactactagcaatggttgtgctaggtgttacaatattgatttgaactcttatgctactaatattgatgctatgcaagctcttaagaaagagaatgaaaggttgagcacattggtgaaatatggatgcatgaagacataccattcaaaagatgccctttacaagaccatcaccgctcatcctaacaagaatggacacggctcgggttttcgggtggaagtcatgtgtctaagcgtgtgatggtaaatgggaaagaatgcttgatgtttgtgagagaaggtacgtaaagcaccacaagcaagtgaggtgactagtcttgtgagctgccagggacccggaacatccggacaaaccgggagaaacttccgggtgggagtctctgtctctcaaaaattcccaccaggaagttccgggccaatggccgtgcacacgatatgaccggaagttccggtcacaatgccaggaggttccggccagagggtttttactatgattcatatgtaatttccaaaaattcagagggcaaagtggttgcctattttaatgggaattacaatgatgagtaccgcacttgtgtgtgggtgacaaaggctttggtaactaacatcaagggacccaaacttagacaagtttgggttcctaaatcccaagcttgatttcttttgtaggcatactcctccggtggttcaagttaggttgtggacagtggttgcaccaatcatatgactggagagaggagtatgtttacaagtcttgatgagaagaacggaactcgtgagaatatcatgtttggagatgatggtaaaggaaccgtaattggtctaggtaaaattgccatctccaataatcaatctctctctaatgttcttcttgtcaattcattaagatacaatttattatccgtttctcaattgtgtaagttgggttacaattgcttgtttaccgatgaggatgtgaccgtctttagaagggatgactccgttgtattcaaaggcaagttgaagggtgatctctatcttgtcgatttcgatgtggatagagtgaatccggaagcttgtttgattgttaaatcctccatgggttggctatggcatcgtagactagcccatgttggaatacggaatttggcaactcttctaaagggggaacacatcctcgggctcactaatgtcacatttgataaagatcgtgtgtgtagtgcttgccaagccaggaaacaagttgggaatccacatcctatcaagaacatcatgactacaacacgccctcttgagcttctacatatggatttattcgggtccatggcctacataagtattggaggtaacaagtatggttttgtcattgttgatgatttttcccgcttcacttgggtgtattttctccatgacaagagtgaggctcaaaatgtcttcaagcgcttcaccaagcaagcccaaaacctctatgatctcaccatcaagaaggtgcgaagtgacaatggagaattcaagaacactcaagtggaggaattccttgatgaagagggaatcaagcacgagttctccaccccctatgatcctcctcaaaatggcattgttgagaggaagaaccgaactcttattgaagccgcaagagcaatgcttgatgagtacaagacttcggatatcttttgggcggaggctgtgagcaccgcatgccatgccatcaatctcctctacctccataagatcctaaagaaaacttcatatgagctcttgagcggtaagaaacctaatgtttcatatttttgtgtctttcggagcaaatgctttattccgagtaagaggcctcgctcatctaagttctcacctaaggtggatgagggattcttacttggctatgaatcaaatgcacatacctatcgtatcttcaacaaaacatccggtattgttgaagtcactagggatgttacatttgatgaatctaatggctcctaaggagagcaagttgttgtacatgttgtaggtgatgtggatccaagtcaagctataggtactaaggctattggagatatacgactagtcgagacgcaggatgaccaagaagatagggatcaacctccgtcatcgacatccaatagccctacaagtgctgtgtctgctgagccggaagttccaggtcctattgaccggaacctccggacatctccaggcccagaagttccgggttctacagtccggaacctccggaccagcggtagtgaagacgtgccaacggcgcaagtggatgggatcgatgttccgggcactttagagcatactgatcaggctcaggtccccccagtgcaccatccaaggatacatcacattgtccaaagagatcatcccgtcgacaacatacttggtaacataagaaaaggggtaactactcactctcgtgtcgcaagtttttgtcaacacttctcatttgtctcttctttggaaccaaccagggtggaagatgcgcttggtgatccggattgggtgatggctatgcaagaggagttaaataacttcactcgcaaccaagtatggtctttggtggagagacccaagcaaaatgtcatcggtaccaagtggatcttccgaaacaagcaagatgaacatggagtggttgtaaggaacaaagcccggttagttgcgcaagggttcacccaaatcgagggtctcgattttggtgaaaccttcgcacccgttgctcgccttgagtcaatccaaatgcttttagcctatgccgctcaccatgatttcaggttatatcaaatggatgtcaagagtgcctttctcaatggacccatctcagaattggtctatgtggagcaaccaccggggttcgaggatccaaagttgccaaaccatgtgtacaagctccacaagacgctctacgggctcaaacaagcccctagagcttggtatgaatgtctccgagatttccttttgaaaaatggttttgaaattaggaaggcggacactactctcttcactaaaaagcttgaaaatgatttattcaattgccaaatttttatcgatgacataatatttggttctactaatgcctctttttgtgaagaatttagtagtatcatgactaaaagtttcaagatgtctatgatgggcgagttgaccttcttcctcgggctacaagtgaaacaagcacaagagggcaccttcatctctcaaaccaagtacgtgaaagacatactcaagaagtttgggatggaggatgccaaacctatcaagacacccatgcctaccaatggccacctagacctcgacgataatggtaaatgtgtggaccaaaaggtatatcgctccatgataggatccttgctttacttatgtgcatctcgtcccgatatcatgcttagtgtttgcatgtgtgctcgctttcaagcggagcctaaagagtgccatttgattgccgtcaagagaattctaagatatttagttcatactcctaaccttggcttgtgatatcctaagggttgtgactttgagcttttgggctattccgattcggattatgccgggtgtaaggttgatagaaaaagcacaactgggacttgccaatttcttgggcagttccttgtttcttggtcctccaagaagcaaaattccattgcattatccaccgccgaagccgaatatgtcgccgccggttcttgttgtgcccaactcctttggatgaaacaaactctaaaagactttggctacaacttcaccaagatcccactcctatgtgacaatgagagtgccatcaaaatagccaataatcccgttcaacagtcacgaaccaaacaaatagatattcgctaccactttttgagagatcatgagaccaaaggagacatatgccttacccatgtgagaaccgagaaccaattagacgacatattcaccaagcctttagatgagaaaagattttgcgagcttaggagtgagctcaatatcttagattctcgcaacattaggtgatgggtggttggctaatttatagccaaacatgtatcactaaaatgtaaataaaaaaattgagtttttgtgtcctgtgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaataaataaacggcgcagacggctccactccacaggcatcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttcagaatttaataaaacagttaggtattaattaagcaatattaatccaacgctatacaacataccctgttgtataggcccaaccattctgaacaaccaccccggctgcacagttctatctccaaaccaggaatataccattccaaaccaggagctaatcaaattattactagtttaagcatcttttattatgatgagaggtgtgagactaatcacgaaagacattgttcgacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcataacacaatccactgcagcgcaccttcctggatcataatcacccccttataaacaaggcatggactccccagcgacccccgtgggcttatctgtcacgcccagaaattcccgaatagaattccaagcagaatgtgtattaaaacccccgtccaggaccagccagggtacacaaacgacaatgttgacatacagatccacgtcttacaaacattataaaggtcttacagaaatgcagcggaaaacaaaagataactggagctaatccttgacttgaactgcagcgggaacaccactccacaggcatcctcgacggcacggacgaagcctactcctcggagaacccgccatcggacacatactcgagctctgaggttggggggaaaagtagagcaagactgagtactacccactgtactcagcaagtcataccggaatagaggtatgatgcagggatttaacaagggatagctaagcaggttcatttgcataaatactggcatttataaacaggaattgaatgcgaaaacagttgtaataattaagcagtattaaacatccgctgtccaacgctaacccacgttgcgacaggcccaaccatccacctaaactatccaaattcaacagattacactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcgacgggcagtcccctctcgtgcctaggtgaatccggaagcgacagaggccgtcgcagggcccgccccgctccatcacgcccacccttgcctggatgcgtcgactagaggaaagctacactacaagcccagccgttgcccacgctggcttgtggtaagtacgataaattcttccagggcatcccgcgaaccggtccttaactgccatgggtgcgactagcaaaaccatgcacccacagcccaccatgtggttcattttatttaaccaacaccagagcggtggtattaaaccaacattatcatataaacctatagtctaggttttaaatgagatccccaatgtgtgctagttgaactaagcatggctaagcaattcctagtccaaagtctaatcatgttataacccaagctaacaaaggagcatgatatccaaaagcatggctgtaacaataggtatccatcccatagtgatattataaaacaatgcaatatttgaaagaaaacaatagagcatttgcaatataggatcaacatgttcaagtgacaagcatgacttgccttgctccgctgctggagggacctcggcgactatctcgaagtacaccggagcgtcggagggatcggaatctagcgacataccaagcaaacattgcaaacaggctataagactactgaaacagagaacaaaaccatttttaatggattctacacatttttcttgatttactgagacttgaatgggattaaacggagctcggatgaattagttatgaattttagaagattcactgtgtttattactataaaagaaatccttaaataatttattgcgcaatattaaccagggctgacgtcagcgagggggcgcggcgccgacaggcggggcccaccggtcagcgaccgggagagagagaaagggggtggcggcgcgcgggcccacgggtcagcggcacgggggaaaggaggggcggcggcgccacgtggcggccgaaccgacggccccgatctacccaagggtagatcggacggcggcgggacctcgcggccggggcgcgcgggcgcggcgcgagacggcggcaaccatggcgccggcggcgcggcgctcacacgggggcggcgcgcatgcggcagcggcgcaaggcggcgaccgaaggcgaccgaccggcggcggggagcggcggctagaggaggagcggcggctacgcggctaagcggcgcgcacgcggctacccggtacggggaaaaggagaaagaggagggggaagcctcaccggacaacggtcgacgacggcggccgacggaggacgacgacgacggcgggacgagctccggaacctcctaacgaacaaaaggagagggattagagagagaggaaagagcgtgggagggcgagagcgccggccgaaggcggcggccatggtgccacttgccggcacacgacggggatgggtctccggcggcgaacctcgacggggaaggggcggccgaggtagatctcgaccccgcgaagctaacggcggcgacggcgcgagacggcgacgagcctagcggcggctagcggcggacggagtagcaaaaacggcggcggcgggtggttgcacggcgcggaggcgatggggagctcgggagagatcggcgaaatggggaaaaagcgagagaggaggacggcgatgcttaaaaagggggagagggagccggacgtggccgggagcggcgggattcgacggccgacgtgggggagtggggaggagagagaggcgggattcggttttcgaatcccggccatctcgggcgcgggcgcgaacgggagggagaggggaaagggcgcgggagacgcggcgcacgcgcgggcgtggccgacgtggcccgggagagacggaggcgtgggcgcggcggcggttttggcgcggcggcgcggcgggatcggcgggaggtgggggaaggacccgacaggtgggccccacctgtcggcgaccccgagagaggaggcgggcggcggctgccaggctgggccctcggcctgcggccggcccagcaaggaggagggggaggaaggaggggaatgggccggcggcccatccgaaaagaaaaaggaggaaaaagggagggaaaagaaaaagaaaaaggaaaaggattttccctggaattaaaaattgcactttagtgatttttaattggttaaaattatttctagagctctgaaaattccactaaaaatcctgttaatgaatttcgacatgtagaattcaagaaaaattccacatgtcaaatccgattattatttgcattgttttcttagggttttatcctgatttcctctgcattttcttggggtcatttgtaatttacaatttggcttgggaggaaaacttcggggtgtgacattatctccgccacttctcagtctggtgccccgcaatgaaccatgctatacaaaagataaagccgttgcccatgctggcttgtggttggcacgattaatgtttcacaatcgaaactcgtgaaccggtccttaattgtcatgagcacgaccatcaaaaccatgtgctcacaacccaccattatcaggttttagttggcacattaattaattaactaatcacgattgaccatcgtgaactatcattaagccatcattaaataatagtgagtcataagttatcccaatagtgagctaatgtttctaagcagggctaagcaattatatctaatatctagttgaaccaatataaataaagctcaactagtcaaattataacccaaggtatcaaggaataaagtaatcaagaacaaaagggctataacaaacaataggttaattccacccaatgacattcgaaaataaatgcaatagttgaaaagaagcaatagctttaagtaggatcaacatgctcaaaggattgtttgggatctgtgtgacttgccttgctggccttggaactcttcaaactcttctccggcgaaaacggactctccggaaacgacggaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaaccggattaaaacacttaaatcggttaaaattgaattatgacgcaataatgaattatttttgaaaaggaaaagaggatttattgcgtcagcgggctagggtttcggtggaccggacgcacggcggcggttcacgcgaacggacggccgagatctaaccgatccaagatggacggccgagatcgatcgggtccacggcggctcacggcggacgaccccgatggcgtcagcgatgacgtcaccccggcggcggcggctcggcggcggtcttcccgagcgacggcggcgtctggaacggcggcgaagcacagctggagcggcggcggcgacagcgaagctagggcttgcggcgctagagcgattccgacgacgagaggcgaaggcgagggtggcggcgggtagaggagagctcggggaggcttttaaaggggctcggaggtgaaggcgaaggcccacggcggccggcgacgaggaaggaaggttcggcaaaaacgaatctgagacgaactcgaatccctcgatttccaaaccgatttagccgaagattccaaaggagaaaaggtagaggagatcacgaggatcatttcccctctatcaattcggccggagaaggaaaggaacggccggatttggaaaggaaacggcggcggcgcgaaactagggtttcaggcggcggcggccgaaggtagacgacgactgacaggtgggccccacctgtcagcgagcgagggcgcgcgcgcgggcggcggactgggccggcttgggccgaggagagagaagagaggttttgggccgactttcggcccaaagccaaaagaagactttttaaaacctttttcaattaaaattatttcttaaatgcaattccatttattaaaaatactttcttagctcaaataaatcccagaaaaatctaggaattatagaattaagcaaagtatttaatgaaattttatcttggcccattttatattggaatttattaattaaaattagatcttctcttcaagacttttaaaataaattctagaaattccaattaaacaacaatttatatattttaaattttcagggtgtgacatcctgagatcacttcttggtagaagatggtcttgataccaggaataaagctcaaacattcaccctatatccaaaaaccccttttgtgaaaatttttgcaaattccttgctgtgccttttattgcgaaaatttggcttttatccccttcttgtggtgtatattgaccatggttatgtaatgttgattgtaggctggtcatatacgtcataagtctctgcatgtccatagttccctatttccccgcgttgaattctcatctcttccttgtttttggtcctgactgccctttatctgtcaggccggaagttccgggcctccttgtccggaacctcggggtatcggggagtatatatactcagggggagttagaagccccattctctctcctcatttcttctctctccccgacgccaaccctagccgccgctatagtgctcctagtggcgattttcactttcgtccaatcaaattcgtttcttctccgtggattcatccacattggtggctgggaggttctttctgtgatcgattcgcagtttcttctctcaaggtagaacttttggattccctctctcggttcattgtgtttttatcccgatctctaaatctgtgaaccttgggagaaaaccacttggatagtcttgtttctgctaccttgttgatcactgatctataggatttgttcacatgcactggctatttttgaaacctctgttcttcatttttgccggccggaagttccggtgttcttgcacccggaacctccgggcgctgtccattcagcctgccattcttgtttctctcaaattttgcctaactactgcactccaatttgttgattcctgttgcagtaagtactatgactcgtgagaaaagacagaaagcctctcaggatgtgtccggtgatgagagtcctcctattcggtatcctcgtggtcgtttgggtaaagagaaagtggttgagggcggcagtggcagtggcactcgtacttctcccagatttacaaggcaatccagcaaccgtcctgttcagattagggatgttgatagtggtcaaggaagtgatgcccctaatacaagaggtcacgggagaggtggtggtcgcagttctggggctggaagggcatctcatgatttccctgtaggatctcgtgagaatcccgttcggctctacaagactcttggttttgacaccactcctatgcaccacattggaagacccaagtccaactaccttcatcaacttgccaagtgtagacgagatcgtttgattgatccagagtcacagcctgaggagtgtcacgccctaaaaatcgtctaaattaataatgcgtattttaaatcatttttagaaattattttaaaagcctacaagttaaactctaataatcaaggaaaattatcaacataaaattgagctagataaaatttcattaaatactttgcttgtttatctattttctagatttttctgggaattatttgagcaagggaagtatttttaataaatgaaacatcatttcacaaattatttttattgaaaaagtcttaaaaatcctcccctaagtcgttgggccgattcgggcccaactcttctctccccgcgcaaggccaagccggcccaagcggcccaagcagccgccggccccctctcctcctcacagccgccgacatgtggggcccacatgtcggggttgtcttcaacctccggccagccagcccaagcccgagccgccgccatcccccgccgattccgccgccctcggtcgcgatcgagtccgattgtttgaggggttttggtccccttgttgtcctctatctatcccccaaaaatcggggctaatcgcttcgtatcttacccgaatcaaactcgttttcgagtttatccccaaaacctaaacctagtttttctcggtccgattactcgcggttggagtctgatctctccaatataaggctataaatagcaccccctagtcgccctctttcgtttgccccatctcccgagctctctcgtgccccgtagcgccgccaccgcgccaaccaagccgccgccgccgccggccgacgtccagccgcgccgcgccgtcgttttagccgtcgccgccacctcctctcaccgccgtcgggtgcgcatggaagaggggaagctcggccgccccttagccatcgccgccggccgccgtagcgccgtcgccgccgctgtccgagccgagccgccgtcgagcctcgccgccggtcgccgttcgacgtcgtccgtcgtgttcgttggtaccggtgagttcgcaatgttgtcctctacgcgtagatgccctctaatagcccggccgagcctcctagcgccggtggttgtgccgcccgagccatggccggcgacgatgacgtgatgacgttataaacctttttttaagttttctttattagatgcaaatcgattaaaacttcggaaattcataactaattcgtcgtagctccgattcgagtggttcaagttgctaaattttttctaaaattgagatctacatgttaaaaatatccacatgtactgtttatgcttgtttttgtactgttttgttgattttatttttttgctctagtttcaaacgttcccgaggagagcgtttcagttgaggaaggttcggaggtgtttgtggaagctcaaggcaagtcacacagatcccaaataaccctttgagcatgttgaacccgtttaaagctaatgttttatttcaacttatgcattattttcgaatgtcattgggtggtgaaccttttcccaattaattaatggccgaagataactttattttcctatgggttataatttgattagcttggaccttatatattggattggttcaactagatgctatatgtatatttgattagccatgcttagaaatatcagctcattaagggatgaattatatatatcacattattaattatggatatatttaatggtagctcacgatggttaatcgtgttatgttaattaattaataactaaaacctgattaaaggtgggttgtgagcatatggttttgatggttgtgctcatgacaattaaggactggttcacgagctactgttgtgaaacatttaccgtgccaaccacaagccaacatgggcaacggctttatcttttgtatggcatgattcgttatggtgtgccagactgtgaagcggcgagaagtccgtgggggtcgctggggagtccattgcctctggtttagagggggagattatgatccaggagtggtgcactgtggtgagttgtgttgtgtgaggggtattgtcacagttcctttccgaggtaccgtggtggtgctgaggcgcatggtgacatgttgtgggattgtatcttgtgggtacagtggtacacctctaatcagagtaaaactattcgaatagccgtgcccgcggttatgggtgagttgagcaatgtttttcgtgattaatcccacactattcattaatggtacttgtgataattaatttgactcctggtttggaatggtatattcctggtatggagtttggatttgtacaaccggggttggttgttcagatgaggttgggcccatgcaacacggaagtgttgtatggtgtttatttaatactgcttaataattcaactggtttactattctcataaatatttattaaatgctgtttatgcaaatgagctttattatgccgtcctttgttatcctatgcacttgcatatttgctgtgtggcttgttgagtatgtcatatgctcattcttgcaatattcattcatcagaggaggagtacttcagtgaaggtgatctggaggactaggcttggtccgggttaagttgcctgtggagtggagtctccatagttgttccgtagtttgcttttattttttttccgctgcgtagaatgttattctttgagaggaactatccacctctgtaataatttattatttgcgaatattaaatagctgtttatttgtactctattatcgatttgttattgtgtgcctcggctgattcctggacgagggtttaacacacatgtaagcgtttgaaattttgggtagaaattccgggcgtgacaaggagtcacaggatcctcgcttcaggactttcactcaattggattggtataactcagtgattatggctagagagaatccagtggttgagatgaagtgtattgattgggcttacatgaggaagaaaaacaatgaagtgttcaaccaagtgatgcaagtgtgccacaatgtcacgtcctgataaattcatcccaaaataaaaatcattccctaaaaggaataatagaattaattaaaattcgaaaagaaattggcaaacactaaaatacgtacaagaaaaattcgaatgtggcccggagaatttttgttaaattctccttggtctaaaaagagccctcaaattttacttgaattttcagagcaccggaaataattattaagcaacaaaaataattattagagtttattaaaaagaaaaacctaaaaataaccctccccttccctttgggccaagtgtggcccaaggtttctcccctctccctctcggcccgcggccgaagtccctctctcctccctctctttctctccctctccttctctccctccttctcttgggcctcctccttccccggcccactccctcctcctccctctctcccccgggcccccctcccctcctctcctcctgggccggccgcccggcccacgccgcgcccctgcccgagccgccctcctcccgcgtgcgcacgcgcctgtcacgcacgcgcccacgcgcgttgaccgcgcctggcaggcgggtcccgcctgtcggacccgtcttcctcccccagccggcctcgtctctctctccccggaaacctagcgccgttcctcccctaaatccacgcgaatcaatgcccttctttccaaattgattggggggaattaatccccattccttcctcttcaattccccccaatttcccccttgaatggcgcccccaatcgtcgggaacggacgcgtctttcccggccgctttccatggccgccggccgccattcccgcctccgttccgaccttccccgtggccggctccctctcctctcctataaaatggaaccccctcactccgttctctcgttttagccccctcccgcgatctcccgtggcctcaccacccctccctgccgtcgcccttctctttcccccacgccgggcgcctccagccgcctctccctcctcgaccgtgcgccggccggccgtgccgtcgccttccccggcgtcgcagccgcctcctctcccccggcctgccctccgtttcgcgcggtgaccgccggaggcgcgttcccgccgtcgtccagtggcgttgccgccactgtaccacctccagccgcccctgccgcgccgctcaggtgcgggccggccgcgccgtctcctccctcggcgtcgccgcgtcgacctccaccccggcctgccctctgattcgtccggagaccaccgtcgtgccgcgccggcctctccatcctcctcgccggaatttccccggtcgaccgcgtcgccgtcttctccggcatcgcagcggcaaggtcgtcctcggcatcgcttcccctccatccaaacccctccgcggtccatcatcgtcgcctccgttcgttctcgtcgtcgacgtcccgtcggtcgcccggctcgtcgtctcgtggcgccacctccgtcgtcggcatcgctgcggcgtgttccacgccgtcctcgcatctgtgcagctgctgccggctgccctcgtcgcctcctcgccggccccggtcatcgtcgtcgtcgtcctcctcttgttgtcctcatcgtcgtggcgttcgtccttccgtcaagccgttcgcgttcaccgcccgcgtttcgtcaagtgtgcagcatccccgtcgtcgtcttcgtcctcggctccgcgtcgtcaagccttgtgccggccgcgtctcgccttcgtccaaggatcaccgccgaagtcgttccctcgccgttcgcctccatcgtccccgagctgtctccgccgcgcccgttcgtcgttgtcgttcccatgcctcgtcgcgtggtggtaaggatccctctccctcgctgccccgtcctcgtcctttcggtgccgcccatgcccgttgtgcggttgtcggccccggtacccgtgtatcggtgtcggcagtcgttcgcttgtgcgtgtggtgaccgtgttagtgtgtccgctcggtagccgcgtggtttccacgtgtgcagcccgtgtggtgtctagtggagttcgtttgtcggccactcgcctcggttgacacacgggatctgcttctgtcgacccgtggaccgtctctgtgtacccggtctaccacggtcctttaggttgacatgtggggtctgcatgtcaacagcgcagccttcctgtcttttccagactagcgcttacacatgttttatagttgcaaagcctaattacaataatccgtaaatctccatgtaacagcattaaacttcggatgatcatatcttggtcatacgaactctgaatcgacccgttcaagtctcctaatgtttgttataacctaaagaaccgtgtgctttctttttatgtattgttattgcttctttataggcttgtagctttgcttgtgtgcttcgcgtagcttctgtcgttccggaggttcttgaagcgtggttcgcggtcgtcaccgaaggttcagcaggccgttctctgtgagcaaggcaagtcacatcatccttgagcatattgaatcccagtctataaaattattttgatttaaattaatgcattatcgctttatttaaattcccgcgttatcactgttttatttagccatgcctatttacctttgttatgaccttattattgttattgatattattaccttgttcaccctagaataaacaaaaccccaactagtgggcactctattcatggttccactagtatgaatttaggtaggtgcttcgctgattaattaggcaacattaggtggtttttataactctagactttgggaatattcatatcacttggacatattggaatggtcggattattgtggaattggatgcacacctccccctctattcaaaaccctcaaaatggttttaggctgggctcggggtgcatggttttgttagtagcacctcggccacataaggaccagtcttcgggcctctgttgcaaagcactaccgtacttccacatgtctagtgggtaaggcttagtttgtggctcagtctggttataaacaaaagtacacggatggagatggacgaagtgggggcttgatggacatctctaggacaaatgaaggctacacgggctgcggcccggtagtcgagatgtcatggcacagggctggtgtcctgctgctaggggctcaattctgcctgcctgtccgggggttccggccgtaggtgggttgggtcggtactcttgtctatggctaggatgggttggaaactatgtcatgtcttctgtccatatgccgtggtggtatgtggcacgtggttgcacgtgaggaagacgtgtcttgtgggtaaagatgtacacctctgatcagagtaaaacctattcgaatagccgagccctcggttatgggcaagcctagcaatgtacccaagttagtgttttaaattcttaaaacctgcttaataactaaaatgtggaatggttggcctgggttggcttggaacgagctgggacccagggtcgggttgccagttcggtctgaatcatcgtaggccttgggttaaggcaggttcgtgtgggtccacggccttgcttaataatattgtatagctctaggatcgtgtttacaaaatagctttgggcaactaagtgacttttaaatgctgtttactgcaaaacttaacccctatatcattatccccttgtacccctttgcattaattatgcatctccggtgtggcttgctgagtactgtggttgtactcattcttgctctatctttccccccttcagtaagagaagctttggagaagaagtcttaggtggagtcctggcttataccccagttgagcgcctgtgaagatggagccgtaggcccgctagtccgctgctgtttatttttgtttctcaggcctaaagtgtctttgtaataatgtaaatattatcgatataataaatatgtgccttttgtatcatgtttgtatggtgtacctggcttttcctgggatggggattaatacactagcgttcgggaaaaggtaattttctcggtcgcgacagtagttttactataatataaatagaaatgcatggttttgcagagaaatcagatgtacttgacttctgcaagctgggatgtacttcttcagtgtgcagcaagataaacacttgtaagctggaaaaacatgaaactgaatcaccattagttttcaacgaaaaaggccaatgcgtacgatcattttccttttcatttcagttgctgccaatgaaggagtgaatgctgccgtggagcgttgcgagcatgcatgcgatcgcttctgcacaaatgaagctcagactgtcaccgttgtgtcctaatcaaacgcaacatgcaaccagaaagggtttcacacacatcgaagcccatacgaggctatgaacctggagtagtcataaataagttggatatcctgatatccaagccagtgtgctatcaacttctcttgttttgtgtctctttgtatttccaataagccatgataattgcaatatgttgtcttgtcctgaggacatgagcatacgataagcgatgatatcattggcaaataaataaactttctcatttgttttacgccaatgcctcatgagttaagacctgtttagttcccacgcaaaaacttttcaccctgtcacatcaaatgtttagacacatgcatacatggagtattaaatatagacaaaaaaaactaattacacagattgcgtgtaaattgcgagacgaatcttttgagcctaattgcgccatgatttgacaatgtggtgctaaagtaaacatttgaccatggttagatccatatattcttacacttgtgtttttttttttttgcttttcttttaccttaattgtgatggatctatgtattttaaattgtcagtgtagagattatggtaccatatacgtagatggatgggctatccgactgattataggggcctcgggtattacgtttgcttgtgtatcaaggaaacgacctgtagtcctggtttggtaaaattgtaaagtagatgaagaaaactgatgtcgtattcctaccgttctaaccctgcccccaacctgtagaagatgggaagggagccctccaaaggcatattcacaaccatatcatcagatcaatacaacatagcggatatactttcggtagtttacattctctgagtataggttctactttatatctatgttgttataattgtgggttagcttaccagagaggtgcagtggtgtgggtttaaggtctgaatattcgattactctatgtcatccatggggatatagagtagtatttaataatgtaggcatggtgcttagattattagatatcattatttgggtatatatgctacgggacagtagaggtgggccgctgatggtgacagctcagtacgggtattcctccacgttagcatgtattccaaatacaatttccttgggagtgtactcctccgcatttagtcccggttggacggccatgacaggttgtcgtaaaaaactcggcaacccagggtggtctgtcgaaacaccaagaaagcactattaggaggtattggccgcacagttgtactccctctgtttcaaattttagggcgccgcctttttaatgaaaatcaaactcggtagctcttgactaataatcatactaactatatcaatactaagtattatgcatgttatctcactagatttatatttcgaagtactttcatgtgatgctaatttcatatttgttgcaatcatagaatgaaataaaatactagttaaagtatgttattgaagaatgtgtaaaaaatataggtcttataatttgggacagagggagtatactagtagatgtaaactgcttcctccgtttcgaaatgtcagactttctagcattgcccacattcatatagatgttgatgaacctaaacatatatatgtgtctagattcattaacatctatatgaatattggttatgctagaaagtcttacaatatgaaacggagggagtagaattgagtgtatattggaggtatcggaattgtttgcttttctatttcttcttccacatagcttaggattaattattgtgagaatcagagttcttctgctgtgtcactctacccatatatttgaattaacccctacctagactttgattatacacgtgatgtatataaattgttcacatagttcttttataaatcttctcttgcgattaaataaatatgataccttgaaatacttccaggtgaaatgcaacaatggtatatccatgcgcttgcggattacttctgtaaccataaatataccaggattatttctttgccattacttggaatttatatttttagtaaagtcgttaagaaataccaacacctagacttttgcggcccgataagagctatttccgctgcattatataatacagcttaatttgggggggcatgtgttaacaacggaattttgcatcagactcaaagaggaagaatcaagatcgaagtggatttgatgtggaatcgagttggaacagaaatcggattgcgcatcggctagcgtcgtatcggcgggaaacatggcaggaagttcacctagccgataaggcgagcagccgatacaatatgacttgggctcggtattggcctagattagaataacttttattgccaaatagagatagagctcatttaaggcaattgtatctgttaattaagttagttatgtcgggttttgttagatttagcaagagaccactgtatatggtcttgtttgtatcttatctttaggaaggtttgagtcgtggctataatagactaactttgtactcggggtataaatatgaaccccatagctctgtaatacgggagacaatccaatataacttcggcgcatcgccacccttttcgttcttcttttcggctagttctctcgacaagaggtaacctgtctcgatggcttatcctatcggagcaattatgttgttttggatgttttagaccttttaccatgaccatatgctatcatatgtcttagttaatctagtattagtatctcgatttagccctatcggctggttccggctttagggttctcgctggtatcggctaaatcgccttactatattagattgattaaggaattcaccatcttgaaaagtgattaattgcttgattgtttagactttagacttctttacctactttgtgatgcatcatcccaagtcttgtttagaaccctaaaaactaacctggaattaatcataattagggatagtatcggagtttcagccgatcttaccagatatgcatatttctttatttgtttcatgtatattcgccatctatatagacagatcgcttcataggaatatatcaagtctaggtcatatcggctgaattggtctctacttgatcatatattgctatagattgatttggctatataggtttgtactagagtattagctggtacgctatctttatttatctttcttctactctaaatactgttccatcagctattttcataataatgtcttaaatttcattatcaaacttaataagcagtattatagccgatgaggcatgtttagggtcttttattctttgatctatccaatctatagctgatttggtctaactccatcggctgagaccaccgacgatacgctgtcggcctatcggccgattagctatcggctaactctgcttctgtaagcatttttagtattcttcacattcatatagatattatgaatctagacatatatatgtatagattcattaacatcgatatgaatgtgagcaatgctagaaagtcatataacacgaaacgcatggagtattaagtaacattaggtgctagtagcattttcactgccgattatgcacccggagattctaaagcgggcagcaaatagagtgttgtaacctgctctgcctattgtgtagtagcccattacgtggtagcagagtaattgaattattttttctgctaaatttttaacaaacatctatctaactatagcgggcaagtaatacatgctggtaaggcagaagatatggctttaatataccagtacgttcacctcatgggcagctcaaatatttcagaaatcggaacttgcagtctacagaagacagtgcacactcgatccacatgggcagctagtacgtaccacagctaatgcaaacaaagaatatatatggagcacaataaatatagttattaatgatccaattagttaaataatcactgaatcatgcagtgtagcttgctcgtgagatgcttggctgcgcctataaataggcgcctcactcccaacatctgcataaaagagagcaacaaattagcagtagcctttgaacccattttgatttagcttgttgatcctcgagtaaatctcaatgaaaaccagataggaaacatggaaggtgtgaagagtttgatcatgtgtgctctggtgctaggcttagtcctgcagcaggagaagatccatgtggaagctaagagctgctgcccatccacctcggtaagaaacgtctataactcatgccgtttcgcgggtggctcaagggaagcctgtgctaaactctctacctgcaaacactttgatgggagctgccagccaccttacgatcacctcacccttcactctgatacgggtaaaacggacttaactattaactccatttttctattcttctgtactgttaattaatgtcacaatatttctggctcaatcattcttgcctgcaagaagctagttttactataatataaatagaaatgcatggttttgcagagaaataagatgtacttgacttctgcaagctgggatgtacttcttcagtgtgcagcaagataaacacttgtaagctggaaaaacatgaaactgaatcaccattagttttcaacgaaaaaggccaatgcgtacgatcattttccttttcatttcagttgctgccaatgaaggagtgaatgctgccgtggagcgttgcgaggatgcatgcgatcgcttctgcacaaatgaagctcagactgtcaccgttgtgtcctaatcaagcgcaacatgcaaccagaaagggtttcacacacatcgaagcccatacgaggctatgaacctggagtagtcataaataagttggatatcctgatatccaagccagtgtgctatcaacttctgttgttttgtctctttgtatttccaataagccatgataattgcaatatgctgtcttgacctgaggacgtgagcatcgatgagcgatgatatcattggctaataaataaactttctcatttattttacgccaatgcctcatgagttactataattaatgttcacaatttagtttacaaactctaccaatttatctattatataaagcagggaaattattagacaatgcttaagacgtccacctacgaatacatattattatcgcaggttgccaccttaaggagtttgcataggaagttatgtgcgcctgcgataatttgaatgatattattatattggtaaaaactctaattaagatatgtatgtacatactgcatgatttaaaattaataaaaattgtaatcatcatatatacttagcgtaggaattatattaaatttaatactaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtaaattataattagcatatgaatgctagtaaattaaatgttaaaaactctaattaacatacatatgaaattgccacctgtgtgatttaaaacttttaaaaattgtaagtatcacatataactagcatatagatgatttaaacttgttgaaacctctaataatcgtgcgtaattaacatatgccatacatcaattgatttatatggataatcaatacatccaaaatagtttacatcgtgtacacaataattacggcattacatcgacggtgacggttgaccgcacgtactttctcctcactattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctacccttctttcctttactagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtatacccattgatctcatatccctggaatgtcgcgatcgacccagacagtcccctcgccaggaaggcaagttgttggttgattgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatattgatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatatttgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaagatttacgcaaaggttcttagtgaggtgcatcgcgtcgattgcgtggcgtacgtccaagaattcccaatatggtaactcccaaaatatagagttctttttccacatcgccgcgtgaccatcttcgctctctatatgctggcttccaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaattgttgatggttacgaacagcagcgctcgtaggttaaactcctcctgtttgtcctcgtcccacacggggacaccttccttcttccacaactgtttaagatcttcgactagtggtcttaggtacacgtcgatgtcgttaccaggttgcttggggccttgaataataatcggcttcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctattgacgctctttagcgtgccatcgcaacattctagcattccccttgttcctgaacaaacgccttagccgtggtattatagggaaataccacatcaccttagcatgaattctcttctttgttagctgcccgtcaacttctcctggatcgtcccgtctaatcttgtatcgtagtgctttgcaaacagggcatgcttctagggtctcatactcctcaccgtggtataggatacaatcggtcggacatgcgtgaatcttatgaactttcagtcctaacgggcagactatcttcttagcctcgtacgttgtctcgggcaatttgtttccccccggaagaatgttcttgacgagtttcaataaatcgccaaatgccttgtcactaaccccagtggtatccaactttttgtgcccctgctcgcaacctgggtacaacgaagttctgtggtcctccaacatcttgtccaatttatgggcctccttttcactttcgcaatcatccctggcatcctgcaacatctgactaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtagaaatgaatagtcctggatgcagaatactccttctgattcttacacttattgcatggacaacaaataaaacccctttgcctgttagcttcggccactctcaaaaaatactgcacgccgtcgataaactctttggaccgccggtcagcgtacatccattgccgatccatctacatgagtcaaaaaaaaccgtacacaaataattattcttacaataatgacagtcatacaataattataagatatctttattcatacaaaaatcataaaatattacaccaaataattattaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaaaacattggaggatgaagttgcaaaccttttaggcacctccgatttctctgtaatcaccaaaataaatttaatagaaattttggcatgacctcccctcttttttgaagaaattttaaagcttgctcgggcagctggaggaggaagaagacatatatataggggtgggactttagtcccggttattagcaccaaccggggctaaagatcaccgggatctttagtcccggttggtataaagttacgactttagtcccggttggtaatgattccgggggggcctgacatgacctgacagcattcgaaccgggactaaagatcatctttagtcccggttggtaacacaaaccgggactaaagatcaaatatgcccgttacccttttgaaccgggactaaaaatcatctttagccccggtttttattgcatccgggactattgtggaaatcggccgaccgacgaaagatggtttctccaccagtgaggcttcatgcccttgcacggagcctatcattgcttttggacatcctcgacatggattaacgattgactctgtacttaaaatcagcaattcaatgtctctgaatccatgacacattgcggaggagcgcagactggaactaatcaagcaaaaaagatgtacttgaaaaatacacatatgatctagtctaatgaagcaacataccttctagtttccagttctcctccaacccctctcctttaaagtgattccaattttcactgtaaacaggttaatatggatttgcaatctctaatttaccccctatggaaaatatgaagagaaagattttgaagaagagaatcaccttgggttaatgcacatgttgagttcaaccagcccacgtgtggtgatacgttgtggtcaacagagattgcaggcgacatcaacaaccggattattaacatgactaaaaagctaagggtgtgtttgaggagaaggggattgaggagattgggaagattgggaagatacgcaaaacgaggtgagccattagcatatgattagttgagtattaattattttaaattttaaaaatggattaatatgattttttaaagcaactttcctatagaatttttttgcaaaaaacgcaccgtttagtagtttgggaagcgtgcgcgtggaaaacgaggtgttttctctcttaatctcccagatcaaccaggaacgaacgaagcctaagtagcctcctcgtgattgagagaacattgcagattttgcagctgatttgaaatcaaattcggcactgtaaattccacaagttagcagggctcctagatgatctaccactaatggtgtaaagagttatccatatgtgagaattgttcataatgcagtataatcattaaactgaaattgattcacaataaatctgaaagcaagttcttctccataatacttgtcatgattaccttgaccaacggttgaaattgattcataattaccttgacctctcatgagataacttccatcgccatcactgtatattatagccgcttgtcacattagcacattattacgggcctgcagcgacggccccggggcggtcttgtcaacggcgtccggcacgttcgacgtctagcagcgccggtttcctcaccgctcactgtgtccccagactggccggtcggcttgcgcggttgcaccgtgcccgccacctgtcgccgccgtgccagtttcgccatcgccccgccgccccagtcagttcctccacgcagtcacacgcgcgccgcccgcccggctcggcagccgccagcggcacgcgccttgcgcggccagccgaccacgccgcggcaccagcgatccctccaaaagcaggcaggctgccaggctccagtccaccggccggccacacgccagcgatgccgcccagtcgtcggagtccgacgaaagtaactcttccctagttcccttcatcccctgtcctgcgcccttgctgcccgtagatgtcatgtctgatgttgctcctgctaggtatgaggccatatgctctggttcttttttaccgtgctctcagtaagcgccgccgcctcttcttctccccccgttagatgaccacgctattagaggattgatgaagtattgggtttagcagtgaatttaggtttctttgaagtttcgtacatactgcaagatgggcagatttgggtgttttgatatccagatcttgctttacacatgtgtttgcagttaaattgtttcttttcttgatttcttgaaggggcagctttggatgttttgatgttcaaagatgtactcgcctttgtgtttgcttttctttgttcggtttagcagcgaagccagaagaagctgaagtgagggagcaaagagggccttaggggataaatcaagagacagtagaatgtatataatttagtaactgcaaatctttgtccagagtaaaaatattgatacacttgacatatagataaaatcagattttagatttagccatggacttggaaattattatctgaaccctagcacagatttaatttatcatgaagcataagaagtataacaactctgtcaattaggctagttcaattatagatcaattatagttcatataggagtccatgagtagcatatttttaataaagagatcaatttgaataattaaggagtctatgaacagaaacatagacctttataataaaccatctggagcaaatggttagggcatgacatgggggaccatgtagcagtatgggtaatagttaagataaggggcaactgtgttcttacccctactttcatatgcaattgtgattttacccctcttttctaaggtttgtgattttaccctcactttttcaaaacgaaactttgatttgcccctactctgttaaaaccacctaacggtgtcaatgaaactaaaaaagacaagtataaccctgtacacttgcccctacttttctaataggatttgtgtattttctaaaaaaatatgatcgcacttggacaaattttgaaagaacttcgatatcattgataggatttcacagaactttcaccaggtgcgaaaatttaccaaaaagatccatcgcattcaccagtaaaaaatcaccaaacaaacaagctcctcataaagtagcacaagatcggaaaaagaaaaagaaaaataagaggcggctgcagcacgaccggagtcgccgccttctcgtgcgatgccgctgctgcgggctcgcacgtgccgccgaagctgcctcctgcttgcggctgccgtcggagccgccgcctattcactcgctccgccgaagccgcggcttgctcactccgccaacaccccctactcgctttgctgatgtgggcatctgctgctgctcgctgggcatcacagccttgcccagccgccggcctatctcgcctgtgcacagccgccgacggtgccactagggttaggctaatcaagtaatcagaatggggatcgggtggtgggatgaaaaaggcaatgcagggtgttgttctttgcactggggtataatggtccattgtttttctcttagtaatttcatctatattttttacactcttattttgggtccaccaaacggtcatccaatataggggcaaacggcagcttcgttcgaaaaaaatgagggcaaaattacaaacaacagaaaagaggggtaaaattacaattagatatgaaagtaggggtaagaacacaattgccccttaagaggaatgaataggacgcatagaccttgttaccgattatttagaaatcagtttcatctttttatatttaaggtcaggcttcataggtgataattaaattagttatagtacagatcttctcatgatattcaaagtgtaggatcatgtaattttcagcatcattcaataaaacttatcctaggttctaattatgttactgtgccagaaatttttcagaatttatcctaggatctaattagcagttattcccagaacttttacattttagaatataatgaactgatttcagtatctgattcataaagttagtgtggtctgagttggccctcccaagtttcttttaagctgtttgtctcacaggtgtgcctttgtatttgtctagtgtgtactagaataatataagttggaccgggagcaacaaaatctctgcttttgacagtgtagcaatacttatgcctctaatagtatttctcaaaaacattgcaatcaaaagctggcattgtcttgtttcacaaaaaaatgttcatcttttggaagtgttataatttttcaattcaaatatgtttgttaagttgagacaactgagctggtatcattgagtagactggtagattatgcaaccatgccaaacttggcatatcttcttttttttatcatggtacagtcggcatatcatttaacattttctcttgtggtgatctagcagaacatagggttttatcttgagaaattctagatttctatctataagttcaataatctttaccacaagtatggattgaactagatgcaaattaattaagctgtggttgcaaattgaattatgtgagtgcatactatcatttagcaatgtcaacagattaaattttgagatatttggatgtagtattgaagtatcaattagtaatatagacaggttggattttcagatgattatgtggcatatcatgcattaacgaaaaaactattactcagcagtcgtattatgcttaaaattttcactattcaagattatcagtttacactcattactgctttcagcatgtttgcagagctgatacttcgaggctatctatcttctgttgtacagtgaagtttagtagtaattaagaaagtgtaagtcataattttttgaagttctctatttccattagctaaagctagcttcctctgtcgaagtatattgtagctgcacatatatgttaaactgattcatactagtcagctaaggatgcatatcttcctgccatgcatgtctgtttcatggcaaaagatatgcaagaagtaaatgagaagaagcagggcacgaccttgtcctcccactagtagacgaatttggctggatttggaatgtggttggatttggctgttaactgggttgtaagttttgtgttgtattggatgtttgtcgggttgtgttggatgctaattgtgctttgacctttgtgctatatgggttgttattgtgtttcattgttggccctctatgggcttagccgatactaatgtaaatgaatacaacatgacgggcagaaaatggtgtggtataatatttgggcctatatgggcttttgcaatggacatggcccatttattatttgatattaaagcaaatggatataatagaattgtgttgacaatatgctacaacatggatggactaggctaaaatctagtcgggtttgccattgggctaaacccataaacaaggtgctaaatacatgaattttaatgggtcatcagctattttatgacgttttttaggctagataatgaaaaatatgagcgtcacaaagctatgacgacggaaggattgtcactagattaatagaaaaaaatctttcgtcatagaacgctattagagatgcatgatatgtcatagcctgaattttcgtttcaggatttataaattatttaataaattattaatagaatttatattaaatgttcattaatttacaagtgaagttaaatgtgggaaataaaatttcctaaatataaagcatggttggatttaatttttgttaaattctccatgattaattatactctctggaattttctcggatttttcagagctcaattcctaattttaataatataaagaatatttcagtaattattcatattaaattaatcatttaatgagctggtttcaattttgttaaatacttagagtgtccaagtatgttcaagatttttcttggaattatttgagtattgaaagtatttttaacaattgaaagatcatctcattggttaatttatttggaaaagcaataaaatcttccttcctagtcttgggccgaattcagcccattctctcccttcctctcagcccggccgaaagtctgtttgtggtccctgccgctacagtactccatcttcaagctccagccgtctcctgcctgtgcacgctgtagcagagcccgatgccgccgatccccttccaaaattcggcctactcgttgctcctttttccaaattagtttcgggaatggaatcctctcaatctcctcttccttttccccaggaaatcccaaaagtttctatggaaatcctttccaatttcgcggttcaatttttcctttttccggcgagaaccctagactttcccgagtttttcccgtcgatgtgggcttgatcccgagctcccgtgcctcgtcgtcctcaagtcccgtcctccgccgtcgccggaaacgctctccccgcgctcgccttctctctccacctccggccgccgctccagccgcagtgcgccgtcgcctcggccgtcgccagtcagcgccgccacctccctcggctccgcaaagtcgagctctatcccggccgctggttgtttttcgccgaatcccaccggagattggccgtcatcatgaaccggagcgccgccgtcgccgccgtgcctccagccgagccgttcgtcgacgtccgtcgtcgccttcggtcgccgtcgtctccattggattcgcagctgcgaggagaagcccgtccgccatctgtcatccgccgaagatcgccggaaagccatcgccgccgtggacccgaacctcgccgccgtcccaatctcgtcgccggccatctccttcgccgttcatcgctgtttaagtgttggtaagcatcgccattgcctcctctttctcccggtgccctccatttgcattattgtgccgtggttcgccggcaaccgccgctcctatgccgttcccagtgtagtttatccctagggtcttaatcccatctaatctaatcttgtatggccctagcgtcgtcatcgtctccgtgtgttgccgccggttcaccgccgtcatctatctctctccgatcgctttggttcggtgggacgtctatccgtgtctccttggtttagatttcaacccatcgccgcgcttgccaagccgctttgtcgcagccgtagccgtgcccgttgcgttgttgttcgccgcactgctgccctagcctgtgcaccgtcgctactggttgtgccgctgttgcttgccgtcaccgctgcgctagtcgcctagctgccattgtgccgctccctgccacagtcgtgttgctgctgctgtgcgttaccgcttgccgctagctgctgtttggccgctgctcgtgtgtgccaagttgttgccgttctgctactgcaaccaccgagccactggccgctgtgctatgccgtgccgttgctgctgtaccgtgtcgcagccgtgcgtcgcttaaacctagccgccgctatcccgtgttgtcgttgttgtggtttgttcgctgtcgttgcccggtagccgagttgcaaagcctaaggtgcatcccttaattcctaccggcctatcgtttgtcgtaccgggactttatcgtgaaccgtgtctagctcaccggtttagtcgcagccgttattgagtcgttcgctcgttcgttcaaacgaggtgttccccttgcttcgttcgttcgtccgtgttgagtcgtcctttagtttagagccgttcagagctgccggttccgttcgccggtttcggttgatcatttgggtgatcccgtgtcacgtagaattgactcgttaagtcggtatctcgtgaggctcgcttgccagatcaatctaatccgttgaatcttggtcaactctatgtcaagattaatcttagccatccaaaatcaatataaatccgttctctcttttcaatggcatattagttcttttttatcatatggcatctaccaaatataatctaatctttttccggaggttgttttaatcttttatctcagttataaattatttgtaaattgtttaattaatttggaatagtcttttctttaataggtttaattggaattaatcttgtaaaattcataactaattcatatgaagtcggaatgaggccgttcaagtctcataattcatctaaaatcatgatctacatgtttgtttactttatgtgtactatttatttggtttttattagtctttttcctcgttttgcgtgttagcttgtcgtttccgtcgtttcgaaggatcgcgtgtgcgtcggaagtgttcaagaagattaattgaagacccactattgcaaggcaagtcacacagatcccaaacacaattcttttgagcatgttgatcctttatttaaattctctatttttttcaactgtgcatttattttcgaatgtcatcgggtggtgtgaaactgtttctttgttatggccaatttgcattgattatcctatttcttgattacctcggattataatttgactagttggatttatatcttggttcaactagatatattagatataattgcttagtcatgcttagaaatattagcacactattgggataactaatgtttcactattacttaatgatgtacatggtaaaggtagctcacgatggtcaatcgtgattggttaattaattaatgtaccaactaaaacttgataatggtgggttgtgagcatatggttttgatggtcgtgctcatgacaattaaggaccggttcacgagtttcgattgtgaaacattaaccgtgccaaccacaagctagcgtgggtaacagctttatcttttgtatagcatggttcattgcggggcaccagactgagaagtggcggagataagcccacggggtcgctgggaagtccatgccttgtttataagggggtgattatgatccaggaatggtgcgctgtggtggattgtattgtgcgaggggtactgtcacagctcctttccaaggaaccgtggtggtattgaggcgcatggtgacatgttgtggggctgtgtcttgtgggtacagtggtacacctctggccagagtaaaactattcgaatagccgtgtccgcggttatgggcgggtctaacaatgcctttcgtgattagtctcacacttctcaccataataaaagatgctataactggtaataatttgattagctcctggtttggaatggtatattcctggtttggagatagatctgtacagccaggtatggttgttcaggatggttgggcctgtgcagcagggtatgctgttcagtgttgattaatattgatgattaattactctactattttacaattctcaaatgtttgctaaatgctgcttttgcaaatgagccctatattatgccatcctttggtatccttgtgcacttgcatatttgctgtgtggcttgcggattattccatgtactcaccttgcaataatcaatcaaacctcagttgaagagaagtcgcaaaggagaagacgtttggcttctaccccagttgagctgcctgtgggagtggaaccggagcttcgctagaccgtaactccgctgttgttttctcttttcttttgtaagtatgtaacgttattattatgatgaatctgtaaattaaattgtcagtttgtgtacctcggctgattcctggatgaggattttgcacaaattagttcggaaattactagtgaatttctgggcgtgacatgataggtgacgaatgaatttttgtcacgcaagcgtcacatattatgaaacgtgacgaaattttatgtgtttgtgacgtaaatgaagcgtcatctatcataagatttcctgtagtgatcgccgctgctgcctggctggccggcctcccatcccgctgcctcccctccggccggatctggcggagggttcggcgaggccgccgccccacgcccggccgcgccggccggcttcccatcctgctggatctggcggaggggaggccgaggccaccgctgcggccaccgagacaagagagaacgagagagagatacagagagcagaggacagggagatcgacagagatcgggagagatagagagagcgcgagacagaggatcgaggagatcgagagaaaggcatgggacattataaataggtgggagagatttcttgtcacgcccagaaattcgctaacccaattttcaagcagaatgtgtattaaatctctgtccaggaccagtcagagtaaacaaacgacaatttgataggcagatccacgtcttacaaaataacaaaataaaactcacatacgcagcggaaaaacaaaataaactagacttaatcttcactaccaaagtgaagcttcctccgtaaaccacaggcaatcctcgacgtccgaaacaagctcaatcctcgaaaaactcaccatctgaaccaacctttacttctggggggcggggataaagcaagactgagtaccaatcaccgtattcaacaagtcataccaacgggaaggtacgatgcaaggatattcacaaagaaatggctcataggataatttgcagtaaagcaacatttataaatcatattttgaaatagtaaaaacaatatatatggttaaacagtattaaatcatcactgtccaacgctaaatccacgttgcaacaggcccaaccaaaaccacctgaactacaccaattctataagtcaaattattatagtgggactaatcacgttgagctggttcaccacccaataaccgcgggcacaactatttgaatagttttaactctgattagaggtgtacaactttacccacaagacacgattctacacatgttaccatgcctcgaagtatcgccacgataccgcaaagggggaaatcgtgacaaaacccgtcatataactctccctaaccaaacatacccacctcagatttcaccccctccttctcccaagttgggaagtcccctctcgtgcctaggtaaatccagctacagcagagaccaatgtccacgtccgaactgcaccattgcctctacccttgccatggtatgtcagctaggttaagttatactctagattcagcctagagcccacgctggtatgtggtaagtaggagtatatcttccaaggattcccgagaactggtacttaattgtcatgggcacgactttcaaaatcatgcatgtacccacgacccactattaaagtatattttagtttaattaaaccataaccatggtggtacaccaataataaaattcaggattaaattatgatgaatcccattgtaagctaattgatctaagcatggctaagcattcctaaaccaatcatctagtcaattataacccaagttatgatcaatgattttatgaaataggctcaatatgatcaatgatgtacgtatgacttgccttgctcttgagctgactgaaccttggcgaccacttcgaaataaactggatcaccagaactaacagaatctaaatgacaaacaaagcaaacaagaaatacaagcaataaggctactgaaacagcaaaggaaactaattttaatggattctaaacatttcaacaagttcactgcaatttgaatgggctaaaacggagcttggattttttagttatgaattttacaatatgagctacgttattactaataaccaaaaaaacttaatcaattattacatattaatgcccatagataaatagatcaatgtaaataaatctccggtaagcaagcctcacaaattaaccactcaacgagccaatcctttgtgtcacgggaccatccaaacagtcaacggaaccagcggcttagaacgactacggaaaactagacatggtttacggcagaggctcggtacggcaaacaataggccggaagggggttagggatgcacctacaggtttgcgactcggctaccgagctacagcacagtggcaaaccacgatgacgacgcggtagaatggcggcgatggcatctaaagcagcggctagggcacgtctcggctagggtggcaacagggcggcggaggcgcggcacagggcacggcggcggcggctagggcacggccggctagggcagctagggttttaccggggctaaacaactagggtttcaatgatgacactaaaaagaattaacaccctaatcaggagattatggataggttcctcaccaaaccgagacgatcggcaaggaggtgacggtgacgacggtccgatggcaacacgcggagacaacggtgatgttagatcgaaacctaggacggaaaaaaattagatccggatagataatggcgatagccatgacacagagagggaaaacggattaccggcgacgctagggtgatggcggcgacggcgggaggtggtggcactgaccggcggcggcggaacagcagcgggcagcagcgcggcacttgggctaggcggcggcagcggctagctaggactagggacaaaacaaaaacaaaaacgaaaatagggaggggctctaacttatatatgagaggggaaaaactaaaggagatggggccggaggggaggaggccgactcggactcgaacagggggagggcggcgcgcgcgcggggagaggaggaggtggcggccgagtgggaggaggagagggggaggaaaaataggaattgggaaaataggataaggactttcccaatggaaatgacgtgcggtaccgttttaggaaaagaatggaaatggatcccgcgaacgaaaacggacacggctcgtcatgcaaaacgaaaccgcgaacaaagggggcagtgaatagtgaatcgggcacgattcacgaccataggtgagagagaaaaaatattattactttaaaacttgataatttagattaacatcattaactccgatgctctgaatattctgctttaagtcctgttaatgattttagagcaaagagaattaaaaaaaaattctccttgacaattccgattattaaacatatcgttaatttatgttttctcttggttaaccaaagtaatttctataggcaattcattagtgaattagaaattaatgaaaaggggaaactccgggtgtgacatttctaagaaaatttggttgggctttttaatcgggacaaaaaaagatgttcagtcccggttcctattcaaaccgagactaatgtggtttttggccaacccagcaaagatggtttgttccagtagtgtctacctattgtgcaatagtgattagtaaggcataagatgccacgtggttaagctttaatgtctcatcacgttcaccacatgggcagccaaagttttccatgaaatgggagttacagtctacagaaggcagttctcactctgctggaatataattaagttagctagctaaatttgtattatctatgggtacaaccatctctaacttttgcgctgctaattttgtaatttctatgggtacaaccattcatggatgcactaaattagttttacatgaatctaacacacgtatgcttggttttgtagaggaatcggatgtacttgatttctgcaagctgggatgtacttcctccgtgtgcagcaccattaacatttgtaaggctagagaaaacatcaaacaaaattactcctgattttcaaagaaaatgtaaaatgtatttgttttatatacctagctaatgtatagaatcattttttttcagttgctgtcaatgaagaagggaatggtgccgtggatagttgcaacaatgcacgctaccgcttctgctccaaggaagctgaggtcgtcactgttgcttcctaagcaagtgcaagatgcaagcataaggtgcttcacacatcgaagcctatatatgcaaggctatgctatcctcgagagtagccataaataagttggatattatgatgcccaagccagtgtgccgtcaacctcttttgtcttgtgctcttttgtattccaataagccataataatcgcaatctgccatcttgtcttgaggatgtgaccatatcaagagtgacgatatcattggctaataaatatagcatctttgaaattggcccatcaaaaaaccagaaacatacattatttttaacgagccttttatgtatgggactgtttatatatctgttgactgaaaatctcacctccaatctttaaaaattttgactgttggatatgctttgagattcgtgcacagccttaaccctaactttttcctcccgttcctctccttcacgcgcattccggcggcgtcggcgacaccgccactggcccaacgcgccgctacctgccttgccggcgggccgaagggagtcaacggtgccggcgaggtccccccggctgggcccctccccttcccttcccttttccctccctgtgctcttcttccctcaagccgatggaggccatctttcccgtcttcgacggtgcggggccaccattgggcgacttcttctaacacatgttatgctttgtccccggcttctacacacagcccaccacca

SEQ ID NO: 59608 - DNA, 678 bp, Oryza sativa
gacccgatcttttccgccgcttcctcctcgtcgccgtcgccgtccgttggtcttccgccgctcctttggtcaccggtgagttcgccgcgtcgcgctctacccgttggtgccctccgttcgtgccgaagcgccgccgttcgccggcgagtgtgcgccgtccgagccgccgagccgctgccgccggtggtgacgtcatcgccgacgtcatcgtggccgtctgccgtgagccgccgtggaccggatcgatctcggccgtccgttttggatcaagtcgatctcggccgtccgttcgcgtgaaccgccgccgtgcgcccggtccaccgcaaaccctagcccgctaacgcaataatccaccttttccttttcaaaaataattcattattgcgtcataattcaattaaaatcaatttaagtgttttaatccgatttaatcttaaaaaatttataactaattcatcttagctccgatttagttggttcaagtctctaaatttttctaaaattgagatctacatgttaaaaatatccacatgtactgttcattcttgtttatgtgctgttttggtgtttttgctcttttctgtttagattccgtcgtttccggagagtccgttttcgccggagaagaatttgaagagttcccaggccagcaaggcaagtcacacagatcccaaacaa

SEQ ID NO: 59609 - DNA, 5080 bp, Oryza sativa
cttgagaattacagtatctaatttcttggaacaaatttctctaaaaagctacatagctcaattatagcctcacaaacattagcaggcagaactccacgaatagaaagtggaaggtatctgtgtaaaaatacatgacaatcatgacacttcatccctgatattttagcttttgttgcatccacatagtgtgaaatttttgaagagtatccatctggcacttttatttctctaaggaactcacaaaatgctttcttctcagctagtgtcattgtatagcatgcaggacgaaataagaacttcccatcaccagttggaggtgcatgaagttcatgtcgtattttcatgagttccaaatcaaaccgggatttaatattgtcctttgtcttcccatccagatttaacaaggtacccacaatactatcgcaaacattcttttcaatgtgcatgacatctagattatgtcttatcgataacgtactccaatatggcagctggaaaaatatactttttttttcttccaaactccatacaatgtgcttgagcgttttctcttattgttatgtttcccaaatttcacctgaatacataaagtgatgtcaataataatacactactcatattcttatactctataaagtaataacaaataaggcatagaatagcaaatagtataataatttactttcagattgaccagataggatctactatcattctgtacgcaaaattccccgagatctcaatggcagactatcagtgtgtaatgacacaagttgagcgacagtacaatgtaagacgccacaaactgtacaagacctattgcacaacaaaacagtgccctagtcatgttgcgccagaggactggcagtggttgattgataacttatggagtgatgagcagttccaggtacttgtttaattttctttgcaatacaatatgattcataattcattattcttatgagattattatgttttttagaaacggagcaaacaaaattccattaatagatcaaagcaagagatgaaatcacatgttggaacaaagtctatagtgcaaatagcacatgaactggtaagggatattgtcattcacttatatctttaaactatatgtttgacatgtatatatataaattataaggcttcttttgtatgtgatataattgcagagaaatccagtgacaggtgaatggactagtgctatagatgtttggaaggcaacatatttgaagaatggaacatggtctgtttctaatggcgaagaaattctggtaaacaaaaatgtctgttacctacattttactgcatgagtttttttaatatggacttacatattttcttttatttgtttagaacaatctgcagacaacagctgaaacaaactatgaaaggattgcagctgctaaaatcccaatggttgaactctttgcattagtccttggcagaaagccaaaccactcgcgtggagttggtattagtgcaatcaatgagggagctcaagagaggtacaaagttcatgcacaagcagaagctgcccaacagcaagccaatgatgcacatcaacaagctgctgttttgctcgaagaagttcaaaaattgacagtagaaaacttgcaattaaagggcgagttgcagtctcagcgtgaagagttgaattctcagaaaagaaccgtagaggaacaaagtggtcacatggagcgtttcttggaccaggaacttgaggaaagaatgaaagcaatgtgggcacgcatgggtggcactggtggtgcttcatcttcaagtgccccaaacaattaagtaagatttcttacgtcatacatgattactaattcaatctaatggtcattcgattaatgttatttttaaattatatgtaggaatttccaagttgacaaagactggcgtcgtggagttgctacaaagttttgtccatctaggcgagcatcctagagtccgtgtcccaagtttcatttgttgcttaggtgttcagttatcaatttagttatggtcttagttgaaatgctctttgtatgagcactttgttatcattcattaataaaggatagtttcctctagtgtgaggaaccctttttaatttaggtgatatttcaattgagttctgaagtgctctattccaagcatactgtaatcattcatgaataaagaggtgctctgttatgaatgtttaaacttgccattgctctatcgagatttcatcatcagattttgtcattgttcacatgctggatattgtcataaaagacgtgttgtttgtggcaagactttagtcacatatataaaacttgcatctggatatttaattttttagtgataaaagttttccttacagcaataccctttttttctccactgatgcattacttcatatgtgaaaaaggtattgtcacatatacatattagcttggtcactactacatttgtaaagaatgaccagttttcgcaacaaataacacgtcatttcaccacaatatatcttacttcttgtggtttttacttctcaatataaactaatatcttatcacaaaatcccctgtcatatgtgagaaaagttattagcaaaggtatatttgtgatggtgagttatcggtaattagtaatatgtagtgacgggcaaaccaacactaaccgtcgacaatattgtgagaaaaaaattccatcactacacgttcacatatgtgagggcactattgtcactagtatctcctgtaattgtgaccacgataccatctctaatgtactgcttattagttgcgacagtattatcacaaacagagccattatctgtgatgaaaaaaaaatcatcactatgctacttgtgatggcagtagtggtgacaacatagtgacgaccccaaaattcgtcacaagggggtaattgtgatgagaaacagccttttagtgatgaagtttttcatcacaaaagacttgatcccttgtggttgtcctaccaaagatatactccctccgtcccattataagtgtaatggtggttttcaatatccaacgtttgaccgtccatcttatttgaaaaatttataaaataattaaaaagataaagtcacacatcaagtattattttatcatctaataacaataaaaatatcaatcataaaaaaatttttaaataggacggacgatcaaatgttaaatatagaaaaccacaactgtacttataatgggacggagggagtaagtgtgtatttccatggacaacccatctcatacctgttttctttcctatcatacaattcctcactaatacattacctcagatctctaacaggtcatctatgatggcttgaggagactatctcggctctctagtctgatttttcgatgaaggatttgggtgctgctcatcattttttgggcatcactgtcactcgacaacactctgtactgttcctgtctcagcatcagtactgtcgcgtgaaacttgagcgtaccagcactagtacagatccttctatctgtgatggcctctaacatgcctggaaatagcgggccgtcacaaggaagtcatctcaatcgggccaaaaaagtgcccgattgagatatggtcgcatagacatattagatgggcataaaacttaagcccgtcacggatgacacctattaatgacgggctgtagtttaggcccgattaagataacattccatatctcaaacggggctgaagttggggcccatcacagattaccatcatccgtgacgggcacgtagtttaggcccgattgagataacattccatatctcaaacaggccttaagttgggccgtcacagatgaccatcatccgtgacgtgcaccaacttgaggcctgtcacagatgactcatcagtgacggactatatactaatccccggttgacatgacttaatctctatcgggcattaactaaagcccgtcatcgatgagtatttttccattttacatatgaaatgtttatatttgtaagttgaactatagaaaaacaattaacttgcagtataataattcaatttatgagtcaaaataattttacgcgtagtaaatgatatcaaatggaaaagtcatcaacaacaaagttttataactcatcaagatctataacttttattttggtcatttttatttataacattttttgaacagtttgaatttgaatttgaaaatatgacaacttcaaacaacattttcaaatactaaatgatttcaactaaaaaagtaatcaacaacaaagttgaataactcaacaagatctgtatcttttattttggtcatttttctatataacatgttatgaaccatttgaatttaaatttaaaaatatgacaacttcaaacaacattttcaaataataaatgatttcaactgaaaaagttatcaacaacaaagttgaataactcatcatgatctaaaacttttattttggtcatttcttcatctaataaaatgttagtaacattgttcataaattttacatatatatatgtgtcatttcttcatctgataaaatgcgaagaattttgttgttgataattttttcagttgaaatcatttagtatttgaaaatgttatttgaagttgtcatattttcaaattcaaattcaaacggttcaaaaaataatgttatgtagaaaatgatcaaaataaaagttatagatcttgatgagttatataactttattgtggatgactttttcagttgaagtcattcactaacaaaaaattgtattttattttctcaaactttgaatttcaaaattaaaattgtttatatagagtcagatggagaaatgaccaaaataaaaatttcgcacctcgatgagctctacaactttggttttggtgacttttccatttgaaatcatttattaatcctaatttttgtttgaagttgtcaaattttgaaaaaattaaaatttaaattattcaaatgaacttatttgtacaaaggaccgatacaatagttgtagatctcgataagttatacaattttgttgtttatgatttttgatggttgtgtatgtgaatgaatgtatatgaatgagggatggtgtggtgtgacatcctggc

SEQ ID NO: 59610 - DNA, 3076 bp, Oryza sativa
agcttagacatctaccaccgtaaaaactcaatcaacggcttgattgtctagatattatgtttcttttcatacttagtgttgcatcagttatgttttatctactaagtcgtgcttagaaccataatctctagcctgcttctagattgccaataagggtttcatcggggtttcatccggtcagttatttagacgttgcatcggctcataaggattgcatatacatagaagttggatttagccgataacaacaaaggtttcactgtttaatctaatcttgtggatttcatgacatcggacctctagccgatgtgtgctttaaccttcggatcgatgcttatttatcatatcactatttgccgattggtttctactggattatattgctatattatattatcatcagtcgattgcctttatatcattatctacattggacatatagccgattgcttaaccctatcgctattggctggtatcggcatcggctattatcggctatcggttggaactactccatcggcttgtcagccgatcggctgttttgatctactatttgcatatcttgtcagttgcaggatcaaactgactggcacgccctcatctcaacaacctttggacctgcactggagctaagcagatctcccaggccagtgtattcgattttttcgtcaacaaaactgtacggtggaaattgtttccgttctcccttcaagagagagcgaagcaatggtacacctctacagtcagatgtgtaaacgctagctgggaaaagttgcgagagagattctgtcttgcatttttcctagatactcgtattactacctttcgagtagaaatccttagtttccagcagatcaaaaacaaatcaatcggtgcggcttggtcaagattcgctaatttagtacagtccggacaaaccctgtttatgtgctattgcaacatttccatacgggcctggataaggagtctgcattctatctggattcattgatttcaaaatgttgctacctattgcaaaattagacatttcctatctatctagattcattgtactatgaagtacaacactccctccgtttcacaatgtaagtcattctagcatttctcacattcatattgatgctaatgacatatatatctgtctagattcattaacataagtatgaatgtgggaaatgttagaatgacttacattatgaacggaggatgtatctaattaatcatataccaggtagtaatattttttataagtaatatatgaaaatggcacttccccacaaagcctatatgtctttaatcgtaatctatatgattaagcgggattgggttaacaaaatggctctcgaacatatcctttagctccaggctattgctgaagccattcttcttgccatggtataggagggtggcggacatgcacaggttggcgatccgctgcacgaacgggaggaacgcgcggtgcttgaagcgtatctggttcatgcttttccacccgtcctcagccattccagcgatcttcgcctcggcgacctctctcgtcaccccgtgctcgttcatgtaacactccacagtgctcgccacatccatcttgtccctcccactctgcatgcatgccaattaatacatatatttatagttagtatttatacatatacatatacatatatatatatatatatatatatatatgccaattaattaatactccatccaaaagtatttaatatttatttatttttctgattcttttttttttgaagagggtcctatatgtcatcttcggatatccaaaacatatatgaataaataaattaaattattaatcagaatccaagtagccatctaaattttcattaattgcatgtagcatatacattttgtcctcattacacgcaggataaattaattactttttggtgataaaagtaatactgctacatctttcgagcactattagaaaaccgattttttatcattgtacccaaaacacaaatatgtcagttagatttagaatcggtactaaaaatattttgcagtacctgttctaaaagtcgaagtctcaaaaacgtttctactttcgattggtgttaccaatccaaccgaagttaaagatggagaaaccaaacccgtactaaagataccggatggtaacaccaacctagaatgtttttacggttttagtacatgttagttaaagaagaaagcatctatatcaaagttagttatgtatagtaggtgagatggtaacacaaatgaggactgaggtgagagaagtcttgagtttgaatcccacatccgacagattattttcatttagtatgcatcaaccagtactaaagatcgagaataaaaataaaggggattttaaaccggtaataaagtggggtgcacataactagaaataccaaaggttgtacagtggcccaccactttgctattgacctttgttattttaagcatgtgtttgtgtgcattcgtgtgttatgtgcatgtgtagtactatgccagtcgtttgcacctctagtgtaatcgcaaaaaataatgtatattaaggacatgagcacgtccagtgtacactaagttcttaataaacaacatgctcggaacattgttcgtaaaatattttcccttttattgaggtgtcggctagccatataatatattctcggtattcaaatatataatattattgactttatttggttcctatggtgcaatttttcaccactaattttctattagactataacgataattaaatgtctaactaaattataatatgggtcaagacactaaattataataatgtaaatgtgcttataaagaaaaagaattatctgcacgaattttatgtttgagactcgaagtttcaaaattttgatcgaataaatttaaaagtgacgcataattagatacggagggagtattatttgtttatgctcaggcacatgatcgatacaagcgaaatcaagatcgtgatattaattaaatgacctactttgtatagtttgtattttcaaaaagtagcgttaaatggcattactttctccgtctcaaaataacaacatttcggaat

SEQ ID NO: 59611 - DNA, 2900 bp, Oryza sativa
  unsure (1)..(2900): unsure at all n locations
ttgctcgatagtatttgaaactgcatgtagccaaaaaaaaaaaaaaggggataagcacaaactagtgatcgaagaagacaattagtgttttctaccttcaggtaggtaaaatgcatgattgtcatcncaggttttaacaagtttattggtccactaaattattaattagttaacatatatattattccactacttgttaagtagtggcaaatttattttatggtgttggattgtgagatatacactaaaattatattccaagaaaacagtacgtggccataagtactttgataaggagctagagactggcgttttaccgctttaatgttgtaagaattacgatatttctcatgtggttccaattcatcctcaaactccctaaagttacttattatgctcagaaaaaatctcttcaggtcctctggtagaagtgaaacgtcactcttgtcccatctgcatataattatatagcacacacaattaatatacgtgtctgcgtatgtgtgcgtgtgcgtgtgctgctttattaattattacttatcgaaacgaaaggcaagaaaagaattgaagtagaccaaacctttgcagagcatcgttaaacttgcgagcctcctctaaagttgcacgcacatcgtatgtatcatcgagcagtgaaaatagcatacacctcttggcgaatatcatacgggcccgtgcgtgctctttttcatagtaggcagcgtatgcacaaaaatagcactcaaccacacgttcacggacgtagtcgagtctaatgtcacttgaaagattctcccaccacctataatatatataatataatatattaattctattttctcgctacaatgattagtaataaaatcatgtggggagaacagcggcgcagactagaaaacttactgacaaatttccttgagttcattttggtgaactttttgtagaatattgaaatcaagcacggctagctccaaaatagagggattgaacattttctcttcagcgctatactcgaagatataatttagcacctctactctcttcatggtccttggtaacggtatctcaagggcacgtgttacttgttcatccaatgggtacgcgaggttgcctctcaataattgtaggtgatgccttgcaaacaatatagcttcttcaagtgctttctcgttgtgagttagaaggtgagctgcgttgtataaacttaacaagcccttcggatcattagttatgtcatcactactaaagctcccatcttcagctttgaatttgttgaattcatctgtgttcagtacagaccataaagatcaatcaaataatttagaataactaatgttgtacatattctgcttagtagacttctcagttctcacaagtcattgaaattatgatataacaaaaagaatggaaattcaagattcgtgtggaacagaataatttcactgaaattttccaatgaaggagtaaaaataatcccacactccaaatacatcatttagtctaagtgtgttattggtatttaattcactgttgcagtatatgtacctggcgagacccaatacccttgtttcctaagtaagcgaaaccgaagggcaacctcgtaaaggtcagagctattgaactcagctctatgaatattttttagaatggtgtcgatctgctcctcaaaatgatgatctattcccaaacgttggagcacatccaccaggttcatttgctttaccacatcatccttgcaaacctcaagcattctacctacctcctcaaccaactgatctactctctcttccatccattcatctgactcctgcaagatacatggaaggacatataggcaggtagttacttttataaacacataacaaattattttgtaaaaagtatcattttgaaacaatcttaaaacaatatttaattttacaacagttgtatgaagagtatttcccctaccattttggtgggggttactgctagccggcagtatcaagattactgcagcgaccatgtggttttaccggaaaaaccgtttggtaagagtgaaattcagtgaggttttaaatactgataagggcatgtggtaaccgcaacaatcttacggtaactgtgcgatgttaagaatccttcactttgtatacgcggcttaaaaaacaacttttcctgcttctagactttccattttcagaggtggctaaaatttgtaaccacctatgatgaagatgaccgatgcagtctccggtaattagaccgtctgtgaaatcatattttgacaagcagtgtcttaagaaaactgcatatgcaaataaaccaattttcatgggtgtttagcctatagtgaaccgtctatgaaaatgctgataaaagtggggtaatttttataggtggtactatctataaaaagctctataaaccaccctttaaaatgggaggaatagtatttaaagaaaaaaatcataagtctttcatacgaagttggataaaaacaaattttatatgaaaattgtagcactagatgagatataaattttgtagttgaaatttttttcatgtgagattgtttaggggtcgaaattttctttagaactcagatagatacctgttctatcaaaattagatcttgacaacacctgcatctttgtagttgcaagttttttccacttgagatcgtttagttggccaaatattcagtacagtctctcagatataattttttattggcgaatcatatggaagtcgaagctttcaaatttcatataaaatgcattttatgtccgattaagttgaaccaaagttatgcaagatcattgcaacatttcttttaatattgggtgatctatattttctgacaaaatttgctttactgtggtcaattacttatgttaacttgtatatagcatgcaaactct

SEQ ID NO: 59612 - DNA, 3000 bp, Oryza sativa
attcctgcagcccgatcatagataatagtttacctcaattaatcataaatgaattttcacatacggattgcttaagtaaccacataggtactaatgaattactgcagatggttctcttaatgaacctccttcaagaatttttttttaaaaaaaacataattcaagagaaaaaaacttttacacaaatgaagttagatgcacataaattttatacgaaatttattgctctcagtgagatctaaaatttttttagttgatagcgcttttttccatttgacattttcatattccctaatatttgttacaagctattagaacgaaataaattttagagttttttgaaaccacctcagatggagacgtgctctccatcaaaattgtagaggtcaacgggataagtttatgtcttttcattagatgccatctgtagtgccaaatatggagcataattttttgaaaggttaagtcaaaataatagcatacaatcacatcgtggttgtcggtagttatatccaactatatacggtaggacgtaacatactagtagtacgtgataaagagagcagattcccgatatggaatctgtgcctatatataaatcgcttatttttggctgtgtttagtttcacgctaaaattaaaagtttaaagaaattggagcgatatagtgaaaaaattgaaagtttgtgtatgtagaaatgttcgatgttatgaaaaagttgaaagtttgaagaaaaaacttttaaatcacgcgtgggtacggtgactgaatgcctgtacgttcgtagggtatggttataggttaccacccgtacgtggtaaaaatggtttacctagctagctaacagtacgaatgcatgcatgcacggacgtacatgaacatgtacatatattgcagtacatactttgggtgatggttggacgttgttgatgaagaagtcaccgaatatcgcagggtggaaagccggcgccatcttggcgtcgggagacggcgacgtcgcggtactactgcacatgcagcgcacggggcgcgcggcggcgtgggaggacgacggcggacgacgacgagcggcggcggctggcgccggagccgcagtagaaacgggcaccagcgagaggaaagccacgtggctcttcatcccgatcgatgataccattgtataccaattaagtgtagtcgttgagatatgtatctctattaataattgtaccaaggcaagtgctttaatacttccaaggcgcgcgcggcgccttttatatataggagctcaaaaccggccggttactaagtactccactactactaatcaagtgaaaggtaattcactaattaaactagttttagccaagtacgtggaattgaagacaagtttgttacagtaggagaattaagtacgtatctcctcagagaatatagttggttaagtcaagccagttagccagatcatatgctacccataattcccttagatcaatcgaccacgtggtaattaactgaatccacgagaggaatgaaattaatattcaaaacaaagacaagtccgggtgtaacggtacgcacgcttttcacggtttttaattatagacaccgttaatttttaaacatatatacgtttgatcattcgtacaaaaataattaattttaataaatttcattgtcatttgggtgctttaagcatgacttgaatttttatgtaattacacaattctttttagtaaaacaaataatcaagcgtatatccaaaatcccatgtgaaatcgtacattaaatatattgaaccagtcttaaaaaaaacaatatattgaacccggtgggagtagtatatacatattttctttgtacataaggaagaagaagtgcatgcactaggtatgcaaattctacaagctaatggtttacttaacttccaacgacttttcatagcaaaaaagcttctaccgtgcagtagcgcactatccatccatccagtcaaaaaaatttcaactttggctgttgacatttaccatggaatatacaggcagtcaaaaggcgtgacagacctccgattgtcgtaaaaacaaaggatggatgagtcctactcctatactcctacgagtctccgataacacacgacaatttttatactagcagatactcccacatgtgctgctagcaggccggcgcagctgcgccagctaattaactcgtgcatcctatcatcgtaaagatactaccattagtactgacgtgtagaataactcgtcggtaccatgcgttttgtcgtgggatatattgattaatgatgttatatattttagaaatgatatatatatatatatgcatgttcaaataatgtaaaaaatggtatatagataatgattcgacattgcttgtatattaaattctaaaaatacaacaaaattataaatggtacgtcatttttgcatgatatttaaaatactttagataataattgctagtgggtgatgatgtggcatacttacatgttaaacttaagtagttagcgtgcatcaactttatagtcttttaattcaaattttaaatcttttaactgcaaaattcgaaaatttcagctctaaatttaaaattttaattttaggtacaaatacagtaaaagaaaagtcatagttggtaccaattataacttgtatgtaacttccgtaattttgaatcgttagatttattacaagatttgtgcatgtgtgataggatttgttctcacgacctccattttacccaaataacatgttatggagatatttttgaaagttacatcaagttaaattatagttacagtgtaattacatgtaagttacattgtaattacactacgattttactttaattacatatgtcatttttttgggaaaacaattgtggacaaaaattattgtcgaaagataactgcgtcacgtcaaaacatgtggttcactcggtgagttgatggcatagtgaaagcaatatattaattgataataaatttttaggggctgcaggaat

SEQ ID NO: 59613 - DNA, 1950 bp, Oryza sativa
tcccccattacatggcaatatggggctatttatagtcttcgtacagactcataccctctagggtttagttagtacagggaaatttatacggatacccttatgatagaggcattagtgaggatacatgttgtcttttgtatttatgggcaatcaggcgatcttcttgggctggcccattaatggcgaaaggcatccatggcctgcagtgcctcccaagtcctcagtcgaagacacctcctacccgggtgaaggcctcctgcttcgctctatggtcttcacccatagtgatggcttggccagatggtgagcttggtggcgaaccattcagttttcatcgttcggcttcgcctaggcgcttcgccccaggcgcaccccttggacttagttaacgccttatggtttcggtggtttcggtaggtcaggtcgaaggtcctcgtggcatgcctccagcaagctcctcactggcaagggtgagtagggagcttcgtccgaccaacattttcgtcagctttgatgggtgatatcatcttcatgttggtcatttcatctccatgccgactgcgtcagctaccatcaatggacaattgtgactacaacagaaggataagctaaatgcttaggggctcatcaacacaagcgcgaggattatatcttcaatttggacttgttccggatacattcaacatgaattcatggtcacgagtcgatttcccgtgctcaacgactggaccactcattattccctatgagggctatctgccgagtatttgagccagtcaggattaaattatcacatcctctttagtacatatcatgagggatagctacttggatcaggagctattcagatgagatgcagttgatctatatcattcgggagatttgttacttgggaccatattaattggcatactctacacgtctaattttaagggtatcggtaggcatattttcgttctaggcctaatatgtctgcagcccatattttcaggtgtggcctatcacgcttttttagggactttggcatcatttttcttaggcaaaagtgcgcgtgatcaagtgcctaataccttaaaatccttttgtacctcagttactcaactttttaggagttggtacaatgcattttaaaatgtgccgaacaatgaagctttatatagttgccccactgaattattatatagtcaaggcattgtttggttttataaagcaattgattggatacaatgttgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaatgaagatctaagcagcggaaaataagataaacggcgcagacggctccactccacaggcagcttgaccaaggctacacctaatcctccacaccatcaacttcactgtagaactcttcctctgatgaatgattgcaaggtgagtatatgacatactcagcaagccacgcagcaaatatgcaagtgcacaggataacaaagaatggcatagtagggtttcatttgcaaaagcagcatttagcaaacatttgagaatttaataaaactgttaagtaattaaacaatattaatccaacgctatacaacataccctgttgcatagggcccaaccattgtgaacaaccattcccggctgcacagttctatctccaaaccaggaatataccattccaaaccagaagctaatcaaattattaccagttaaagcatcatttactatggtagaagggtgagcctattcacgaaagccattgttcgacccgcccataccggcgggcacggctattcgaataggcttactctgatcagaggtgtaccactgtacccacaaga

SEQ ID NO: 59614 - DNA, 715 bp, Oryza sativa
tttaattaccagctcctcctcttgacgacagcagcaaaggtgtggccgaggcggcgaggcacatagataggggcgggcaagcttggcttggatcgatcttgagtggatagatcaactggaagggcgtagcggcaacggcgttgggcgggacctaagatctgacatgtgtacgtggcgaagggcaaaagtacacggcattggaatggatgacatattatcaaatttctcgcaaatgatcgagcaacctaagagacaaagtcaatcgaattgaaatggtccgcgtatagtggaagtgggattgcactatactcgtattaggtagatgcacggacggacgtaatacaaacgctagttgacagttccaattaatcgttcatgcgacccaattgatttagttctaaactttcgctccatactacaaccttctcatttttctattatcacgttttcttaaccgctaaacggtggattttatataaaagaaaaagaaatactccatcattttacgttataagatatttttgactttggtcaaagtcaaattgtttcaattttaaccaagtttatagaaaaaaatagtaatattttcgacccaaaataaatttattataaaaatacatttaattattaatttaataaaattaatttggtaatataaatattattataattgtttataaacttagctaaatttaaaatagtttgactttgacca

SEQ ID NO: 59615 - DNA, 1175 bp, Oryza sativa
cactggtactaaaatttgatcagtctatagtaggttttaggcttgtgaaataattgtaaaattagctttatgcaaaagaacctgaagccattccttgaaataccctctatcatatgcattgttgttgtggtggcttcctgagtacggttggtactcacccttgctattcatatatcttttaggagagtgttgaagagaagcccttgtcggtacgcttgcgtatctaacaagatgatcggagtgcggtcttgttctaggtctcgttccccagtcgactgcctgtggcatgttaaccgggcccttatattattttgtcttccgctgttgttctctgatagttttggcctacctggccctaatgtaagtatttaactcttttagcctaaattcattcgtgatatgttgtgatccaactatgaatgtgtgtaccaactactgatccagggattgatacggataaacacagaaaatttccgattcccaaaattgggggtctacactacgttaacggcgcggttagtcaacgtgcttgacaccgacgtcgtctaagctatccaccctaacatcctatgtgccgttcctatcctaaccacctcgttaaaaaccagttgtggaccctcagatcttcgacatttcaccgaaacaaccgctgcttcgtggcctatggtaagtggtttctagaaaaatctttggggttccacctttcccaattcagtctctctagggtgaggcccgtgattctgcagccgtaaaaaaaaacctagctcgattccatgcccggaaggcaaagttatcaaggtcttaaattcgcccagaaatctccatcggcagtccacggtgtcgcgcccgccagcctaccttaacggcgcggttagtcgacgtgcttgacaccgacgttgtctaagctatccaccctaacatcctatgtgccgttcctatcctaaccacctcgttgaaaaccagttgtggaccctcagatcttcgacattccgccgaaacaaccgctgcttcgtggcatatggtaagtggtttttagaaaaatctctgggtccacctttcccaattcagtctctataaggtgaggccggtgattctgcagctgaaaaaaaactacctcgattccatgcccggaaggcaaaattatcatggtcttaaattcgccaaaaaatctctat

SEQ ID NO: 59616 - DNA, 716 bp, Oryza sativa
tgcaccccgatggggagtgggcgggtcttgaggaagccgagaggataggcgcggcggaccatggtggcgaggccggcgtcctgaacgagggtgaccggcgcgcggtcgcgacccacctccgctcgtggcattcggggtccgggctgctgagcagcgccaccgcacacacctcctcggcgccgcggttgtccaccagctcgatgcggtagtgccccgccgcgtccgtcgtcccctccgccgatctctccaccgccccgctcgcgctcatgaagtgccggcactccagccgcacccgcgcgccctggatcgccgtcgtcgcgttcgtctggaaccccgcgcggcacgtgtcgcagtacacgtcgccctccacgaagaaatccgggtcacggctcccctgcaccgccatcgccatcgccgtcgccaccaccatcaccatcaccacaccgccggccataaccatacatcaatcaatcaatctcgataaattaataaccgatcctgcttatatatatatagcagctatatatatatcgaatagttgaagcgatcgatcggctgggaatggaacgacggcccaattaatcaggtgatccatacattaatttgcattgcatgttatatatgactctattgttagttagttaagttgcttgcgttgttgaccaatcgaaagtactcctaatgaacttcccctacaataattaaataataataat

SEQ ID NO: 59617 - DNA, 802 bp, Oryza sativa
cggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacagaaagaaggagttagggcgcaagcagcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcaacgttaccatatcttcagacgaaacgaatcgccatgtccagattcgtatgctactcaagtaatgtggcagtcttgaagagaccgctcattgttgacagccgagttaccattgccgatgtgcgtggtttgtgaccgttgggtttctgcccaattgtggagatcggtcccacctgtcaccaggtctcaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtcccc

SEQ ID NO: 59618 - DNA, 12794 bp, Oryza sativa
tcgattaactccctctgttttctgcttgcgtgcgtggttgagtcaatcgtggtcaaagtgaacggcaaacgacagaaaagtgacgaaagtgttaaaagaggaatgaagggaactttcggtgctattaaagtgaaccggtaactttcggtgctagagaaccaaaaacgtgaactttcgatgctttgaaaccaatttttcctagttttggccacatcagaagtgattgatcagaccattttattacatgcatgacaaaaacagaaccatatagtctggctctatagcatccagtccacatgctcaatcttggtagcgtcttatgggttttgctctattggtaattggcctatcagtttaaagcaagtaaacttttgaccacccagctgttggagcaaatgctttaaattgtttgttattcttccatttttttaatggataaagtgcctattcccacagattaatcttattatacaatcagttaacaaggcctgcttttattgtaatttttactcaggatatggagctgccctcacaaaagtcacaacgaacaaggaaatcccatttgggttacgtcagatatccttaaaccatttaatgaagttattttatgcccaaaatttgtagcgcataccctttctctgttagatttggctttcacacattctacttccaattgttgtttgttcgtccttcactcctcagtaccttgctgctgtcttgctaaagcagttcatcaaacagcattggcaggaagacgaagagaatttcatgcctcctgttgtttctgcctcggaaaaggtaccatcatgcactttcaatcctctggataacactaattagactcagtccgtaacaggcccatggtgccattcttttcttttctcccttggattgtcaatacaaattgtaattcatgtgcgtggtgttatcttctcgcagcaagcactattttcatgcttgaaaacttctcatgtcagaagattgtgagtaatgattaatgagacaagaggtccacattattacaacaaatattccacatgcatagcttgaattgctcatattttttgatgcatggtatcccttactgttctaatcaatgaaaaaaaatttaaaaaatggtataaattgcaaggaccatggtgtcatggcaatagggtgtcgcatgtcatggtacagccagcctgcatgtcaggcccagcagcttgtggacagggaagctcctacttgctatttgtttagtttgtttcttaggccttaagccatttctggatacgatcagttatttgattaattaagcataatactgtttggtagggccattccatctctatttcaggttgctgacagatcattgtatgacaaacaagaattaaccaaagacacattaatctaattctaatagttcactgcaatctaattctagcatgtgacactgacacatgggcttactatgtaaattattgttttctaatatgatatattcttatcgcattattttgcttctccttatttatcattaggtgattatacggcaactcctccttacatcgttggatgattctcacgggaagattcgtactgctattggcatggctgtagcagctattgggcagcaagattggcctgaagactggcctgagttacttccctatctcttaaagttaatttctgatcaaagcaatggttgtggaggtatagagaattcttttgcttcccaatatttttgaaaccagggtgtgcagctattttagaggcctttttagagtcattgagcttaaacttagagctgctggattccttccagcatagctcttccaaataagctgtttttgtcacaatttcctggacaagctgtaggccctggctgagatttcagcaggtttaatttctttaaatagctagcttctaagagaaactggtggagaggtgtaagattccttaagaaactgccccttttgtgagggttttgtcttgctatgtctttcatctgaagcttaagcaataggaaacaaccacaaacttatttgtctaaagaagttcaaatggcatccattaaagcgaactattctatgttgcatggtacaaacatgggtatggtacgcaacaggctactacatatatgtaggattgataatagtatgagaattcttgtttctggattgacttatataaatggtgttctattcaacactatcaggaaaagttgtaattttttaacagttttgtccctccaccaaaaactacaggtgtttataataaaatgaaaattgcactcgtctacttttgttgttgttgttatagtgttccttcctttgaaaagaatggttacgaattgaacaaaaagatccacttctggcatcttctttaagctctcctgttttatgcttcgccatgttggtggctgtgtcagtgtctgacactagtacctagcttacactactagaattctagttttagtgctacatagtctaaataagaaaaaaaacatcttaggatgctcatatggccctaacactgactactaagatgatgaaaatattctaattttggaatttgtacattctttttctctctgaaatcagttacatgaatttagtaattacctattacaactttcaacttactgtctgtagttcgtggagcattaagatgtctagctcttttatcggatgatttggatgatacatgcattccaaaattggtgccagaacttttcccttcattgtacagtataatatcatctcctcatgtaagtctcatactgtttaatgtctgttaaatttcttttatctaactgctatggaggcatttatttgtttatccaattttgaaaagcagctgtacgaaaattctcttcgtgcgaaggcccttgcaatagtccattcatgtatttccatgcttggatcaatgactggtgtatataaggtggattgtcttgtttattactctttgtgctgtttctacatattagtaggaaacaaactaaggtgatctgttggtgcagagagaaacagtcagtttgataagttcaatgcttgatccactcatggagcaattctctgcaattttgaattcaccggtgcagtcccataatcctgatgactggaacatgcagatggaggtatacatcatataatctgtgttgtgaggttgtaagcatgcattgttaatagtcgctgaagctttttgcttgtcttgtgaccaggtgcttaaatgtttacttcagcttgtccagaactttcctgggttgcctgaagccaaaatttctggcaagtgcaaatgacttgttatgatttgttaccccctctccctttttttatgacgaatgggcaattttttgcagctgttcttgcccctttatggcagacctttgtctcatccttcaaggtctatcaattgtcaatgattcaagcctcggaagatgtggattctgttgggtatgattctgatggtagtgaaagaagtctggagtcttttgggattcaggtaatatcttgcatttccgttttgttgaaacttccttttcctgttgttacatttttagataatggataatccagcctttacttcaaaagaagctacaaccacttattacaatgttcataactgaagcaaaagcaaatgtgcatactaataatgaaatgtgacaagaagacaatcctgttattacttatcactgaatttcagactctagatttctttcactgccaccattcctgttattttagggaatacgcaaaagacttgcacacctttgtattaagatagaaaaaaaaagccagatgcgatggtcgatcttacggaggatcgacccaccaaatagttattacagactattcatcacggcaacaatgacataattccctttattgtactccattgtttcatttgctttcatatctcaatatgttcttgtccttttcagttatttgagctatggatatcaattgtggggaattcacggttagcaaaggtatgacatttcaatgaatattatgttcatttttataaaaaaaacaaatactgcctctgtcccaaaatataaggagttttagggttggacacgggtattaagaaagtaggtgaaattaaatgtgtgaaggttgtgattggttgagaagagaaggtaggtaagaaaattaagaggtggaaggatgtgattggttgagaagagaataagttgttattttgtgggacaaacgttgaaggctaaaagttatatttttggatggagggagtactaactattttttgtgctgttctactagatcattgctgggaacattaaagagctagcatattatactatagcgtatcaacagataactgaagaacaggtatgagctggctgaatcatcattaattcatcttacttttggcaaattgtgtttttggttgtttttgcttgcaaacgcttacgtgttctctattctttttgtttctagttgcaaaactggtcacgtgatgctaaccaatatgttgctgatgaggacgatgtgacttatagctgtcgcgtatctggtatgaactttaacattgtttaatttttcttaacttggttggatggattttaacagtgcgatgtgccgaccggtattttgctgtgtaaagtctaaaggaacataagattcataaacagaacaggttaaactaagcaaataacaaaatagagtactgttactgtagtactgcatatattccctcagacccaaaataagttcattttcacctatctcacacataccaatacaaaccaaaaagactagaatacctttattaaacccaatgcaattattctccattttatctactcccaatgccattattccctattttttacaaactccgatgcaatgattacttaaaaatgaacttattttggaacaaatgggaggagccaaaaatgaacttattatgagatggagggagtattaagctatatgctctgagcctccgattaggtactcgggaaatattctcttgatgtatttgcaagactcgcattcttctttacagtttactcttcgacagatatttttttcgaaatgtaacatgttttcctcgtcttggttttcaggatctcttttgctggaagagatagttactgcttacgatgaatacggaatagagtcagttttggaggcttcacagatgcgttttcatgaatcacgtgaactaaagaaagcgggttctactgactggtggagagtaagtttttgattttttaaattactaagaaatcaaaactttggacttgctgcttataaacaatgttactctgcttatcatgttcctcggtacttttaccttctgggttatgtgccttgattttagattattgcactttcaaaaaacagaagaagcaccttcaatgattcttctttgattatttcttgtttggcaatcggccatatttgaatttatttcctaacaaatattaaatcccaagtatgttcatagtgtccttaattgacttatctgatttacccctttttttttgttccagctgcatgaagcatcattttttgctctaggttcactttccgaacagctctgtgaagcacaggttggtttttaattttataataatcagcaatttcattgactccttttcttttggcaaatgtgccctataattttctctagtttgcatatataaagaattgtgccatttggaccaggcatcacattcctacttgttatctaagagcttaacatatcgtaattcagctattccatcagtttgactactgtaggtatgatttggattttggagtgttccaatgtggtatgatggtattgtttgcactagagctgaaaaaaaaagagggggcagacatcctgaatctgagggaaatactaacaaatcacttgattcagttcagtatatactgccaactttaaatatcctatcgcattgtcatgctaactaacatcaagccaaagttaatacatggtagacaacctcagatctgactgtatttacgaaagcaacttgtgctcatggcagatagttgatagggttggaggacgaagagaaactattcaccatatgtccatgctcctttagttcacgcgagtgggttgttttctatatgattatctttttgatggaatcgttaggattgacgcactgactttagaattaagcaacaataatgaattaatataggccctccaaatgttcaacctccaagcctgccgtcttgcaggattactattcgtgcacttttcacccgtgcagacagtacccacacattactgtaagctgaaacttaggtttcttgttttagagataagggaagaatggattgtaatttatttacttgttttgaggatcaagttatacatctatataaggatccatggtatttctcctgagatgcctccatttccaccatgtagcttgggttcttggccctaccccttgtcccccttgtcatgaactatctttataacaaacattacaggaagtggctaatggggactgggactttggatcatggaatgctttatgttgaccattctcttaacataagtcaatgtatgttttactacctcatatggcagtccaagctgatgtatttaacaagcagccatgatttcctaacttaaaacaagattccccttgcaacatacttacatattgagaaaacacattgataggatttatggcattttattattcaccatttgaattctgattgtttaggattctggttacaacgtgcgagatttacttgagcagatggtaactgacactgtgggaacaggtatctttctttagtctgaaatgaagaattgtttgttcatgtgctattactaatattatgacttttagaggtgcaccagtacccgtttcttcatgcacgtgcattctccattctgtctaagttctcttcagtggtaagtttccttttttttatgtatttattttcctatatgtccagcaagctgatttgggaaaacgtatcagataagtaaggaaatctgcgaacagtatctatgcagtgctgctcatgcaattgcctcagatgtgtaaggccatgaatttattcgtcttatatttcttgactcaagggcgaatgatatttgtctgacatatttgtttggcagacctcccccagttaaagttggtgcttgtagggcactggcgcaacttctgccagaatctaaccagagcttgaatgtgcccaacattatgggcatactctcatctcttgttgatcttctggggaaggtaaattttaatttaaaattgaaaacattacctgccttgagttttttgaaatgaagacatgctattttgtggcaggcatctgatgaaacgctgcatcttgttctagaaaccctccaatcaaccatcaaatcttgtatgtcagcatgtgttccaatgtatcttgtggcaaactatgttttgtgttgcacattttgcctttttcttggttgataattatctgcttggtatgtaggtggtgaacagtcaacattaattgagccagtcatctctcctatcatcctagatgtttgggcccaacatattgctgatccattcatcagcatcgatgctgttgaagtgctagaggtaggttatcgtcagacttgggcagtacaacacatgacttttcttgaatgcaggaatcgatgcttttagttcatgttgaaattttacaccattttacttcattttctgaacacatgataactgatgtacaacagaaaacatttagatttttatttctgtgtatcaatataggtctggcatatatttgttttttccagaggtatgcaagattgcgaaagatgatgaaaataatattttattggatgaatgaatgtttctttaaagcaaccaaaaataattttagggtaggctgagtttgaaacagattattgagtggattgttctgcggattatttacttgattttaggggtaaattaaatatttttaccttttgacagccgaagtttggatttggaacttttttgttaatgttcttgattaccttaaaagttacaacccactaaacaggattctagtttttaggccatcaagaatgctcctggatgtttagaaccacttgtatcacggattctgccaacaattgggtccattttagaaaaggtaagacacttaattccagtttcacattattattaccttccttccttcatttaccagtgttatgcgaatctaatttatggctcatatcctagcccaagatccagcagaacggtcttgctgcaggctcactggacctgttgacgatgatactgaaagtatgtcgacacattattaagttccataaagttcaagaccaaatatttcttataagcagtgcctgaagcttctaatcggcatcttgcaattcatatttcagaatgctccaactactgtggttaaggcgatctttgatacatgttttacatctattattcaaatcgttcttgaaagtgatgaccatggagagatgcaggtaaatgcttacatgtggttcaatcattgaagtcataattgatggtacttttgtggacatatacctttaatatggcaattttttgtcaatttagaatgcgacagaatgtttggcagcatttatatcgggtgggcggcaagagttgcttctctggggtggtggacaaggacgtacactgaagatgctactcgatgcagcttcaaggtaacgtcaagactatagatatttgattcatttctgtcatcaaatttagcattatagagtacataagaatcaaatggcttcaatctgtacatcctgacaaacttcaccatctgtcaaaaggaatgcataaaaaattaacaacatggcatcaatctttgtccagagctaggagctcatatatgcttctctctgaaatttgatctgcatgttaacagccaagcataatttcaagctgaatcaaaacgtgccattaggcgaatgcaaacaattaagcgcttcctacactaaaatgtagttccccagtaaacgtacctgcatctttgtggacttgacaaagatgtactaaaaagagcagcaatcaggatttttcatgtgccttgtttggatacattgcttccttttgatgaaccaatcaaccccttttgttgaatatttccatgctatccctataataggaggtgcaacaccatctctctatcatacacacagagaaagaagaagggggtaaatagttggagtacacccctgctttatgccttaaaatttgttttggtacttggaaggcataaccatacaaacacctcttcaatgtctttgcaggcttttagatcctgtgttggaaagttcagtatcactatttgtcgggagttatattttacaacttattatacatctgccttcacacctatctccccactttcctgagcttattgctgctattgtgagacgtatgcaatccagcagcattactggattgaagagctctcttgttgttatagtagcaagacttgtgagttgcatctctctctctctctcccctggttaagttgtttggatttcttactacccatggtggattataattcgatatattcacttttcactttagactaagtttgaattagtgttttggttatcttagtatcttacatggttattattttagttattatttgttttagtcctgggtctcttttctacccaaccgcagtaggattatgttcctatcatcattacctaataactgtcaccctatgttttctagtaaagtgcattaccagtcccttaacttgtcccatgtgtcatcttggcccctaaactctgataattcagttccagaccacctgaacttgttatatgtttcacaaaatgtctaaacctcccagtcaatatcccctctcacccatgtggcacgtttgactgtgcttctgtggtcatctaactaacatctccaggcccgatcccgtgttgcacctccttgtaattgacctggtacaaatctgaatgtgtaatgggtatgagtgaactgctaagtctaatactgtggctctaggacctgcagtcgtcgcctccttggtgctgtgccagtggtgggtccttgagcttaggacagtcgtgctatgctgaactcctagagctcaatgtgcttgggcaaaactgatgtgtgcaaaacatcctagagaggtcaacgatggtcagtttttagttgcacagagatggtggagatggtgcatggaggaagcggtggcagtggggtttgggagataggagagcgggtggtcagagatgttatagtgaaagactcgggcaaacatgtattgggtatgccacatcagcatctgaagctatttttatttggattctggtgaattacttaccaaatttggggtcattagaatatgcatcttcggagttcatggacataatgacgccgtgggacaagtttttaaggattgctagtgaaatttactcttgtattttgagcgaaggggagggaggtggtgcttcaggaaattctaacatttatcacctgctacaggtacatctgagtgcaccaaatgttgatcagtttatcaacctcttacttgcaattcctgctcagggttataacaattcacttgcttatatcatgtctgaatggtcacagttacaaagtaagagctcataaaacagaatatcattgaatcaaacaaatgtgacctttttattttgttcgtatagtaagagcttttcaacatcctgtgtaggtgaaattcaaggagcctatcagataaaggttacaaccactgcattagctcttctcatatctactcgtcatcctgagttatctaggattgaagtccaagggcatattattaaggtaataccataaaagttttgtttgcaacagttcctacctgcttattagcagtccatgggtgtcttacacacaaaaattcagactagcgcaggtataactacacggtcaaaagctagggtggctcctgatcactggaccaagattccactcccagctaaggtaaacaattattatttgccataataattcctccaaagtccaaaattcaattcttaaagagctttcaaagcaattttcaattccagaaggagatgaatctgcacaaatatcgttttaatatattttgtttgtacataatgtctactgttgagtcagacctcaattttcttttcgcatggtactgtagcattggctagagtccattagttagtttagagacaaggtaagatttagttgttcctttatttttggtataaactactcaagggtcaagtcattgccatctatcgagcaagaatgaaaatatttacctaagcatacctgaacatggattatgcagatcttctcactgttagcagataccttagctgaaattcaggaacaagttgttggtgatgaagacgattgtgaagaggttgctatacttctcttgacactgaaaattttaaactggactgttttttttttgttaacattggttgtcaatacaggatagtgactgggaagagattcagaatggtgattctagtattccacatgatatgatatactcagcatcagttccttcaaatgctaagccatcagttgagcatctaaatgcaatggcgaaagtttttgatgaggtaagtcagtggcttgtcatgctactttgtaatgttttgttgtattaattcctttatatttacccctaattacatacaataggatgacgacggaagttatgatgatgacctggcaaaagctgactctcttaatgaggtttgccttcgcagcaaagtccatctaatataaataaagataatacacatacaatcaagtaaaggaattctttttttccccttacaggtgaagctgtcggactttctaacaaacatctttgtcaaattgtgggagagtgatcggctgctttttgaatatctttgccaggtaacactcctttgctgttttctttcattatctttgaaaactaatgttaaatggctgttttatttccattatcaatgaaaacataacatttcatgggtgtattaattttcttcttttgctttgctgaatgctaattgctataaatcccatatatgaatactacatcaatgttgtactgtattatcctttgcaggccctaacagattcacagaggactgctgtggacaaagttttgaggaaataaagcgcatacatgattgagatatctacatttggtcctattccacattagccattgggtgagctttgatgcttagtgtaggtttattgattaagagttctgtgtacaatgtgaggcgagtcctcgaaggcaggagttggtggtgtgtggttttgttagtgtaggtttatttatccaaatttgtctagatccgaaagtgaaccaacttagaaaatacaagcaaaaatttgccatttgtgtgttcatgtgacgtgttggatggtgtattgtttgtatccatatgtttggttcgtgaaagaaggcaaggaaattttttcatagcggtccacccgttcagtgctttcaggtcaatcggagttctgtttcatgaaatttataaaccttgtgttttggttttgatgagctgctcccaagatccagtcgacatgagtgcaagtcatttgttttgcatgagagcttaatcgatagagtaaattgtttcacttcgtaccgggtttagtatatactccctccgtattttaatgtatgacgccgttgactttttaacaaacgtttgaccttttgtcttatttaaaaaaatttatgtaattatcatttattttattgtgacttgatttatcatcaaatgttctttaagtatgacat

SEQ ID NO: 59619 - DNA, 4278 bp, Oryza sativa
ctagattgtgtcatataactgaagggatttttttttttgagaataactgaagggaaatccttttaggctgcgttccttcccattcctaactccccctccttttttccgtgcgcatgcttttcaaactgttaaactgtgtgttttttgcaaaaagtttttatacaaaagttgttttaaaaaacatattaattcatttttgaaaaaaaagttaaaacttaattaatcacacgctaaacgctgcttcattttgcttgccggggaatgctcccgaacacagcctaatcatgagtcgaacttctgatttttttttttttgaatttagatcatgtttcacaaagttttatccatattttatcaaatttaatgaaatatttataggtttgacaatgtaaatcatggtgtatgtaacttatttgaaggcaacctggtgtaaactgaaaaaaaaatgtgttaaacctagggcatctttggattgaagccaattcttaccttaccaattatttgatagttttgagtagcacttgttagctatttggattgaggccaaatcttaccgattcaatagggttagaaacgaacaaaaccctatcaaaatattggtagtgccaaaacttgcccaagatttggcattaccaaaattttggtagggcttcaaaccaaaacaacccctaatgtaaagtgtaatttactcatttgataaatgaccatgcaagactagatcccgagctcatcacggatgggtgctcaggaaagtgaagataacccaaacttaatcgatattaagattgccaagaatcttaagaaataagcacatcacaactcacaaggaacacatcatgctatatcctatgctcgtaacattagttaggaaattaggaaccaatcaatgacataggtagcaaccagctacagaaagtccatggtttcatctggaaaacacgccatccatctggtgatcagcaaacgaagaagcaagcgcatgaatctaaacaaacctattatgatcattgctctgcgcagtacagtacaatatccacagagaagttcacagtaaaacatgcaacaacatctataagagagattctcaactgctaccacaaatctcagatgcataaaagtgccctgctaagatcttacagcatgtaatttgtcagtgatgaatggctggactgtcgatacggaaatcaaatctggaatggcatgctaccatttcaactgcttctgtttctttcattcggcagagctacccgcaggcttcgattcttcgtcctttggcttagttggggtaataccttcagtgcccatctcaaccttgaggtcattgatgctctgctccaactcatcaattcttgcgcccatttcatctagtgagcactagttaaggactatgtacaaaagcaggtagatatgttgatagtacgatcttgtttatgtcaggaattcaacgaaaaaggcaaaagcctcaggaactcccaaacccagcaatttcttttcccagttatatgtatttaaactgtttcagatactcgatcagaactgttccagtgtactgattgaaggcacaaatatcatactttttaaggatttcaagttactaccaaaatcaggaactttttggacttgtccctcttttgtgtagtgactaatggacagatgtcacacatcaataatcttaaatgcccaagagtattcttacacactcagaactaaaggttcaccatgttaatattcttccttttaaatgaatatattcttcctcttaaatgaatgtatttaaagaagtaaagtgcacaagagaactggtttagaaggatattctttgaaatgatgttctctgacatagattggaacctggtttgctgcaagaaagttacaattcagtaaaagtgaagtgattgcatgaaattcgcatcgccccgccatgtgaacaaagttactcaccatctgcatcagaagattttgcacctgcaaaataaatagtgggcaaaacaaaaataaataagttgtcaagaaatgcactagtaagtacagcagcagcaacaacaaacaactcaatttatatagctcaaagaaaatgtgaactcagagcaagatcttaatgctcacgaaagcggtcatatcagcagtgctctgcgccgagccatccgagtcctgatcagcctgcattagaagagggaatgggatgaaatgagcaaactcggcaagcctaaccacaatcgtcagcccaagtatgccaccatacgcatcacaattcacaattataccatcccacgaaacaacacaaacaaacagctgatccatccatcccctagtccttcacggattacagctacgcactatgtatacagatgcaatctgctttgcgcgtgcaccaaatcttcggtagccaagaatcgccagcacgaggaaacctaaaactgcccacgccgcattcgccaaatgcagaaactgcccacagcccgagcagctgccacacgatgcggaggaggaattaatcccgcaacccgcagaggcaggcgggcaggtcgtaattcaagcaagaaccagccggcgggtgtgatgcgcagccccatttccaagaaattttggcgaaaatcgtcttcctcgagcgctcggcgacggcaacgggcggggaggagggtggcagcggggagggagaggtgtaccttgatggggatgccgccggagccggagccgggagccgccataggcttgccgccggcgagggggggagagcgcaggcgcagatccgctcgtggcgagatggaagtgggaactgcgcgatatgggttgggggttttcgaaagtgggcctgcggcacatgggccaagaaggcgcgttgcaacggatattataagagataaaagcaaaagcaaaatcttataagtttatcgcatagttagttgattaggcatataatgctatgctcaaagcaaaagcattcaacttgtggtattggaggtagtctcggacaccaccactagcatcatttaaagtagtatagataactgtgaatttattcttaaaaatacaatataatcatagtgtaattgtattgtaatttatatgtaacctgaatgtagctttcacataattttgaaccatatatttgttttaagattcgtaacattgttacagcacgtatatatgtaagaggattcggtttcacgacactacaaaagttgtacccatgccttgctatacatctaatacgtgttttgaatcttttttttgtctactgtatttttatatggaccaaaatacccctagcatatcttttaaccctagccccaaatctaacaaccctatcccaaatcgatcccctaatcgccccatgctagcgcctagcagcaatggcgatggctgctaagcaagctccaattgcggcagtggtgacggtaagatttcggcatagaggacggcgtgtccggcagctacgatgtgcggtccgatggtagcgacaagctccacattgctcgtgtcggtggaagctgccgatgctagcaatggaggggatgggcagcagttgactggaacgggcagtcatcgtgtatgatgatccctcctcaccagctccatccgctactgtggatgcgctcggcgatgacagatcgagtggcacagagggagcagatttggagggtggcaccgatgagcaatgctgagtacggtggctgccggtggtcatgaacaacaacccgactcttccatcgccctttttttttcccctacatttgttcttctttttcatgtatatttttttacacgaagttcaatcattttgtacacaagttttgtataacaatttcatactttagatttgaaattttgattagatctaaagcatcaaattgtgaagttgataggaggaaggtcatgttgttgttcaatgcttgatttgtaaggggcatatgtattttggtccatatggaaatacggtaacaacaaaacgatttagtttcagatgtataaattgacatatatatgattttggatgttacattggcatgattccaatttactctatttgaataaattttttaaaatcagcaaatttataataatgtcacttaaccatttcttttggatacaagcgaagcatattcctccgtcttctccccgcccgggtgtcgctctcctcctcgtcgccgtcgccggtcgtcgccggtcgcgggtggcgcgcaacccggagtctctgccggctgcttactcgccgcgggcttcagcttcctcctcgatctccggcgcgcctccaagctgcagatcggccgacccccc

SEQ ID NO: 59620 - DNA, 13973 bp, Oryza sativa
ccgccgccgacgagcgccactgccaaagccctagatcgaagcgaagcagagggccttgcctcgccctctccactcaggatttgtaccgctcgcattcgcatcgcgcgctcatgacctggagttcatgttgtggaagtagacgcatcgtagcaagcaccacccacgcgttggcttgcccccgtatctgcggttgattgattcctgttgggttcggttggtgtttgctcagattcgaggtgacaacgtaccagcagtgaagaaaaaacattgcgaagaagtgatcctcgttgcaccaagagtgtaaataatcttttgatcagctcctagaacaaacaataatcacatgtgttggtcccatgggcagaactagaaaatcaatccaaccaagatgagttcatgattgctcattctttcgtgcgtcagataaatcaagctgcatacttgggtaaaagaagatcatgtgctcaacatcttattgttctgctagcagttgtgttgaatcttcctatgattggccgaaacgtattatgaagctcctgatgcttctgctctcccagttgttggtaaagaaagtgatgctgttggtttggctagctgtctagttccttccagtttcttttgttcctagcatgggcaacagtagtcagcaatcatatcaaaattagatgaaatgcttgttacttgttgagacattgagatataatggattatggagatattactccatatgacataaatacatattaattatggacatctatttccagttttctctaatacttttttgtttttctgcagtgtgttgaagcctgcccttgacacttagcaactgcagagtcctgctggagagagatggggttcatcggcgacacgatagagtcaatccgctcgatgcaggtccgccaggtgctggcgcaaatcatcagcttaggtgcaaccttgcctcttttgcctcagtgattattttgctcacagataagtggattgggtccactacttcttgatttaggcttgggtatttaccttgtgattccaggagagtttctttgggagtggtctattcttagttctgttgggtttgatttcgctggtaacgctggggtagggaagtcttttgggattcttgatctagttctatgagctctattaactattccctctgatccatattataagacttttgggtttgtcccaagtcaaactactttaagtttgactaaacttttataaaaacatagcaacatttataacaccaaattagtttaattaaatccactattgaattgtagtatatttgatttgtgttggaaatgctgctatacttttctatgaagttggtaaaacttaaagaagtttgtcttaggacaaacccaaaacatcttataatatggaatggagggagtagatttttctaaggaatcatacggatctgggtaacaaaaatggattcgggaaacaactcttgtttaatgttaactgtaaaaatatgcatgttttatagaggaatcttttcacatatgagtgggttttaaccttagaaacttcttattccttttttttaaagctagggcatcagggcccccatttccattaccagaaatgagatagtgctacaagttcttgctgagttacttaagcctagaaaacaaaaagcgaaaggaagataaagaaggaaaaacaaaagggtctagggttacagtttaagatctgaaggatctcccggcatgacagcaaaatattcagcaaaacacacaactattcctattcagcagtgcacaccacaggacccatctttcacttgatgtctttagccctctagtcttatgatccccgtcccccaaccgaatttggagttgaaaatgtcacttgccacttgccttattaatctggcccccagcagaagtttttctcgatttgcctccaatgtctgcaacacagcccaggtttaaatccagtgacaagtcagaaaaactacctcagtagggtcttttgggagtttattctcaaaacaagcattgctcctaaatttccaaatggcccaaataactgcagccacccctacaaccactgagtgtttcatgttcttctcaaaaccattcaaccattgcggcattgcccaaacaggtgttgtatactcacaccaagtttcagattgagtgcattaattactacattccaaatcaatttggccattggacagttaaagaacaagtgttgaattgattcttcctcattacaaaactgacaaaagatcgagttacaaaatgtgatattaggcaaaaggagcacatagaatttactcactctgtcccacaaagcttcaccttttgccttcttcatttgccccacaaagacttcatctttgaagcagtcagtgcattttggagtttgagaaaaaaagagggacatatgcattgaagtttgacaaagtgcggaacgaatacattagagttctgagaaagtgaagggtattatggtctttttggttttatattggtatgtgtgagataggctaaaaatgaattctttttgggacggaggtagtactgcttagtatgtttttatcagttaggttagacttctgctgctcttatgttatatatatttattgttgatgcaacagcatatatgatagcttcaaatgtttctcttggcaggtatgattgttacctctgcattgatcatatggaagggtttaatagttgtaacaggtagtgaatctccagtggtggtggttctttctggtagcatggaacctggatttaaaagagtaagttgcttccttagacaatataagagccatattatacttatatttgtgcattcgcaatctttggtctttacatacggggatttacagtaatatttgttttttgtgcatacgctgaatttctcagttataagggacaaatctaaatttcagaagttccatctgcaacaaataaaaaagggaatttcctttttttaataagataggacgatatatggtttcctgtaatttatattggtttgcaaatggtgaacaaatgccttgttgccttattttacattccttaaaacttcgggttcattcatttcccaaaattttctttaaacagcaatttattcccatctgtgttcaactttcaccaagaagtcactttttaccctttaatgcactgtatgcatttagcattgttcatgaatgaattgttatctgctttcagggtgacatcctgtttttgcacatgagcaaagaccctatccgcactggagaaatagttgtttttaatgttgatgtaagtcttactgaaacattgtacattgtacatcatgaatttactgtatttctatatctcattgtattgtatttggctgttttctgctttctatgtagggccgtgaaattccaattgttcaccgtgtgatcaaggtaataaatttcaagtcattatattatcccatttgtttcagatgtcttttatgatctttcccctatacaatggagcttatcattctcttggtataggttcatgaacgccaggagagtgcagaagttgacatcctcacaaaaggtatccatcattttctatttgaacaccataagtttctcaccagtggttatagtggtgactggtaaagcattggcagtagtaatcacctgctaacaatgtataacataccgtggatacagcaatgtttgtttgtaactgatgagctgcctttcaggtgataacaattttggggatgaccgacttctgtatgcacatgggcagctttggcttcagcaacatcatattatggggcgagctgttgggtgagtgtcctcgactttgacaacacttatgtgccttcacacttaatgaaatatattttgcctgatcttatgttttgttatgcgagaacagttttctgccatatgttggatgggttacaattatcatgactgagaagccaattattaaggtatgctcatcctttctcagtatactgattgaccttgagattaaacaatgaatgcctgttcataggcgacaatttgttccgtcatataactcttcgctccttctctctatcaatgatagcacaaaaattaagcagtaccattgcagctcgataggtctcttaaaacttgggaagcatttctgactgactgatatacgatttctcttgctgcagtaccttctgatcggcgcgctgggcctactggttataacatcaaaggagtaataaagatgcggcttttcagtagagtagtggcctctctagtcgcatggaagaagctggtatttgtttcaccatgtttccaatggaagatgcgaggggtttatttttaggataactgtgcgacaattggcattgtattttccagcggtttatcatgtggcatccatctttcagtggtttacagttaattgcgcaagaaaatttaacgtgacttttggttcggcaactggttattggatgctgactttgatacaatataagatgaattcataaagcaatcctttgaggcaagtagaatcgaacctggctaagcctttttccatggatttgttggagtcttgactcttgagtgctaaatccctttcttggttaccaactgctattcagcggcagttcttttcactattgtatctgtcttctcaatccaaactatgctgaagtctgatcactgaatagcagcgcggctgtgatggttcattgaatactttgttgaatgctagtagctcatgtgccataaagccctaacagaatactggtgagatctcaacatgcacatatatgcttgtacttgtgtgagattgaggcaaatatttctgtgtatagtaagtatatgtgaaaaggagaactcgagccatattatagatctccagcccattaaatcgtatccagaatattgatatggtgttgtctttttggataaaagaagttcgtttggacgtggtctcttttgacaaatttgtttacttctgatgagtgaaatggtttacattttgactgttgtctgggtgagcttaaagcgtaagaatgatttgaccggctggctttaaaccatggcctttcacttcttgttcttggtccgcagttcttgagtgactttgaatgtcaaaatttcaggttgtcgttcaaacaatgcgatgcttttggcgtcaaaacaaccaactgagacgccaactgagcttagagtcttgtgataaaactccagatttaagatctagactcggcaagaaacttgtatttaccttgagatttaacatgaggacgtatttagtggtcaaagtgtgcagtgtgctagtgctatatggggttgagcctttaatttttttttgaagggatggcaaaagctttacgtctttgcctcgtatatcgatagagtagaagaaaattataaaaagttatgtatagggtctgtcaagacgacatacctggaaaaagagaattcttagaagatatctcccaaaattccgaactcttagagtctagatgctcttgcttcctccttgatcttggctaggattgaggttgacgttgatgctttgtggcataatattcttgcattacgttcgcaccacacttccgaagataccagaatcaccagagttctaagtggttggtgagggttattgggggactcgagcacaagattccactattgtttgactgagtgacaatcattccacttgttcattgtaggtacgtgctagtccatctctggatctctgcccatattctctttgtggccctacattttgctggtaggtgaactgcatatttgtcgacagtacaacacaatgggtagatcttttgatttttccaccctcttcgctccaacccgtccgctgtccacactctattttggacaatgagctaggagaagaacttgcacttcgaaggggcccatgatttctagatcgattggttgaaagcagttctcgtggccccgaggaaccgaagtctgtaagccaaatttgccgaaatttgacgagtattgtctatttgccgtgaggttccaccgaatgccattccgttcgtaatttagaggggtcattatcctgacgctagatcaaagtcgcacgaattgttgcaaatgttccttctctgtgaatcacaggatgtcaatgtctcgaatccaattgctttcttttttttttttgaggctgcgaaaatagcaggtgcaatcctccgtggggtttgattttctagccacttcgagctctaaaagcacactgtttgccatccccaactgttatggttgctgttgccgcaaatagttcctcgtcgagatgattgcacgggaccgcagtccctgcccatggcttctcaggtgccacccactctttccaatctaagccattgtgccgaagcaaaacgatcataaactgaaaaaaatctatactcagatcaatatatctaagcatctgattccgcaactcaacgaggcaaagacaaaaaaaaaaaaaaaaaaaaaggcaaatccaagggaaattttcatctacattgctccatatttgtctgtgctttgctgagtgtcacgtcaggtagcgttgtcatgaggatgcgattatctgaagcagcaggtcgttccacacgtcgatcgctccgggcaagcaccagtgcaggcagtcgatctcgaatccgtcgtgctcgccgccgccatgcccgtgccggtccgggtgcccgtccggccggagcagcatcatccgcgtcacgtccatcagcctcagccgcgcccgcttgccgccgttcctcgccgccgccgccgccgccgccgggagaactcctcgacctgcgcccggtagaactccgcctccgtcgcgccatctccggcgccgccccgtcctcgctctcgctggccggccgcgtcgcggtgcactccccgccgtcgaaccacccgccgttctcgtagtgcgtcggcgccaccgtgcgcaggatcgccgtgccgttgaacccgtccagccgcgccagcgccccgagcacggcgcggaacgccgcccgctgcgcgtgctctggctgcttgacaatggccgtggcggtggcgttgctgtcgccgcagtcgtggcagccgacgacgcggccgtgctggtagtacacggcggggcgcgcgaaccagtgcgacgcggagaggacgacgtagtcgtggctcttggcggcggacgtccaccgctcgtcgggctcgtcgaggtggaagtcgctcgggccggcgaacacctcgccctgccgttccggaccgccgccctccggcgggccgcgcgtcaggcgccaccggacctggaacggcgtccagaagtaggcgacggcgaaaccgtgcgccgggaagcgccagtgctcgaaccccgccgccgcgtcgcgcgacctcgccggcgcctccacctgcgacagcgcgcacacgagggacgtcacgtggctgctcgccagcgagtcgccgacgaacagcatcgacctcccgcgcacgagccggaagaaccgcgccgcgtcgaacggcccgagcggctcgcacccctcgccgccgtcaccgggacgccaccgccaccgcaagaactccatgctgggcctcccgtgcttcatgcagttctggtagttctggatgaacccgcacgtcgcgttggtgtagtacggcgccgcgccggcgtcgcgcatccactcgccccgcccccgcgccagcgcggcgtcgcaggcagccgcaccgccatcatcggcggcgccaggccaacggaaggagccgagggagaagaccgagaaggtggcggcggcgaagaagaagaggagcgcgacgagagccgggacggacgtggtggccttggcggcaacggcgtggcgggtccggcgagccccggcgaggaggccgcggatggagaggcgcttcatgacggttaccgacgaggcctcgccggtggcgtcgccatgtcgccgtgtaagtagtgggaggtcgccgatcgatcgagctccactgacacagatgtgaaagtcaacggcgggggaaagtggaggagacgtggttgatggatccggacgtggcgagcatgtgagcgcgcgtgcgtacattctctcgaagtgccccggtcaatccaacattttttgtacaagtatacggggctatctcgtgcatacgcaccagcaactgagatggcgcccccacccggcagacaagttttcttctctttttttttttacgatttttctcctattttggcacccccttccgtcggagcgtttttttctgttttttttttaatcttcagcgtacgtgttttttaaggaggtgtttggttgcccaccacacattgccacaatttctttggaaagtgtttggttgactactaaagctatgctcgtcacaagccaaacctcctcccaccacaatattttccagcagaagtgtggcgggctttttccccaccacaaccatccgtagcgcgccatatcggcgaaaaaaatcaccaactaccgcgataaattcacccccttgccttgttcaacacaacaaaccctatcttaccacatctctctccttccgccatgctccatggctgccattccacaccgccgtgctcgttgagctcacgggcagaggtactgccttctcccaaaggcagtcttcctttggccttctgccttccgatctcctgtcaccaccaatagatggcacctgttgatctctggttttcgttgtatgtgtgtgcatatctgagtagtttctaagccctatagaagcaacggaggcagtggaggcaaagggacaccaggtacatctaaattggtaactcctatttccaataaactataggtgtcatgttcatttatcattttttaaaataattctctattttcatagggatgcataggagcactatagtactgtactattctcaccactatagtattgaggtatttctatcattctgtaagaggaatccaaacagctaccacaacttcttgccatacattcgtggcaacgatccaaaacaacagccacattgattttgccacaccttagtcataaatcaaacagtctaattttgccacaaactctggctagccttgtacttaagcttaagcatggcaatgtgtggcctagaaccaaacacaccctaaatctttaagttgaaagttttcaaatcttgacttaaaaatcttctaatttaaattggaagtttcaaatatggagttgaaagtttttaaattttgagttgaaagttttaaaatttgagtttaaagttttcaaatatcagttaaactttttcaaaattgagatgaaaagttttgaaaatttgacttaaaaatttaaatttcgagttgagagttacaaaatttgacctcgaagtttaaatattgagttgaaagttttcaaagtttaacatgaaagttcataatttgacttgaaaattttcaaaatttgggtttatagtttgaaattttaagttgaatgttttaaattttttgtatgacttttagtttttaataaaaagttttagattttatttgaatgtttctttcacgtatagatttctttcaatctgttactcctagtaaaaaaaaccttcaaagaaagaaaatattaccttaattatcgttatatccaaaactaatatgattagttacgataagatttagcgcctccgggaaaagataaggttgttgccgactgaaaaaagaaaagtcaaaaacaaaatgtgtggctatgctggtccttatgagcctgaaacgcacgtcaccaattagctttgtcgcaagtatactcctactgaccctctaaaaaaagtatactcctattgatagttcataaggactcaggacactgactccatcatttcggagtttactctccctatcccataaaaaaatattcctactatgtcagatgaaattagtgaagaataaaaataaacaaaatacatcttattattgagaaaagtaataatagtgatatgtaggtaaaggatattgaatggagaaaacttctcgttttatgtactaaggataagtataatggcaaaagttggttttttatgtgacaagatttaaactttagaagttgagttttttttaaaaaaaaattggaacggaggtagtatagattttgatttggaaagatcaaactggatatggcttttctgacgttaggaactttaggaaaattggaggattcagttcctataggatttaagtactattcactcattcagtttggaggaatcgggtatgaaaatattggaggatttttttcccttcacctatgattttatatgaattccataggaaactgaacattcacgatgacctctttttcattttcctttgagaacttcaagacaaatcaatgcatatgacctcaaaatgagcctattccaacacttgtcaagcgaaaaaaaagagttacatatcataatcttgatacaatggttgtgcaactttttgtcaactttggatggaagtttataaatatggattcaataattgaacactctttatattgtgttgacaggtttttatttttaagtttgtttgtgctttaatggctacattagcctttataagtttcattggtctgcattcgtgttgagtgtttcattgtaataattggctgtaaatctcggagtaaaggccgggatggttttattctattctattattaaagaaaaactatttgttatactcaaatagcgaaagtcttatgttttgctctactcctgtgttctgaacaatgtgtgtgcattttttctatgttttttaattctatgtttttcatatacaattctatccgatttatgcattttttttctatttttatgattttgtattcctacattacaaataagcccctaaaccggaactaggatccatcatccaatccttgcgtctccgtgggtcgcggcgcgcgagagcaccccgcgccgtgccagtccaactaaagcgcccgacacgtccacgaggaagtcggggaagtactccgcgtttcacggctagccgaggccactgggcaagtgggcacgaagtctaaggccccaaagccagtgattgttggacgtgacaaggaagtaaacaggtttttggtgcactgtttctctgttcctacagaaaaaaagatgattctggtagagaggtagtagtattactccatccatcctagtacttaagtacaaccatgagttttatgttgaattttaatcgtctattatatttaaaaaatatttaaaaaataagttatgtataaagtactattcacgttttaccatctaataacaacaaaaaatgctaatcataaaaatttttaaataagacggatgatcaaagttagacatgtaaacttatgactgcttttaaaatggagctcatggttgttcgcacgccatggggagttgtgttgctattcaggttggttcgcagttcgtacaccaggccaggcctactggactatcattgggaggtgctcgatgagggcgttcatagtgcagtgaggtggcattctgttctaaccatccacgtcagatattcctccctagatgcatgcgtagcgttcccaatccaagcccgtggagccaaattaagtcacccgttcttcgtcagaacttgtaggcaggccatggccccatgcgacgcccccgcatcccgtatgaggcggcggcagttgccggcgaggccaccacgttgtcctctgttggcgaaaaaatcgaacacaccggcctgggagatctgcttagctccagtgcaggtccaaatcttgatgagatgcgggcgtgccagtcagtttgatcctacaactgacaatatatgcaaatagtagatcaaaacagccgatcggctgacaagccgatggagtagttccagccgatagccgataatagccaatgccgataccagccgatagcgatagggtttaagcaatcctatatgtccaatgtagataatgatatagtggcaatcagctaatgattatataataaaataacaatataatccaatatataccaatcggctagcaatgatatgataaataagcatcgatccgaaggttaaagcacacatcggctggaggtccgatgtcatgaaatcctcaagattagatagatcaatgaaacctttattgtcatcggctaaatccaactcatatgtatatgcaatccttatgagccgatgcaatattcagataactcaccggttgaaaccccgatgaaacccttattggcaatcaaaaagtaggctagagattatggttctaagcacaacttagtagatcaaacttaactgatgcagtactaagtatgaaaagaaacacaatatctagacaatcaagccgttgactgagttttcagggtggtagatgtctaagctaatctaatctagcaacgcgatttagccgataccggtagaaaccctaaaacgagaagcagccgatagagctaaattgatatgctaagactagattaacagagacatatgataaataggtaggcaaatatatcatccaaaccagagcaatccaagaggtcgaatgtactgatgcagccttgaacgacgccgatgtaaacgatacaattgcttgggccggcggaacattggactttccccttagccagagatcgaacaccgatgtagccccgcgtcaggtgctaagtcccgccggacgataaaataaaagtagaagtaaaaagggtggcgatgcgccgaattatattgatcgtagtgatagattacatagaccccgggtgtacatatttatacccatgggttgatacaagtctttgtcggacaagaaagaaactttcctaaagataaaaggaaaagataaagtccttataggccaccaaacacactttcctaaagataaaaggaaactaacaaactattcctaattaatatataacttgccatgccgtattttctttgaactcggtctcttctgaataagcttcctttgatagatcaatttccttaaccgaatatagcaagaatccgacgactgacgacttgacaactctcatcagctaatctcaggacttcaaagccgatgctgactctaagccgatgactactccaggcttgccaaaattcactgttaacatcctcaaagcggtgccgtgtcggatttggtgagctcgacggggtggtgacggcactagccaaggggggaggggggggggggggaaggaagatggcggcggcgatggcctgggaggaaagggaagatggcggcgacaatctaggagaagggaatatggtgactgcggcggaagtgagcttgggccaaaatgtgtgacgcactgctgctgccctggtactccaggtgatactagtcagcgctggcatatgacaaaactggtgccatccattcagttggcatccactgcaaaccggacgcgcgccggcgcacgccatccatccatgcgtgcgtgcattccgttcgttgctcatcctctcccgtcctgttccgcctttgcacgatacgacggaactgccgggtttcactcgtcggtagccatccgatcgtaccgtgcattcctttccgagaaacaacatttccagaaaaaaagacccaccccatcctagaaaaagagttgctcccactcaaaactcacggatagaaaaaagcaagtacaagtactaaattcctagtgcaccggcagggcacttgtctgtgaatattggagggtacttctatgtcatagttaaacaccatatatagaatttgaggggttaaataaacttatttctatatgaaaattttgagagagaaaaattacaaagatgaaccagaaaactcttcacgattgatgacgcagcagcatctggagcagcatctcgttccacacatcgacgggtccagggaggcaccagtgcacgcagtcgttgtacagcgtcacgttctcgtgcgcccagtgcccgtaccggctcgggtgcccgtccgcccgcgccaccatcgccgccgtcgcgtccatcagcagcatcctcaccgcgctcccgctcgccgccgccgccgcctccgccctcctgaa

SEQ ID NO: 59621 - DNA, 8368 bp, Oryza sativa
cgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggagttgattctttcccagataatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatttttccacatacagagagagtgagagcttgagatttcaccctaagccctcggccgaactggcaaaggggggcctgcgcggtctcccggtgaggagccacgagctccgtcatctggcgcgccaggtagggggctcagcgtgtgctttcagagctctcagactcttccgtgtgccccaagtttttcttgttcagcctaatggccgagcaaggaaaaacgcacgacctctcgccgagtgtgagcggcgacgacggggagccgaatccacgccgtcgagctcgtactcctccacctcctccgcgccaaagccctaagcagggggaggcgcttgagagggtcgacaagtccgcagcgtcaccggccgcaggtgatgcaggagaacggcgagacggggagcgtcgcctcctcgtctacggcgacggcagcacgcctcagggtgcgcttcaagctgctggcgcgctcctacgacacccgcctgtcgtccatgacccggagtctccagcccaacgatggctggaagacgtggccaacttggtcatgacggcacagcagcgcctgggtgctggtggacggtcagccaccaccaccaagacctccggcgccgctaccaccggctccgtgtcatcaaggcggagggcgcggcgagcggcggcggctgcacgtcattcggctgccactccctcgtctacaccgtcgactcgggaggatcagcatggggagccggatgcccgcctcaacatcgggcgccggtgtaatagccggcgtactccccgtgcaacggagggagcctcctcgtccagagtgtcactccgacatggacgtgaagatcagccctccgtgcccccggccggtggtgttggctgtagagcctttgtggcgagtcttcggaacgtccgttggcccccaaggttccggcccaccatcaccgagaagtacgatgggagcgtcaaccccaccgagtttctccaggtctatacgaccgggattgaggccgctgggggtgacgacagggtcatggcaaacttctttcccatggccctaaaaggacaggcgcggggttggctaatgaacctgccacccgcgtcggtccactcctgggaagatttgtgccaacagttcaccatgaacttccaaggtacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggcgtgcggcacaaccgcatgctcgaaaagatcgcttccaaagagccccagactaccgcggagctttttcagctcgcggaccgagtggctcgtaaggaggaagcgtggacctggaactcctccggttccggagtggcagcttcggccgcccccggatccgccgctcagacagggcggcgtgataggaggaggaagaagaggtcggaccgttccggcgacgagggtcatgtcctcgccgtcgagggcgctccgcgggccacccgaaaggggaggcctgcgagcgacaaaaagaaagaggccggaactcccggcagggagcgccccgccggcaggtggtgctccgtccacaacacctccctccacgatctcgcggactgtcgtgcagtcaaaaacctggctgagcgaacgaggaagtgggaggaggacaggaggcaggaacgccgtgagggcaagtccccggtggttccatccggcaaacggcgaggtgaggccaagcagaaggcccccgctgttgacatcgatgatggtgatgatgacctaggtttccaagaacctggggccaccattgccaccgtcgatggaggagcgtgtgctcacgtctctcgccggagcttcaaggctatgaaacgagagcttctggccatggcccctacccatgaggcgatgcgtcgggcgcggtggtcggaggtcgctctcactttcgaccagactgaccacccaccgtgcattgcccggggagggcaggttgcgatggtggtttcccccaccatctgcaacgtgaagttgggacgtgtcctcatagatggaggagcggctctcaacatcctttcccccgcggcctttgatgctatcaaggccccggggatggtgctccagccgtctcaaccgatcatcggtgtgacgccggggcacacgtggccattaggtcacattgacctaccggtcaccttcggtggacccgccaacttccgcacggagcgggtgagcttcgatgtggcggacctcagtctgccctacaacgcggtcctggggagacccgcgttggtgaagttcatggcggcggtccactacgcctacctccagatgaagatgccgggccccggtggccccatctctgtccgtggcgaccttaaagtcgcgcttgcttgcattgagcagcgcgcggaccgcctcgctgctgcgtccaagcccgagggtggtgacgagaggcttggcccttctgcccccaccgccccgaggcagcggatggccacttgcgacgaggtcccggtcaaggaggttgccttgggcgacggcccatccaagaccacacggatcggtggtttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaagccccggaacgtcaagctttcatccgcgaggaggtggctagacttttggaggccgggttcattcgtgaggtcatccacccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcattgaggccaatcccgagaagattcgagctatcgagcggatgcgcccccccagcaaacttagggacgtgcaatgcgtcaccggttgcatggccgccctaagtcgtttcatatcaaggctgggagagaaggcgctacccttgtttaagctcctcaagcgctcggggccgttcacttggacggaggaagctgaaaatgccctcgcccagttgaaggcgtatcttagctctcctccggttctagtcgccccggagccaaatgagtccctgctactttacttagcggcgaccccccaagtagttagtgcagcgttggttgtggagcgcgatgaggacaatcctcattctgcgcacccccgctctgtgccgacttggcccgggagcaggcagggaggagaggcccccgagtcgaacggtggcctaaggcccccgacgaccggagtcggccctccacccgcttgtcaaacggtgctgggtgcccccgaccctcaggaaggccccgaggccactgagggaaggctgcacttaaagccctttggccccgaggctaaccctgtgctgactcgacccgggaaagagcagggagaaggggcccccgagccgaacggaggccagaggcccctgacgaccggagttggccctttgcccgcttgtccgacgatgccaggagtccccgacccccaggacggccccgaggccactgtgggagggccgctcctgtcatcctccgaccccgaggtcatcagcgcagaagacgagtgcgccccgaggggccacttggacgaagaacgccccgggggtacggcccctaacgaggaggatcggccccgccgaaaggtgcagcggcctgtctactttgttagtgaggccctccgggacgccaagacccgatacccacaggcccagaagatgctttacgctattctgatggcctcaaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatgcccgaggccagcacgaacccctcacagctgcctcacgccgcccactgggtgatgcaattcgacggttctctgtctcttcagggcgccggtgcaggggtcacgttgacctctccgaacggagacgtcctcagatatttggtccgtctcgactttcgagcgactaacaatatggcagagtacgagggactccttgccggactcagagtggcggctggactggggatccgccgcctcttggtattaggcgactcccagctagtcgttaaccaggtctgtaaggagtaccggtgctctgacccacagatggacgcctacgtacgctaagtgcggcgtatggagcgccattttgacgggatagagcttcggcatgtgcccagacgggataatatgattgccgatgaactctcaaggctcgcgtcctcgcgagcccagaccccaccaggcgcctttgaagaaaggcttacccagccgtcggcgcgacccgaccccttaggggagacggatgcgcctgaccggcacccgaggcccgtcggagtccaggcctcgggacccgaagagagcgttccaagctcccttagattgattgcttggatctctgagatccaaacatacctcacagataagactctacctgaggaccgcgaagggagtgaacgcgtacaacgcatttccaaacgctatgtgctggtagaagggaccctctatcggcgcgcggctaatggaatcctcctgaagtgcattcctcaggaacaaggcgttgagcttcttgctgacatccatgagggcgagtgcggagcccattctgcctcgcgcaccctggttggcaaggcctttcgtcaaggattttattggccgacagctctcaatgacgcagtcgatctggtccggcgatgcagagcgtgtcagttccacgccaagcaaattcatcagccggcccaggccctgcagatcataccactgtcatggccatttgctgtctgggggcttgatatcctgggaccgttcaaacgggccccgggcgggtttgagtatctgtatgttgcgatcgacaagttcactaagtggcccgaggcttatccggttgtcaagatcgataagcactctgctcttaaatttattaagggcatcacggcccgttttggagtgcccaaccgtattattacggataatggcacccaattcactagtgagctcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcgaaccgaaccacaccaagccgagcgaccggggaaacgcctttcttcctcgtctacggcgcagaagcggttctcccatctgagctcaccctgaggtctcctcgggccaccatgtactgcgaggctgatcaagatcagcttcgtagagatgacctcgactacttggaagagcgaaggcggcgcgcggccctccgagctgcgcgctaccagcagagcctgcggcgctaccatcagcgccacgtccgggcccgatcactctgcgtcgacgacctcgtcctacgccgcgtccaaacgcgtgctggattgagcaaactctcaccaatgtgggagggtccgtatcgagtgatcggtgtcccccggccgggctcggtacggctggccacgggcgacggcacggagctgccaaacccatggaacatcgaacaccttcgtcgcttctacccctgaaggggggggtcgggtgtcaggttttggctcgggctaaccccgcaccccccctcgggtgtgcagggttagccgggggctaccacacatgcatatatattcctttcagcatttcaatagaagcagtttcaatttcctaaaggttgtgtctgtgccgttttttccttttgaagaatcttgacttgaaataatgtcactcgtgctcaaccttgccctcgggggctcggttcggtcggctaaaatcgccaaacggggcccagaaccgagccgtgccccggggcgtggtgaactccgggggggaatcggcaaaaacccacaatcgggtcacccatacccctcggtcaccacgttcccggcctggccagtctcgacatgcggatctccccaggcactagccccgacccgagccattcgaggaccgggacttgggcgcgagcccttattccaagctaagtcgcaaaaggaccatggcacagatcatcctcaactcatatatatagcaaaataaaactaacacaaaaatttttcatcatttctcattgcagattaagttaaaattgtacaaaaaagaggcatgaaggccttagaagaaagaacaagaaaaaagataagagtggcgggggcctgggggctcattcatatgcgcccgggtcgccggcctcgtcgccaccgccgtcctcgctgctggtgtcgccttcctcgtcggagctgggggcgaacgcaagccgaggggccgagccctcgaagccgttgacgatgtggtcagcagcatccccgacccgcgcgcgcgcctcgtcctcggtcccgggagggaactcctccagcgccatccatggggagaagttgggatcccgggcctggtaactcgccagcacgagttcgaccgccccccgggcgaggtccctcgaggatgccttaatggtcttctcgagctcctcggggagtcgctcgagaacccaagccatcctgttgaggtgcggtgcgaggccttccagattggtggggggcaccgtcgtctggcctccccagagcctgcttgccgaccggcgcgcttcatgcgggagaccgcgtcccaaagcatgccgggcccaatctcgcccgccaagcgaagggcctcggcctccccggtggaggagtccagcgcgcgctgcatgtcagcgacggtgtgttcggcagccgcgaggcgagcggctaagtcgctttcgcccgcagccgccccaccgatgcgcgcccccgcggccagctctttctcccgtgcctcgaggttagcagcccgctgctccagcgcggctctctcggcgcggacgctttcaaggttgcggcgcgcctgctcctcttgcgccgcctcgcggagggagaggctgtccgccagccgtcgcgtcgtggcctcggcctcctcgagagcccgctcccgctcggcgagtgcatcctcgcgaaggcggagcgcggactcctcctcggcgcaggcggcctcgtgcgccgccagcgtcgcctcccggagagcagtggtggcctcgcggtccatcaagcccctctccacggcgccggcatgttcttccagcgccatggcacgggcctcaagggcctcct

SEQ ID NO: 59622 - DNA, 8539 bp, Oryza sativa
ggcgtccaccgagcgccgcccctcctcgacacgcgcccatgcggcctcgagctccgctcgttccgctcgcaaggcctccacctgggcgctaaatccatctagcaccgcggtgtttgcggcggccaaggcctgcataatgggctcggcgctcactggggcgacgagagaagaggagaaagccgccttggagaaaaggcgacgcggctcggccccccggaggatgcgctgggctcggggatgtcccccgggcccgtttggtcctgggcgtcgcccggtgaggtaggcccaggcgacgcgcccgcggcctcgtcgcgagccgcctcggaggatgtcgcctgagggccgcccgagggagtgggcccgagtgacgcgccagcagcagctgccgcttcagcctggcgagcccgggcggcctcctcctgggcagcttcttcggcttggcgagcccgggcggcctcctcccgagcagcctcctccgcttggcgaacccgggcggcctcccgggcggcctcttcagcttcccgaaggcgggctgcggcttcacgccggtcagactcccgcctccgctcctctgcggccgctggatcttcgacctcggactggccggacttggggcggcgggaggaatgcgacgggacatcgctgaagcagaagaaaaaaaccaaaagacgaacaaaatgagtaagaaaaaacttctctttgggagaaaggtggtcgcaatgagaatgagacgaacctgcgagggggtcggttgaatgaccaccttggaggggaaattaggtttccccgggctggttccgtctcccccatcttgcggagccgcttcttcttgcgctccccctcgggctgtgacgtcggcgcagccccctccgggcgccgaccgctggtacgcactgccccgccccctcggggaggagatgggggaggtgttccttccagcttcctcttccccggggcgtcggcagggcggctgctccccgagcccccgacgcggggcccagaagcacgaccccctcctggggcagattttttccccgggcggctctcacccgcgccgtcgtggcccttaggggctctctcctctgaggccccgacccccagcataatggttagaatggagacgcggtcgggatcgatgcagagggggaggatctcctgaggaaggcgagacgcctccgcggagctaagattcagcaccctttggactacgatcttgaagtcctcaggagcccaatcccatctggctccctggtgggtccgcatgtagtcttcaggcccagtgtactcccaggcgctccgggcgcgccgttggagcggcgcaatccgccgacggaggtaatcgccgtacaccatggccccggtgagcccctgggatcgcaggcccgccaggcggtcgaggacggcgtcgtactcctcccccagatctgccggcgcccgccagctggagacctgcgccgggggctggcttggaaggcggaggcgcgcttcgtcggcgaggggggtgtagaaccagtcgctcttccagtcgtcccacttcttgcggaggacgcaggggatgtagcggttcaacaccggcccccgcggctggaagtagcagccgccaaccaccgatggcggtgacaccgactgcacggtgaagaaccaccggaacagctgaagagaggggcgcaccccaatgaacatctcgcacaggtgtgcgaagatggccaatgtcatcaccgcattgggggtgaggtgcgccatctggagatcgtagaactccaggacatccatgaagaaatgagaaaatggcgggaccagcccagccattgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggcagtacactgccgtcgagcagagcagagccccgtgccatggcggtggaggaagagatgattgggaacgagcgcgtgtggcgaaagtagggcgtggcagagaaagagttagagctcaggcagcgaaggcaagaggaacaatggcgaaaggaagggagcaagtccttttctcgatgcttttatacccttgccatcgctgggcctggctcctcgtttctcgcgcccactacctcgctccctcgtatctcgctatcttgctccctcgtttcccgtgcccacgcttccactaatcccattcgcccgcttacggcgcttgaagtggatatgcggttgtggcaatcgaaacggattgtatcgtgcgcgcgttaattacgctcgccaaccgaagcggcgttaccgtatctccgggcgagacaaatctgctcacccagattcgcgcgctgctcaagtgatgtggcagtcttgaatagaccgcccattatggacaaccaaagttaccaataccaatgtgcatggactgggaccgttggggattttgcccaactatgcagaccggtcccacctgtcaccaggctttaggagtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgaggggggggtcgggttgcgcttgccctggccccgagggccggggcaccccgaccccctttaggaagtctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacgcacgccatgccccatcccgtcaagacgaaagcctctagtcactcgtctcaagccggcgttaagcgtgttatctcttagagatgacacgttagacccggtcgatatatgccaggcttcatcttaaccattacaggcaagatgttgtgtgaagaagggcaaacatgcacgttgccaagattacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagaggggggttgattctttcccagataatgagcttagaacgggggagaagtcagctcacacttgtagctcattcatacgcagatccaccaaaacacaggagtagggtattacgcttctcagcggcccgaacctgtatagatcgtcggtgtctcgtgttttctggctggcatacgatttttccacatacagagagagtgagagcttgagatttcaccctaagccctcggccgaactggcaaaggggggcctgcgcggtctcccggtgaggagccacgagctccgtcaatgttttatcatctaataacaataacaatactaatcataaaagaacttcaaataaaatgaatgatcaaatgttggatatagaaactcatactactacgtcggcgtcgggggattttgtttccatgcggttcgtaagtggaaccgcacgggaaaatagggggaccggtgccggattatcgcccgcacgggaaaatacattttcctatgcgggcgtcttaatccgattcattatcccgtgcggttgatttaagaggaccgcacagaaaaatcgattttcgcgtgcgggctttttaagtggaccgcacaggaaaatatttttcctccctcctttccctcccacccacttaaaatttttacatatcctctctcctcctttttttccctttattctacctcaaccactcctctctctctaccttatctctattctccccctcctccctacacgctcgcgcaaggcggctgggagcggcgccgccctccccatgcccggatccagcggcggcagctgccccccacccggatccagcggcggtggcggtggggtgcccggaactagggttagggtttccattttgaaattttattttttttttggatttttattttcccgtgcgtgcaacataagcacccacacgtgaaaattggattttcgcgtgcggcccgcacaagaaaattgcgattttcccagacaatctgttctagacgggcgaatctaccgcactcaaaaatcaaaacaaccgtgcgcaaaaataattattgtagtagtgtcataaatacagttaaaatgggaaggagagagtagtttttttggttgggttgtcctagtgggcaataaattaattttcagataattttttaatgttttaagacaactcatctttcagataaaggtagtagcgtagagttcaaagaatgacttttttcataacaaaatgaatatgtatactatttttgaactttaaaagttacaaacatagtggtaattggaaagtttctacgtacctttaatgacccataataagaacgatgagtaataaatctacacacactagcactacaatgttgatatcgtaaataatgaagtatgtggacttttgttcctctccaaaccgaagccatcaaataatgaaaaaataaaatcataatgaggtacaagataatgacaaatataacatggaaattttataacgagaatgatttttttttattttttgaggctttaaagtgtatggtggggattaacttttttttaattcccattgcaatgtgcatgtattcagctgatattactagtatgataatagcatcagatgtaggggtggcaattttcccagtggggctgggaaacaggggcggggatgggtgctgatttcgactcgcggggagtcggggtcgggggcccggccatgggcggggacgggggcggggtaggatagccacctacgagtgacccgtggagccctgagggtgtatattagactattaatactaccatattgcaagcccaaaaaacctacgtagcctaccatgtataaaccaaaccctaatttccccatcttctaccctatccttttctcacccacccagccgtcactctccaccaccacttgcgcttcctccggcggtggccaggctacggcgtcggcggccaaggagcgagcgatgctgtcagtggccaagtcgcgggcggcggcggcgaccaaggtgcgggtgacggcggtgacgacgaccatggtgcaggcgacagcttcggcgaccaaggtgtgggcggctacgacggcgaaggagcttgtagtgatggcatcgtcaacggctaggggcatggccaaccgcgtcggcgtcgacatgcggttcatacgcagcggcggcggcgccatttccggcatttctcctcatctcgtggccacctcgtcgctgtttgccgtcggtggtgcggggccccgctcacccacgggtcccctatggggactaggacgggtgatgtttcccacctgaccacctctatggggccggagctagggccggagtgagaaatcggggagcgggggcaggggcattctagctcaacccgcccctgacccgccctgttgccattcctaatcagatggatagtttatcagtgtatgaagtaaattatggagagggaatttttttaatgccccttcacatggaggagctagctccttttcttttaagaccaaagatacataggtctaaaggctatgtttggcggtccctcttcctatcttctatccagtttagctaaacacactttgtaattttatgaaacataattaagagaggattagggataggactagtaggactacccgccacgcatgagacatgatatagagtcggtctaacgaaaagtattaactttattagacagtatttgggtcggaccagatcttttttatacttgggtgcaccgcgcaagtgcaggacctttacctggctgatactccaaaacagagtgtggacatcagatagactagcaaccagaggctggcccaatggatccacatgccctttatgtcgccagactcaagagacagctctctacctgctagcattctagcataatgtagatacacaaggagaatctggaatgaaattacgcagtggacattcaatgaccacctaagaccttctagctggtaaataattttaacggtacatgagtggtgggaggccaccgtaagcatacgggaagcatctaagaagacactacgcacgttaaccttacttgttaactgggagatatggaacgaaaggaaccagatgactttccaacataaggaattatcgacgccaactctgctagccaaaataaaggaggaagcaaaaatatggtggctggcaggcgcaaaaaatctcactgcctggttgacaatataattgcctgtagttagggccgtggccctggttttgttttttttttacattctcatttttgtacagtttcatctcctctattcaatgaaattggtggcctcgttgattcgatcgaaagaaaatatgcgccggcccttacttgaatgcaacttaaatgttacgaaaaaaggggaaaagagactattttacatatatcggtgctgttcgtttccactacaagaagtgaataaagttttggatttttgtggcacgcttttcaaactgttaaacgatatgtttcgtgcgaaaactttctatatgaaagttgttctagaataccagattaatctattttttaagtttatataataattaaaacttaattaatcacatgttattaccacctcgttttacatgaaacacttgatcttcatcttcaggagattcaaacaccagcatcatgtgatataatctggatacaaacaatattagactcgatctacgtgtatactgtatgttctaaaaataacgtttatattgtgttattaaaaaatcgttctacaattggagaaaccataatgaaagaaaaaataaagcaacgaattgaattgtgcccgcacaacatgaatatatatatttttctccagtttaaacgtgcatgtttgtttgtgtagtaacttatcggtccaatcactaaatatatttttggtgtcagcgctcttaaaaaacttatcggttggattgtttcactatagctaattatacataaaccgtaacacacttattagcaatacaaaataatttataaataataataaataattaacggatactatacactggtggagaaaccatttttggtcggtccaccaaattccactatagtctcggttgcaataaaaaccgggactaaagatcatttttagtcccggttcaaaaaatggtaggtgatgtcagacccctctaatatctttagtcctggttggtgttaccaaccgggaaaaagatgggcatgcacagagagatcgaggcgtgcgcgtgaatcggatcgagatacatgtctcatcctccctcccggttctatctcctcctctcctcacaccctatctcttcttctcctcccccttctcctctcctccccattctcctctcctccgagatccccttctcctcgccatcttacgcgcggaggatcctctccgcctccccctcccctcctcctccccgatctgcaggcggcggcgcacgacggccggtggaaggtggcggccgggcggtaggtggaagaggcggcttgcgcggcggcgggcgacgcgccagatttgttttgttttgtttttgtttttgagaatttgtgatccggatctgagatgtatttgatttgtgtgtggtgtgaatatgtgatgaattttgtagaagttgtgatgtaattttttttaagattttatgatgtatttggggatgatcgatttgaggatttggaggtgttagttgatttgagattttgggaatggggatggagtgaaatcaatatattaaaaacaatgaagaaaataatagaataaagaagcaactgggtatcagtctggctctatctttagtcatggttggtaacaccaaccgggactaaaaagtctctatctatagtcccggactaaaaatagatttttactcccggttatttcacctgggactaaagataacgatctttagtcccggatttgtagtcccgtttggaaaaccgggactaaagggggttacgaaccgggagtaaaaactacttctccaccagtgaaatatattaatatatgcatttcacttgtggagaaatcatttttggtcggtcaaacagatttcataatagtcccagttgtattaaaaaccgggactaaaaacatctttaatcccagtttaaaacatctttagtaccggttggtgttaccaaccgagactaaagatcccga

SEQ ID NO: 59623 - DNA, 3159 bp, Oryza sativa
agggcttgcgcgcgggcggctgctacgagggcgtgaggcggccacgcgcggagcttcgacgcggcggcaagggcgtgcacggcggcggccgcagcgagggcgagggcgagcgcgagcgcgcggcggcggcggcggctgcgagggcgggcaggctcctcactggccctggcagcggctactgttgttgctcccgtggccgctggcttccacgctgactcgccgaggcgtcgtcgtcgtccgcctccgcttccacgcaggagttcaagctctccccgacctctgccctctcccctgccgcgagtacgccgccatcgagaggtccgtacggccacttccccacaccgcgcctcctcgtactacgcagccggcgacgaccccatcctgctcgacatcgatggcgacgacaacgcgtgcttgtgtccacttggttgcaacatttatgtcctccatctgcaccatgactcactttgtatttctcatgattgttaaatgctgatgctcaagttataactgatgaactgatgaactctgtttttcgtaactgatgagcttcttcgtcatgaaattcttcagtagcaactttccggacctatcgaaattttgttcaaattttggtcaaattttgtacttggctagtatttgttatttttttgttgaaaaacatcacaagggatgctcatatttgaattatttataacaatcatacaaactgaaatcacacggtagggacaaaaataaaaatgcaataaccaccaagaatataaatgtccttttgctctacaactaacaccgttaaaccgactattagaagtgggggtagccagcagtttcagattcaaaaagtgagggtaaaattgcaaaccctaaaaagtgagggtaaaacaacaattgggtttgaaagtgggggcatagatgcaattgtcactatattaaaacaatgaagaaaagaaaagaataaggaagcaaccatatcttgcctctgggactaaaaaggctctatctttagtacggttggtgttatcaaccggaactaaaaatggatttttactcccggttacttcacctggattcgtagtcccagttgaaaaactggaactatagggggttactatccgggagtaaaaaccatttctccaccagtgtttttagtgactgaataaccaatataaaaataaagtataataaaattattataagatattagaatcaaaatttaaaatttaatcatcgtagtcattcttatgaaattttgctatttttttctccaactattggttggatcgcgtgcatatgcgcaggtgcatatacgcaccttggtgtaaaaaatgccttggcgtttggatcctgtgtccactgtccacagatgagtactgtagatcggccacgtgaaggcaaggggatcgatgatggtgtcagactatcagtacaagtctagtactattagtattttgattagcgcctttggggaacattatcttgaattgagagctactagtaagcaaagtactatatattagggcaaataggcaaataatgcacatggcataatgcaaaagaaaattttgtccctttgatcgaaggggaaaaaatagtatggttatttaagcaagcttaatactgtagtcaaccactacctacaaatcatatataaccaatctaataacatatttattaatagttatttataaatgtatactataccactaatatttggtctaccttttacgcacacaatgtcttagaacatgtgttatagttggctataaattctcttcctcttatatttttatatgtgtttatagcgggtttatagtttgctattctatttgctctcaatgaactaaactggtagtacaactacctattcccaccagtattaaattagtaaagcaggaaaaaaacaatttaaatggtctcatctcacaacagtagcaccactgcaccaatacctcgacaccaagcgcgtaccggaaagaacctcaaacagtggacctagaagttagtaacaccattggtgcacccagaacaccaaaagcacctaattaactacttaacaaaagaaaaaagaattccatcgcactagctacagttcaattttatgtcaactccgtttaaactttgtctcctttactatcttctctctccctaaaccgtcttaaaaaagtctctctctccctgtgtcacccctcgcgcgggtgacttggggcaaaccctaaccgtcgccgccgcctgcactcccaccccctctatgccttgctgccgccggagaaccgtgcgaggagctgagatggcagtagggccaaaacgcggcgctgcactatctccgacacgagggagacagaacgacgtgcagcgagccggtagccacaggggacgctcgccggcaaggaagggcggggatctacatcgctgtggccggatcagggccgtaaggcgcgacaggcggcgacgcaaagagctgcggcgcgggcgagcggtgtgtcccaccggcagggcagagggtgagcagtggcgggcggtggcgcagagggctgtggcgcgagcggtggagtccaagtggcggggcagagggtgtgcggtagcaggaggcggcggggagggctgctacacgggcgacggcgcggcgagtgcaggtggcggggcacttggcgcgtggagtgtgtgaagcagccgaaggtcacggatccggcgtccctgcccgccacggagaagagccggcaacaacgggcgcccggtgcgactgtgcgagggatgacgccgcactcgtaatgtgtccagtgcagtgcatggtggagggtatcaataggtattagctagtaccaactggcaccgatggggtaccagatctggtactgacgagcgttagacctggtatgaatatgtatcaggattgatatcttctcttcatcccaaataaattaaatcgtgtacaaaagttggtatttttgatagaggaagtgtatattacattcgtatctcgtagggtaggtataagatcggacaccaatgtgtatcatattctgtgaactccaccatataccattgatacagataatgtttggttgctacttctatttgctaacagttcgaagagctaaaaatatgaaaattacactatctgtttccattctttaatttcagcagcagcatatgtactca

SEQ ID NO: 59624 - DNA, 3977 bp, Oryza sativa
tcgcgacgacggtgggctcgtaccttcggaggaaagaagggcggcgcgagcgcgacgacgccgtgagtagcacgacgacggcgacggcgagcgccgccgtgagggacaaggcggcgcggctagcgaacaggagcatcttcattatcggcgatggccagcaacgtggtacagattacagaagcaaaaccaagcagctttaagctagcagcagcagcagcagcagcattgcagcaatggcgtctgcgccgcgggtgagcaaagggggtgaaactgagactcgtgctgcggagctagctgagagttgagtgggagtaaaagatacttccgtagagatggatggagcaggtcatgtcgttgctgcatcttcactcttgtcgcattgtggccattggttcctgggggcagttgagttgggtgcatgtgagtgtactgggcgtgtttcacggctacactgtgacggtaaagctttcatggtaaaaagttagatcggaaatgactcaaagtcatgattagattgatggtcaagtgagtattatagtagagtaaattgtatttgttaggtgagtgtaatttagtgcataaacttgtaaaatactcgttttagtgtatgaaattgtatggtgcatgtggaggaaggcggaaaggacactacatggctaatcttattgatttagaagcagattaggatactatgtaaacatatatctgagaagattgctattagacatacacctctttagtaaaaatagaatataatatagtgatagtagaaaaagattaaaaaatccgagcaatgatgtaagggttagaaatatatgaaattcatcatttccacgatgaaggataaagtagagaccaaatttataaatattgcatttcttatgcataatcactacacgtacacacgtcacatcctaatcaacatcagctttgtaaaattaacattactaagttattttggtcttcgttcgtacgaactagacaagttcgtgtactgaaacgagcattttacaagtttatatactaaattacacctatctaacaagtttgtgtaccgccaatacaatttactcagtatagtacctccgttttctaatacacgatgtcgttaacttttgagcatatgtctgaccattcgacttattccaaaaaattatgtaaatgtataagatataagtatgcttattataattacataattctttttaatatgacaaatggtaaaacgtgtgacaaattcaatggcattatctattaaaaaaaggagatagtataggctttcatcgtttccttttttttctttccgaaaacattagggaattacctccatttcattaaaaagaaaagaaaagaaaatcgaaagtagggaaagtactacctctgtcccataataattgtatttttgtaggattcaaatttgtctcaaaataattttcacaatagagtactaattgttctatcaatcacttttcattcaaatttcttcctattatatcctcaaaaaccctcctacttttatctatacaccgattaatgatggacatcatagtctcacttttcaaaccttaatatattccgaaattataattattttgggacgggtagtactgaacgtcatctaacaaacatgggtcgttcgatttcgattccggatgatgcaaaccatccgatccttcaactgatgaaaccttctcgtgatccttcacgaaacttcttttttcaaggaagtccttccacgtccctgctaggggaaaaaaaatcgcattttgtcgttcacggtgttgctagctaggctgcgacccctcctctccttgcaggcgccacgccgcctttccatcccgggcgccactgcaccgccgtctccacatccctggagccccgccaccgtatcctctccaaccccatcccctcatcctcctccacccctgccacagcctcctcctccccatccccactgtcgtttcctcgccatccccatcgatgtcttctcttccccatcttcagtggcactaccatgacctcctcctatccatctccgacagaagctgcagatctggtgtccttccatcttctttgctccctattcctcgcaatggggaaggtcaacacctctgcctcctttcgtgctggtgactccaatgcttctacctgtctccatccctaattcgccactaggaggcacggtgaagcaaagacaaaagggagacgcggaggggaatatggcggcagattgggaggggagatggtcatatggagatggaggcggaaagggcctcttcgtcacgtatagcaacttgtgcttccactccgcttccacttacggcctccgcctgaccgtgagtacattttatagaacttgtctagcctcatgttcaactttggtggataaccatattttgttcatctgaggtgcggcggccgccggcgttaggcccatgggggcgggagtggaggaggccacgcctctccacgtcgtccttatctgcgccggcgagaggagggagcagaggggagatatagagagaggggaagaagaggaagggattgagaatgacaggtggggcccacgttgaccccaccatttttttattattgtgtgtgaaactgacatgtgggtcccataagttttattattttttggatcgaattgccatgtaagcgccacgtcagatgaagaccgagtcaaattagccacacgtaggcgctacgtcagctaaaacctccatccagaccgccatgggacctatagtgcaccgggtttgacagttgagggacccattgtatctggtttttcggtggaaggatgaaaatcggattcgttgacaatttaagggacctcaaatgaacttattcctaactccttatcattgcaatcaatcattgattgatgcttatacaaaacatttcagtaaagggccatgttgaactggtgataattccataaattatacaaattgaataggctgccacatttccaaattaaatggtaatctaatttatttcctcggttaattaatttcaggtataccgtagcaacgatgttttagtgctgctgtaaagaatataacaatggacataactgtagttggtgcaactggaggatagaataaattaacatgaagtttcaactagagttgcagttagtaacataggagtattatgttaattgcctcattacttttggagaggttcataccaatttagtttgtttttatactatttctgaatcaatggtttgttctattaacatgttgtaacctcggaataattcctttcatggacggtcaccaccatagtctttgtctctattgtgctagtactgatttctacgaaagaacagtcaaggggcctgtttgggggagttagctgttgtagcttcttccagaatcagaagctccccccaaacagtcatcttttggtctaaattttgagaatctgtagttatagaatccataaaataaactagaagcctttctagattctcagaagctggctaccagtcagctgcttcttagaatcttaagctctcccaaacaggcccaaggtctcattcccagctgcttaattcgattgtgtcatgtctcttatcatccttccctgtctatggatttggattttagcctttcaaatatatatgcacattataaattctaacgtttgctaacttctcctttatttcataagcccaaaagaccaaaatgatttggctccatgattgcctagagagttactctaagttctttaccatctattagatgtacacaactcaacatttaagcttagaacatactatatgccttattctgcattggcatcggaaaagaaatgttgtactctttgtatcagcactacagatacaatttgttgagtttggatttgcaatgttggctgtgtttagttccctttaaactttaaactttcagtcacatcaaatgtttggacacaacatggagtattaaatatagatgaaaaaaacc

SEQ ID NO: 59625 - DNA, 716 bp, Oryza sativa
atgaaacagggcccaaaatgagtagttttagcctttttctttaatttcttgaatacatatacgaggtatagagtacatatacttattttttttgtctaaaaatcttgggtatacgtctgaatacccttgaatcaatagtgggcccgcccctgttatgatccaattgccagggcatcatcttcaacctcaggattaggggaagcatcttcaacctcgggatgagggggaagggagagagggtagctcaccggagggacgtcgacttattattccaccggcggggaactctccctcctctttggcgccggtgacgacagccatagatttaccgaaccaaaacaaaaacctagatttgggttcgggggcggcgaggcggcggtggacggagccgcggggttggaggagggaggtgagagggttctgcggcgtaggttcctagaggagtgagtagaaggcggcgatgccggtggcgtctccggtggcaggaggaagcccagaaagccgcgagcaaagcttcgatggcggatgccgcgacgcgaggaagaaagaagacgactaatggtttgcctgcacgaatcaaagaccctactggtatttggttgatttgtatacgcctagaaacttatagtcacattaaatttacacctctgtgctataaaaatattatatcctaactgcgaatcttgatgcatgcatgtcgaggttcatacccagaa

SEQ ID NO: 59626 - DNA, 2040 bp, Oryza sativa
ctatatagcaatctttgttttccaagtctacatgctatagttgttttagcttaatgttttacacctatatatttgtcctcaaaaaataaaaaatattatgttattagtgtaaaattggacttatccagatatgttatatttttatacatattttaaaaatgaaagctcacgttttatggtcagagttacagaaaatcacatgtgttatgaattgtaacacgtaaccacgggttttatagtctaaatgttttataaaaccaacacactctatgttttgtgaaacttttgaaccataatagatggggtcaggtggcactaatcgtaataccgggtttttatgcaattaaccacaaaacatcaggtattttgaaatttgctcaatatatttttaagacatccatggtcaaatttaatcttgaagacttttcaaaattaaatactctaataatccagatagaaaataaaattatacataactatacatacataacgcttggactatatttgcattagtcactagtggggtgtggtggtgagttatgcatggattaacctagtatatgtattgcactttccatagaaatttagtggctttagagatttactgttggtattcatctatatgagtatgtgttagatggtacatccatgtaatcggagaaaaaaaaattaagaaacgtatacgacgctgggttggggaatatcgtgtgatagggaaaaataagatttagacataaaggatgttggataacacgtgttaggggaaaatggatttagacataaaagatgctggatacagaagagaggagccaaatagccaatgtgcttgtctgcatgtgtgttgacagacgctttgtgtaatttggaaaaaaaaatatgtacacgacgacactgatctgactagataaaatcggtatcatttcgggttaggagggccgtaaatcggacgacaaccatgggtgtggctgatcggcgaccagccgcgcgggcctgcacccgcgcggtcagtcctgcctgtcagtccattagtacaacaactactgctacaatactactaatactaatactactatcactacattattatttctacctgtaatactagtactattataattgtttttatatgtatatatacacatatacaaagtttatatatgatgtatacaaaatttatatacatgtatacaaactttgtatacgtgtatttttggtttttttatatacgtgtatgtataaaaataaaaaaatacacacatatataaactttgtatacgtgtatacaaagtttgtatatattatatatgcatatacaaaagttttaggtttttatttacgtgtatgtataaaaataaaaaaaatatacatatataaactttgtatacacgtatacaaagtttgtatatacccgtatacaaactttatatagacgtatataaagtttgtataggtgtatacaaagtttgtaaacgtatgtataaaacaaaaataactgaaaaagatacgaaaagaaaaaaacagaaaaaacaaaaaaaaagaaagaaaaaaacagaaaaaagaaaaaagaaaccgtccaaaaaaaattgggccaattccctacatgcccatgtaatttcacccagtcccttctacgcccctgaaatttgtttgatctcttatatacccctgagtttttattccgatcccttatatacccattccgttagttgaccattaatttgaccgttagtaattgtagaaattaatttattgtccttggtatattgttaaaagctagaaatgttttatgtgtaaattatttgtgatgtgaaaatcaataaggaataaattactaaatatttgttatgaatttttaaaaataaaacattatttcattaaaataaaaaagatttattgtaaaaaaagttctgcataaaatttgaaaattacttttcaacaaatatttagtgaaaaaagattcgttgtgaaaaaacaaagggggtgtaattagtttatcacaaattagaaaacaaattaaaaaattttaaataaatttcagat

SEQ ID NO: 59627 - DNA, 11590 bp, Oryza sativa
taaccaaaatattttggtactacatttttttttcttacatattttttcatcaggatcaatccgcgaaaagaaatgtaatcttttcgcacaaagtacaggattaattaatccgcgtaaattgtgatcttttgtatacaaagtacaggatgaatccgtgtacgaatggtgatattttgtacatagtacaggattaatgtgcgttaaaatttcgatccttttgcacaaagtacaggatgaatccgcttaaaattaaattgtgatgttttttttttttgaaggtggagtacccgaaggacgtgtcgaagacgacggatccggggttcaggacgatgcactacgggtcccacaacttcaccatcgccgtcttctggtcgccgtacctcgtgacggcgaaccagtcgtcggaccccgccgccggagggctgtgggacctctacctcgacgagccggacgccgcctgggcggtcgccgtggcgggcttcgactacgccgtcgtctccgcggcgaactggttcacccgcccgtccatgttccacgagcgcggccgcctcgtcggctgccactactgcctcgtcccgggcgtccccgacctcacgctccgctactccctccgcgccgcgttccgcaccgcgctgcgcgcgctcgccgccggcgccggcggcgccggcgtgttcaacggcacggcgatcgttcgcacgctgtcgccgacgtcgcacttcgagggcggggagtggaacaagggcggcgactgccggcgcacgcggccgtccacggcgaacgagacgcggatgtccgggctggacctcgacttccacacggcgcaggtggaggagttcaggagggcggccatggcgagcgggcggagcgcggcgaggctgctgctgatggacacgacggcggcgatggtgctccggccggacgggcacccgagcagatacgggcactgggcgcacgagaaggtgacgctgtacaacgactgcgtgcactggtgcctccctggacccatcgacgtgtggaacgagatgctgctccagatgctgctgctccatcaaccaggagctgtttctgtttgatctttgtagtttgttcttgactactacttgttgattggattaaagaataggttcagttcaccatttcgaccatcaattttacaagtgctcgagtgcacaatgtgtagaattccactctgatcacttatgtgcctaatgacgtatcaacaattgcagttttcaagctttaacaatcgagtaattagccaatcatctcagcttcatactgccgccgggctggataggtaaggttcacatttttagttttagcacaagtggatcaagttgggatatgtgcgcaatccgggaagtgggtttcttgtgtcatcatcaaaattctctgcatacggctttaacggggaaactgttttaaaccttaagggtgtgtttggataatgagttacgagaggtgggattggaaaatggaaatgaatggaggaacatgatgaaatggagtgagaagaatggatagctaaaattgaaacttatcctttcaaggatgggaaatcatatcccaaacctattatccaaacatggctcccatcatttgtctgcaaaccatttaaatagttatgaaaatagaaaaaaatggcaacattcatatatcatatatagcactgtacaaaagtttaggtccaaacttaactcatgcaatgagatataaaaaagataaattcggataggaatagtagtggtagtattcatatcctaatatgtcatttttgtttctcaatgtgtatatcaaatttgttaacttgatttttggtgcagtgctatatgttactatactctacattatcaaattttttataactatttacattgaatttggaagaaaagatacacgaggggacatcctcttgagggaccacccaaaaaaatactatcctaaatatcaattatctatgcagaagaaaatatatatccctccatgaaacataaaaggacaaattcgtcctacatacgcgtatacgaagatagcagaatagcaagtttaaccacgagtgaggatgcacttttttttttgtctgatctgttatttttatccctctacgtgtaaattaaatttggcgttttgtatttgtggagggacatgtaacacgacaagcaatattatcataaggttttcagaatttgttcgaactatttagaatgtttgcaacaacgagcacgcaagtttttcagaattttttttacttgaaatcatttcatgcatgaagatttaaaacattttttcttgaaaatggcctccccctaaccgaactggatagctacggagcacgccgataataacatttgggtttcatggcaagtggatgaaagtaggatatgatgcacaattcgcttcccagtcaccttccaaatactctggatattcatgacctaatgagcaattgtatgtgcagtgcaaggagctgagaactaactgcaacgcacaaatatatatacacctgaatggactctactattgcaagtgtttcacacacaattcttgagatagatatagattcttagtttcctcccagtgccaatgacgcctcttaataatctctgcaattttcgtgtcaagaagcagtactacaaccccaggtgcttgatccccgccgtctctctcctcctattcgtcgtcatcctcaccgtctctaatacatacttccccttcccgacaactaagtcgcgaacactgtcttactcttccttctcctcctcccccggtgggcagaaggccgccgacgaggcctgcaacatatttaggggagagtgggttccggatcctgatgcaccttactacaccaacaacacctgctcggtcatccacgagcactatgactgtatgaagtacggaaagccggaccttggcttcgtgcagtggcggtggcgtcccgacagttgtgatctcccccgtctcgacccggcgcgcttcctctcctccatgagggggaagaccttggccttcattggggattcccttgccaggaaccacatgaactccctcatctgtctactgaccagggtaaaaaagtgaaaaacgtgccggatttgctacagtactagcttcgatctgacccgtcgatcgcttgatcggacggtcagaaatgggccagcagcaacaagggtgtgacgttttgttggccggcctgcaggtcgccgagccgacgacgagctggccgagcagcgagcacacggtgtaccactacggcggcggctacaacttcaccgtcctcagcttctgggcgccgttcctggtccagaacgagctcgtcgacgccgacgggccggcgcacacgggcctgtggaacctctacctcgacgagcccgacgcagtgtgggcgccgcacgtcccggcgttcgactacgccgtcgtgtcggcgtcgagctggttctaccggccgtcgatgctgtacgaggccggccggctcgtgggctgccaccactgcctcctccccaacgtcaccgacctcacgctgcggtacgcgctccgcatggccacccgcgccgcgctccgcgccgtggtgggcggcggcggcggcggcggcgtgaccgccgtgcttcggaccgtgtcgccgtcgcagtacgagggcggggagtggaacaaggacgggaactgcgtccggacgcggccgtaccggcgcggcgagaagacgctgcagggcgtcgagctcgacttccacacgctgcaggttaatttcttgatttttctccattgatctagtgatcaattatcttgttctttctagggaacgtgtgttctgagcttcgtaggtggaggagttcgaggcggcgaagagggcggcgagcggcggtggggcgaggatgatgctgatggacacgacggaggcgatgatactgcgggcggacgcgcacccgagcaggtacaggggatggacgcgtcgcaagggatggatgaaggagtacttcaccatctccaacgactgcgtgcactggtgcgtccccggcgccgtcgacgcctggaacgacatgctctcacacatgttgctcacatcgcaaagctagttagttaggttattgatcaaacgaacgtagcagccgaaaaaaacagagaaaaatacattcactcctgaattcagtctagaatttcaaaaccaccgtccatgatccatgtgaatttctagcaaattgcacgagctgaactcaaacattttggtcctgtttgctgcattcgcaaagggttattgtgattccgtctgtatggacctaaatcgacctgaggcccaatattgcgaaaaatttcagaacaaacatcgtaatcgatttgagatactatattgatattttgtgacaaatctggaagaattaggaataatctagccgattcaaaagcagtggttgaactcaagttggctgatctcgacatgcagtcaaaagattatcagacagaaagggaaagctgctgctaggctagctcatacaggtggccagtgcccctggtctcaaaccaccacacctgtttagcacttcgattctttccatttcgccaagacctagtaataaacaggtggttatctcaaactacacgcgtggaatccaccatcccaagtgtacgctgaatgctaatttatcacgtaatctaatgaatattcgtgacaaaaactgcagaaaaaattcgatgtatatacagcaatctcatctcatttcatatccatgagctaagctaagctgtagtgtggacgttgaccaaccaggtcgatgatgaagtttcacgaggtgatcaagctgccatccattgctcattacggcctacgctatgtgcttcccgccgccgccgtcgccgcgtgcgttctggtgctcgccaccgtcagcctacccggccgcgtgccgctgccgctgctgctggcgccggaggtgatgacgaagacggcggatggcgtcggcggcgacacgtctggctgtgacatcttcaagggcgagtgggtgccggacatggccggcgagccgccgccgtacaccagcgagagctgtccggtgatccatggacactatgattgcatgcggtacggacggccggatcttgggtacgtccggtggcggtggcggccggacggcgggtgcgagctgctgcggttcgacgcggcgaggtttctcgccgcgatgaggggcaggtcggtggcgttcgtcggggactcgctggcgaggaaccagagcactcgctggtgtgcctcctgtcgcacgccgagcggccggcgccgtggacgaacggcagctacgcgtaccgcttcgagcggcacggcctcaccgtcacggcgttctggtcgccgttcctcgtccgcgccgtcgagacggaccccgacggcccgacggggagcggctccggcctgtggagcctccacctcgacgagcccgacgccgggtgggcggcgcacgtcggcgcgttcgactacgtcgtcgtctccgccgggagctggttctaccggccgtcgatgttctacgaccgccgcggccgcctcgtcgggtgcaacacctgcctgtccccgaacgtcaccgacctcaccctccgttactccctccggatggcgttccggagcgcgctccgggcggcggcgacgggctcgcaccgccacgccacgaggaggacggtgatcgtgcggacgatctcgccgtcgcactacgagaacgggacgtggaacggggacggggactgcctccggactcggccggcgcggcgcggcgagtgggagttgaacgccatggagaaggacatgcaccggatacaggtcgaggagttcgcggcggcggcggaggagacggcggggaagagggggaaagaggcggcgaggatgctgctgatggacgcgacggaggccatggcgcagcggccggacggccacccgagcaagtacaggctgtggcagccggacaagttcaaggtgtcgcgggactgcgtgcactggtgccttcccggcgccatggacgcctgcaacgacatgctgttccacatgctcatcgggtgatggctgatgcccgttcttctcattatggctcgtcgatttttttttctttaaaaaaatacatcagcattgtttagatagcttgggagcctgctattgatgggatgtctgatttttttcaaatcattggaaagtattgcaccgtgttattgatgttcacatgtttcacccttcgataaaaattgttgcaacaaaagtgttctagatgtttcacaataagagaaatgtttccgcactagagcatagttgtttcaactaaatacactactaaaacatatcgattgcaacaccaagaaatcaatgtatacaatattgaatcaaaacgaaataaaacaccttaatacaatcaagtaaaaaaaatacaaataaaccgtaacatcactttaattcacaataaaacccactcctctgacttctattccggccaccgaaaccaagcagctggcatgaggagacaagtgacatgatgcgtagacgaggatgagggcaagcaacgacttcaggtgagcgaccccaccagggctagctgcatcggcatccagtccagcgcctccttcttcgcatggcactgcttcgccacgggtagagggctagcacctcttccggtcctcgctttcgcctcagcatgccacgccaccgccagcgtggtcaccggcgccgtccttcctcttcgcatcgcgctgccccgtcgccacccgcgtggccaccggtgacctcctcccacttaatgtctcggtgggtgcggcgacgatggtgatgtcatcatgtgtttcctatgagcacaaaaacaatgaggagaaaatgagacgataaggttgtggtggattcaatcaactgcggtccccaccttatttgaccgtccgatgtttggtctcgcatcgaacgctctgggatcagcatttctggataacttgctctaaattatttgttagcttgaattcattcctataagcaagtgtctttactctgtccaatcatccatttcatacttgttgatggttagaaggtttgctgttagaaaatatcaatgcctacttctaatttaattgcaaataagttagcaattatgctttataacgatggcagatcgaaagatttatccttttagtggccgaggtgcatccttcgaaacaactagcgtacacctaagccctccctgaaaataggttttggttttgtaaggcattttctcccaactaatcggcgaccttgtcgagactaagaggcacttggcacttgagatccatcatcaaattgcagtaattattcccgcataaaaatgctatgttctgagcttggctaagcataaacctaaaatatctactaagcactagatatataactttcactagctgattttgtttacctagggttgtcaaggataaacatggatataaataataagaccataaatgtaggaatgactaataaaacagttaaatgcgtcgggaatttaattaagccgtgcaataatttaaaccatgacagttttcacatactgggatttaatattctcaaggaaagcagtatggtttgccttgctcaacaagaaggtatttctgatgtcttgatatgcactttcaggatcctttgaaactataggaactacacgagacacacaaaatgtggctaaaggtgtatccaagaagcaagattagtctataaaaatacaaatgggttcttcacgatttaaccaaaatattagtgacttgaacgggctgattcagagttcagataggtaacttgaactggatgtatattggttcctctcctttcatcattaattagcatatagtagatatgtacaaggaactattcatttatctgttttcttgattctttagggtagtgctatgggagaatgtagtaccttctagccggggcaggcgtgcaacctgatgtgcccatctcatttattcactgtctactattgctcttgttcagagtaccatacttcgagtttcctcactccaattgattatatatgaaaaatacaatggtagggttaaagatggtagcaaaatgaacatgccttgagtctcttgaataaataacttactattgatcaatgagtgacattcgtgcaactaaggctgtcaacgagctgagctcgagcgaatttggctacgtaggcttgagcttgacatgaactcgagccgagctcgagccaagcctggatactgatcgagcttgggagtgagctcgagttcgagctcgagcgagcttcgagcctactcgagcttgacagcttgtcttggtgaaactccaaaaaacttacacttgtataagagatattaatgcaaattatcggtagtcaaaattaatgggtgctacttatcttgaataaagcctctgcagcttttctcatgaattcatggctttaaaacgttgcaattaacaaaagctagctactacatctaataggaatagtagtactattactagcagccggataattgctttattgagaagcatcgatgaggtcttgagacttgagtaggtcaagcacgatgacaagtatacatggacccatcaagaatatcttcctacatgcaatacatcttatgctaatcaagccttgccgagctattcgagctcgagcttgctaggcttgcgagcctcagcctaggcttgagcttggcttgtctagtatttgagccgagctcgaatcaagcctgtaacgaatcaagctcgagcagcttgcgagcttcgagcttttttgatagccctacttgcaactattcgtgagacaacagacaatgtgttttatacagtttatgccccttagatgggtaatgactatatgtcctatttggccggagtcaagtgtttttcactatatcaattacatgagtacaaggtatgcaatggaaccctaatctagcctatgactatatcggcgagaatgatggtggtggtcggcaactagttgttgtcgagtttccattaatgtttactatggtggtggtggaattgccacacctactagttatgtgtagactagcgatatagtcagatcctagctataatgttgatgatagaaccaccacgtctactggtttatgtagacgatgaacatagtcgtaccctgaccactgttttgttgtttaggctgaaagttttatatgcatcccattgtttatccaacccttaaatcattatggaggtgtatcggtctatggtttgtttcaagcttttttttttctccaaaacatctttccaaccagactgcttgtaatgcacgtatatctctatgtttgttcaacggtatgcttggtattgtcgctatttgagatctctgcctatgtcatcatggtagatgttacaggcagtgcatcgggttctccgcttgatagcgaatcacctccttcgtccttgtcctgattcccgagtcgcttgaggccattcacaatgcgtcatgggccacgaacgaatttgtgatgccacataggaccaagctcctctaaagcaactcacctcacaatgcaactcccactcccacccacttttcatgggtcccactcccacacacttttcatctccccccctctctctctctccactatctcccccaccggcggaggatgggaggagcacccgaggctcacgtgctcgccgccgccgccgccgccgccgccgccgcgccccacctcttcgtccgccggtgcccctctccctccctccttccgcagagctcgcatgcgtggagcgggacggcacggagctcactagctccggcggtgcggagctcacggagctcaccggcgtggatctggcggagctcaccggggtggagcgggacggcgggagctcgtcctctccggcggcgcagagctcacggagctcaccggcgtggagctcggcggcgcggacggcgacgaggtcggcggcgtggagaggaggatggtgacgagcttggcggcgcggcgaggaggatggcgtcggcgccagcggagcggcggcggagcagcccagtccggcgctcgccgggtctagcctcgggcggcggctacggctcgtcgcatctcccctctcctcagctcgtcggcgctcgccgttaatggctacggctcgcagttttctgctctctcccctcttccctgtcactggcgccagctttttcaggcttttagtgggaagaatgggtgaccaaaacttgctacgcgttcctcgtgaggctccgagtgtaatcgacgaggcatagaatatgccgttcctcaagccgaggctgaacgccacggaggcgcattgtgaatgccctgatagccgccttcaccaatcgctgtgtcgcacaagggcccaaaacccacagggctagctgcagcctactcaggccagttaagcaagcataaattggtccgcatcttgcttgtgtaagctgtccttcggcccaatggacaagtaattagtaggattttttagcctcgtcttccaaaatttcatgttgatatggtgatttggactcgaatgataggagtgctggtatcacgggtaaataattgcgaccagggtcttgataatgctggctgctattgtgctcattttgtcacgagcgaggttaactagcttacgttattcttgatcccttcctaaattatctggcgatatattgtgcgcactgactgatcgatcatctctacacactaccacaaaaatacacaaaagtgatggagaaatactaaaaccggcacctacaaacccctgtccgcggcacgtgtctagtgcctacggggcgtcatccggtagaaccgacacctttaatacaatctggtacctatgacttctgtcagagagaaatgtgttgatttctattgaaaactagcacctttgagtacgtacgagtgccgatttttgaaaaaaaaccgatacttgattaaaccgaggcgacgggcgtggagcatgagaaagaaaacaaatttacgctcttatccccttgcgtgcctcatcttccttatcctcttgcatgcatcgctcttctcctctcgcaaaccgcgcctctcccctacgcagcggtgcggcggtgccagcggccagctcctctccctctccccctgcgtcggcgggaggttgacaccgtggcgacgaggaggtccggctcatccttccatctctcccgtcccgtatatacagcgatctcccgtatcaaatgaatattcgtgacaaaaaaactgcagaaaaaaattcgacgtatatacagcgatctcctgatcctccatgagcttagctatagtgtggacgtacgttgaccacccacatcgacgatgaagtttcacgaggcgatcaagctgccatccattgctcattacgccctacgctatgtgcttcccgccgccgccgtcgccgcgtgcgttctggtgctcgccgccgtcagcctacccggccgcgtgccgctgccgctgctgctgatgacgaacacggcggatggcgtgggcggcgacacgtctggttgtgacatcttcaagggcgagtgggtgccggacatggcccgcgagccgccgccgtacaccggcgagagctgtccggtgatccatgggcattatgattgcatgcggtacggacggccggatcttg

SEQ ID NO: 59628 - DNA, 712 bp, Oryza sativa
tgcttcttttattttcatgtccagaccatctgtcagctccttttcagtctaagaaatagtgttagattaagggcagtcttacatgcattgcacatactttaaatataaatagttcacttgtactgctgtattgtatcatacaaataaacaatagacaactccattgccattaaatcatgacaacggcttcagtatgctggtttctagatgagttatccctgttgattttagataatttatgaatattgaacggcttgtgagttgtagtgcctgtaattaacttgtctttaatttcttgtttgatcattgcaaattcagctgctgatggtctgacgagatagaagtcacagaactacaatagcagaacctctgacatcatctcttcagtaattttcgtatcttcagatcaaatgacagagattggatgtcttcttgttgttcttttttgttgatataggcttagaaagggaaaccataaactcttctttgctctgaagtttacagaactgttgtaaacaccaagtactagaatgtatgcatgaacaactgtgcgttctggcatttgctgtagtttcctactttccttggatatctgtatataatatgattgatcataaatttgcggtgtggaatgttatgctctatttttgacaactgaaatgttatgatcaagtctgaatacaaggcaactctttcataacctgttcctgta

SEQ ID NO: 59629 - DNA, 684 bp, Oryza sativa
atggataactcatataaaaacatcataagctgggtcttgatttaacgtcagcagcgttgtgtattatacatttgtagatgaaaaccagcatgcaagattatcttaaaacaaataacctgtttcttagactgaaaagatattactgagattacctgggcttaaatccttcaacactactaccaggacataaacattctcaaccaaggattgggatataaacccagtattttcgataccagggcaaaccattattcccaattactaaactaccttcaggccatattttagcacatgtacacagattgaaaatccacaaggacggggcatgagtatgtatggcaaccaacaaaccattatttccaacagttttcaggtaagtctctccaaaccagacatgctatacagtttcctagaggacaaatggatataactttattaagaacagtaccaagctctgttagaaagaaatcgatgcagaagtttgtcacaaaagatgcaggacaaaatacaaactgaagactaaaggattatcacaagtgaatgactattaatgcatagaaactgtgtcagggaaaaaaaaagatgaccagccatacatggggtaaaatggaaaccttaccatgagaggttctgctcctgtatctgtcttcctcttatacagtcagataagtctccagtaaatgg

SEQ ID NO: 59630 - DNA, 2626 bp, Oryza sativa
ttgttaggaaccctcttctcccaattagtaacaacaagcttgaatacaactctcacaagtattttgggggaaaagagagaagcaaactagctagctgatacaagtgtctagaagtttctggaaaggagagagagaagctggaggtagaagaggatgggaagagatcgccaagattccagcccggaaccaggacgccgccgccgccgtggccgaagccgccaatgcctgatctgtttcgatgcctcgccatggttgttgctgctctgtatttgtatcctccctgtccaagcttccatgggccacaattgaatattagtgcaacatcagcccaagagcccatcaaggttaagaccctaacagcatagcatatcattgctgtccgtcgacgtggcggtgaagaaagagtgcgtggaggagatcgatcgacggtgagagggtgtcatcggcgggcggtcgggcgagcaggacgacaacgactgcggcagcatccgcaagaaagctcctgtattgatttgtatttgttcatcgatccgcacagcacggtcaacctggtacatgatcagtacatcacgtatgtctacatgttcttgttacattgtattgttttgtatttgttcatcttttgtcgattgaatacatgcgagtcactaaaccagcgctttgcttcttcgagcagaagcaaaaagtccctttagcaaaccaactgaagctcaggacgaggcaggggcaaactttttttttaaaaaaaattctctcttaacttttttcttgaaaattataaaataatatctctaatgtcctatagccaattacactctttttatagtgtctcggggcaatgacacaatcttatggtgtcccccagccaattacacaaaatttggatgttttatagcaaatttcgcctactccatccgtctcaaaatataagcatttttaacatagtatcaagtgaaatatttataactttgactattaatagcaaaaaaataaaaaaaacaatcatgtaaaattgatattactagatttatccttgaacaaactatcacaatatgtaactccttttatttaaaacattttacttttatagatatcattggtcaaggtagcatctcgatgactgtgtcagagtctaaaaatgcttatattttggaacggagggagtagatgttacaagcagtgtctcgggttctcctctttgtccttgtccttcaccaatgcctgtgccgcacaagggcccgaaacccacagggctagctgcagcctacgcaggccagttaaacagcataatttggtcggcatattgcttgtgtaagctgtcctttggcccaatggacaaataattgggacttttaagccttgtcctacaaaataggcaaattttgctacagaacatcgcaattgtgtgtatttagctcagggacactgtgaaagtgaacatttggaggaagacattccataatcgtggatatttacccatggacaccgcgtcgtctcctctccacttgacgtgctgacgtggcagatgggaggctgttttttggcccggtcggacacaaatacccctcagccttatctcctcatatccactcggtttggcaagcagtaccggcgaatctggcattgtagctggagggcggcggggatcgtcgttgtcggcgaggagctgaagtcggcgtggttcctatgccgtgattcaccgtgcagacgtggtgaggagggagctcgttggcggcgatgatatcttccgcttcttcattctcacgtgcttcttcctcttgggttcgccgtgattcacaggttagtgagttgcctcttgtgaaatgtcctttctgcaagggcgatttgacggtagtggagcggacatgcaagaaggaagagaacttcaaccgcaagttctatcgatgccttacagggcagtatgttagttgttctttgcaatccccaatttttctagggtttgagttgaattcgagtttgatttgataagctgtgtgttattgttgtaatttcagacaagtgcgcaatgcaagtttttcatgtggcaaggggattatgctgtttggttggtgaaggaaggtttccttcatggatggacagaatgcagtgcgcagaggacagaaggtgatgccccagaattagtgaatgcttcattgaaaggagtacatgatggaattgagatgttaagatgtgagattaaggaggcaatgagtagaatttgtatgtttgggattgtagttgtgactgcttttgttatgtatgttggcatgaatgtaatgaagtagaacaatgtgatgcagtaatgagatgaattgtgatgaatcaaaatttgtgcacttaaatatttgcaaggaaatatttgtgtttgcccaaaattgagatgaattgtaatgctggaaatatgtgtgtttgcccaaaattgagatgaattgcattgcaggaaatatttgtgttaacatttcagaatcatatggcatgaagtagcaatagaggaatggcatagataggacttgcattgcatttcagaaccatttcagcagtaggactttcatacatagaggaagtcttgtcttgcaacagaggaatagatacctaaagtcatggcttgcaaaatatacatcagtta

SEQ ID NO: 59631 - DNA, 12426 bp, Oryza sativa
tgacaccagctcattgtaattctccctctcatcactaactcctatatactcaacctcatcaaactcaccccatggatctggatttggcactaattgatcagtagctttgtccctggacttgctactttttttggttggaacctttttttaggtagcatctcaggtaggaacattctcagcctgacttgcttgtgtgggtaaaaccatactcagtgaaaccaccgtgtcaacttcatccacacaagacacaatttgggtacaaggaggctcactcactgtcacttgcaatgaaagcttcctaccatcccagtattggttaaatgcctctaataacatagcatcagaataaatttctacatccctacccactctcttgtcccagaaagtcacagtaagctcctgcgcactaccacggatgatttcatcatccaagtccttcatcaaatctatcaagcatacggtgtctttatctacaacccacttatgcgaagttgaaacatggtaatcttggctaccgttatccatatactcaacataagcaacaaccctaaccacaactttgcatgcagagttcggatccatcctacaatgcgatggcaaatgaggagaaaaatgggatccaaaattagatccaccaaaccatgcatcccaaaccaatcaaaaggggaaaaacaaatcaaagagtggcggaaaaattcttaccctttcggtaaccattttggcgtcggcggcgctgaagctagtgcagattccaccacctcctgcgacagtgaagccatctccgctcgtcaaacttgcatcccaccggcgagaatgcctgggcacagccagtatcgagggtggcggaatgagtgagtgctgtttcgatggagctagggttctatcgccggtactgcttgcgaatggagccaaaccgagtggatatgaggagataaggccgaggggtatttgcgtccgaccgggccagaaaacagcctcccgtctgccacgtcagcacgtcaagttgagaggagacggcgcggtgtccgtgggcaaatatccatgattatgggatgtcttcccccaaatgttcactttcgcggtgtccctgagctaaatacacacaattgcgatgtcctgtagcaaaatttgcctataaaatatcgatctggtgattttggactcaaaccgatacgagtgatggtatcacaaataaataattgcaaccagggtcttgataatgctggctgctattgtgctcattttgtaacaagcaagtgtgggcccccggttttgtacaccagaaaccccatgtattttacaatatcactccctagatcagtaggtggtacacacatgacacagtcgaatatcacaagctggcatcgttagtactatattaataatacaagggtagcctaaatgggacccaaatagaccaaacatggtcatgtacattacaaaataccaaatgaagtagaagagacagcggaggcgaagcagtggcggtccatcatactccacaagcaacgaatggtgaaccaaggtcccaattccactgtcttcgacacattctcaacaacatagcacgcatacagtcgactccaactcctttcttaaaaaattaaattaagtaagggtgagtacaaacgtactcagtaagtcaccactacaaaatgcatttagtgcacacaggggttcaaggatggcttggtttatttgcataaagctagttttcacaattcatatcacaaacctatgacttagcatttttaactgaaaaaccacgttaaattgaagttgtcatttatcgagggttcatccaccttcccaagtctcgcttggttcggtttaccctcacattccattttataccactaccaaaataacctccctgcacatcggcaaggttacgcatgcctttacatctcgtagtctaagcaatattaaaatctatgagtctagtcaagagtagtacaagttccgacgctcattaaccgcgagcatggctattcgaatagatcggtttactcatactgcagtggatgtacgctttttaatcctgcaatccgtgacttgtccaacacatgagcctagtcccaacacatgagacttgtcacggcccggtttttcagtcattctcgcattgcggcacccactccaaggactatgagcccccattacacccaagcacaccaaccctacctcgagtcggaagtgaggggagtcctggcgctctcgggattaggagttatttaacatatatacacttatagggtgtattttaggttttagtcggcattatccaaacatcaacactgcaacaacaacaacaacaacaataacatactcgtacagaacctaccatgattggggtgccgccccatgagaatttcctagttcatcgggtctatacccacttgagaaatgcaatcgtactcggttcgtttcttgtatagcttcctgactcggtccttaactgaccagggtcggcgactaacagtttccagaaccacccatattctattcttgccaccctagtcgaaattattttgttttattaagttttggttttcacaaaaggtttttgagtgatcacacatccatacccatataacataagtatggagtgtacgatcgtctaaaatagcaatgctaagcaatgccaataattgactgtgtataaataaatagactcatgcaacaatggatgaatgcataaacataatgataacaagatcaaggaggggtttcattcaagtgtaggtacacagttttataaatagcatgcaattttatttgaagacaacacatttataaatataggttcgatatgctcgaggaagggagcgtagtgacttgccttgttttcagaaacctatgtcttcgaggaatccgtttcagttagatacccggaatgcccacgttcaaagaataaccaatatccaaaacgtccgacaaacgaccacagaagaaccacacacaatcctaaatataaaataaaagtaatattcagtacaaactaatggtgccagtaaatagatcttgattttagagagattatggaagttgaatggagtcattcggaggtatggttcgtaagatatggatttccaaagtttggaaggatttgtaaaccgtggaggtagcactcctcgggtggggagatgattcagacttccagagagggttttgggttgtagagggacacaagatggattttagtgagcaaggaggctgatgatggtctcagcccgaaggttagatgaaggacattatacagacttctatagaggaattaatctctggaataagtacatctgaggtcccttaattttacatcgaatctgattatcgtccttaaccccaaaaccagatacaaccggtcctcaaactgtcaaaaccggtgcaaacgaggtcccttagcagttttgaaggcggttttggctgacgtggcgcctacgtgactggtttgaccaggtctccgtcccacgtggcgatgacgtggcaattatatctcgaaaaaataataaaaaccatgggcccacatgtcagccacacaaaaaaaatttaaaaacggtggggcccacacgtcagctaaaaagatatggtggggcccacgtgggccccacatgtcatctccctctccccactcggctctccctcttcttcctcatcacgccgcagcatgctgacgacgacgacggcagccgaagcatcggcggagtggcggctgcggcaggccgcggcgaaggggcccacgaggagcggaggggcgggcggagcggcggaggcagcagggcgcgggcggcggaggtggccggaggaggagggagaggaggaggtcgccgccgagtttcgctgcctagaggacggcaacgaggtcggcctcttcgccgtgttcgacggccactccgacaccgacatcgccaccttcatccggccccacaagtcatctccctctccccacatgtcctcttgtgcggccgccgtcctccgcctccgccggccttcgccccaggccatgctgccaactacgacgacgccgcctcctctcgccctcccatggcgtcaccctccccttgtcgaactcgaactccgcgccgccacggccggctgtcccttctatctccatggagatggaggaggcggcgaggttgaggaggtcgccgcggggccaggcgaaccacggcgcggaggaggcggccacgcggccgacgctcgatccagcgaggctgtggccgtggcggcggtatggccgatgaaggcggaggcgccggtgggggatggtggcgctggtggcgagccggccccggaaggatggcgcgacgacgacggccgatgcggcggcggcgccggcgagcgtgaggaggccgcggggtcggcgtccaagaggcggcgcttcacgtggcgtggcggcgtcccagcgccgatgaagacggtgacggcaacaacttcgagggacggcggcggcggcctcggtggcgctcccgctaggcggaagcagaggcgaccgtgagaaggggaggtcggcgtggcggtgcgggtacccagcggcttggccacgctctgccgggcgccggccgtgagcgaggcagaagcagctgcagccgattcggctgtgcgcggaggcggcgcccgtgcagcggggaggcatttttgcttggtgctgcaggtggcttctaggagaaggaaggggaggtagaggagatgacatgtggggcccacccaccatatttatttattttagctgctatgtgggccccactatttttaaattattatttttagctgacatgtgggcccacgatttttattattttattattttttcaatgtcacgtgggacggatacctaatcaaaccagccagtaggcgccacgtcagctaaaaccacctttaaaaccaccgagggatcttatttgcatcggttttaacagtttggggaccgattgtatctggttttggggttcaaaggacgaaaatcggattcggtgtaaaattaagtgacttgagatgaacttattccttaatctctcgggctcggccaaggatgtataggctgggtgatgtagacttttagagggagagagagcacagacgggtcccacttccttttattttgcttcctcttttcttctctctttctcggtctcatctcttcctgctctctctgtcacgcgtgcgttggccagggtgacgggcggtcggcgtgcgacggccgggcgcggcggcgcgacagcgcgtccgtgcgcacgggggagaggcggctcggctcgatgcggcggccaggcagcgcagagaggaggagccgggcgcagaggggagccggggcacggcgacgggcagaggaggtggccggtggcgatggacgtggaggctggcggcggaggaaggggagaggagctcggcggcggtaggagagaggaggctggagatccgacgcggtggggagctcgatgcgggcggcatgcgcgaggcggccggcgcgcgacgcgcggcttggcgcggcggcgtgaggaagaggaggcctacggtgtggaggaggatgccggcatgctgcgatggagaggaggacgacggcggggatggagaggagactggcggcggtgaagaaaggctgccgcggtgcgggcggcgcgcgacggcttggcgcggcggccgggaggcaacacagaggggaggaacagaggtgacggtggatgggaaagcagaggagggactacaaggcggcggccgcggaggtgaccgcacgtcagcgctcggcccgacgccatggcggcttgggtcgggcggagacggcggtggcagtggaagtggaggaagggcagaggcacggggaggaggagccgggcggcgaggttgggggtgtcgatggcgggccgcacacatggcgctgccactcggcggcgtcctggagcgaggccaagacgacagcggggagggcatggcgcaacgcggcggcgcgggcgacggccgaacacatcgcgcgcgcaagaggacggaggcggtgcggcgcagcggctaggccgtgcactgccaggaggcaatagaggaggagcgatgcgcgggcgccgcgcaaggaggatgcgacgatgcgcacgacggcggcatcgcgcggaggcaaagacaagagcaaaagaagaacagagaggagggaggaaaacacggaaaggaaggaggaaggaggagatgctcacgtcgcggcagccgggtagcggcacaccgtgcgtggtcgatgggcgtcgatgctcggctcgcggttcatcctcggctcgaacacagccacagaggttcgtttttcagttttagctcaagttttagttcgactacgtccacggtttgagttggattgcaagtttttggaggatgctatgggtcggacgtcgacacgaaactgcctcacgactgtgcgcatgcatgcagcctgctgcgtgatgaggcatgtgttgctgactaccctttgtttactgtatgcggtgcttgtctgcctgagctgttactttactttttctcttcccttcaatcatattgcatgtatctacttttccattaaattttaaataatattttcatcttaaaagacatatacaatgtacgattcaattataccattacattcattgtaattaaatgtttataacaagaacccacgaggttatatatatgtgagtatgaaaatcaaccattgtttcaccatttataaaaacatatttgaactcacctcatgaagtgtttcaaattcagagaaatgtaacataccgaaaaaaaatactaaatgcaacaatcacaaccactacatgaaacactaaataccatcgagtgaaacataaaaaggatcatattaaacatatgctatatttgcaaaatatacttagttatgtttaaatatttttaaatcacacatgatgcatagttgtaactgctgagacaatcaaaaggatacgttgttgacggtcgttatcgatcagtttcgaccgtcaatattgccaaaatagaggagaactagtgatgcttgcaatgcataattacgttagaataataatattccactagtattaggtatactaaccttttgcatagaatgacaataaagtgaaggagaatcgacatcaacacagacgataaatcaatcggacgatatcgacaatcagacttatgtatgaatgggctaagaactcagaattgacacgatgaattgggccaaaattcacaagtctgcagagtggagcaatagaggaggccaccagccgaaattgggctggattgggccagccccaggttcagccgaaccaatcctggcgccgtcggatctaggttttggtgtggacgtccaggattgcatcccaatgacggttggagggcacttcggacaattccccttccacaaccgtcataactacctctatataatgagctcactctcttcacttcaacacacacctcaagcaatagcttagtttagtagtatctagctggtggaataggaatagagtagaaatcaggagtccgaaagtcttcggaagagttcgggtatggctctagcagcttttctcttctcttttgtaagccttgtacttttattagaatactcttctaaatacatttatggtattgaaatactttccgagtatatgagtacctactttacattatgttcttgttatactgaatatacggctagcttatctgggagatgctttggtgcgggtataatgtttgcttatgcaattactctatgtcatgacgatgatattagagaagtatctggtagtttagatgtggtgtctagattacgggatattattatttggggttatatattgcggatgagaggtgggccgctgatggtgatagatcggtacgggtattcctccgcgcctatatataatcctaagttaatttcctggggagggtattcctccgtatttagccccggttgtatggtcatgacgggctgtcgtaaggaactcggcagtcaggggtggcttctcgaagtaccaggagggcatcggaaagagggtattagctagtatatcagtttactaagatgtatgtatactatgtatattagaagtataggaatagattatcttcctctttcctttccacttagcttagataatatattatgagaatgagtagttaatgcttgtgtgtcactctacccttggattatcttaacccctgcttagaatatgattattacaagcaacatataaattattagttaagtcctctctacatgatcttcccacgggataaaataaatacgatacatttcgaatactctcgggtgaaatgctacaatggtatatccgtgcgcttgcggatgaactctgtaaccataatataccagaattatttctacgccattgctgggaattatatttctagtaatgtcgttaagaaataccaaataagcatttctggcgtcgttgccggggaaaattcataatagagattacttgaactaatattttatatttgcctctgtataatcattttcctttgcaggctaaccttggttgttttcacctttgttgtgagaacagggtagtgcatgactggtttcaacctgccggaaaatttcaaggaaaatccagaagctttcttccggagcgtcagaccgcgagtcgctgctccgcagaaaactctaccgacagagaaaccagccgtaccagcgccaccaattttcaagactatggctagcaagactctccgcgagttcgctgctccctctgctgacaatgtggccattgggccacagatcaacatgggagacatggatttcaatttgaagtccagactcatcacgatggcgcaggctagcccattctgtggcaagcctaatgaggatgccaatgctcatctgcaacagttcctggagatctgtagcatgtacaccatcaagggcgtcagtctcgacgccgtcaggctggactgtttccattctcccttctcgggagagcgaagcagtggttttatgccaaccgtgctgctgtcaacacctgggataagtgttctatggcattcctctcgaagttcttcccgatgggcaaaaccaatgcccttcatggacgaatttcaattttccagcagacgagggatgagtctattccagaagcatgggaacgactgcaggagtacgttgccgcctgtccttatcatgggatggacgactggctgattctgcagaatttttataatggactcaccccgacgtcccgcgaccccgacgtcccgcgatcacctggatgcggcagctggaggagcattcttctttaaaacggttcaaggagtcgttgatctaacagagaagatggtctccaatatgggatggagcgaggaacgactccagacccgacagcgaggtatacacaccgtcaaggagacggagttacttgctgccaagctggacctacttatgaagcgattggacgaccacgagaaacgaccacaaggcaccgtcaaggccttggactcacacgttacgtgtgaagtctgcggcaacacgagtcattctaggaatgactgcccggaaactcgtgaggaggcgatgtacatgggcaacaacaacaacgggtactgtccacaaggtggtcaggggtggaaccaaccacgcccatattatcaatgaggtaacaataacggtaatttctctaaccagccctccttgaaggatctcgtttttgcgcaagctaaaaccactgatgcgctaagcaaaaagcttgcggctaatgacaaggtcctagagaacaaaaatgtcaaattagatggctttgcttccgtttttcaaaatcagctgagctttaataaaatgatagaaacccagttagctgagttggcatctttagtccctgcaaatgaaattgggaggattccggggcaacccgactcctccattgaaaatgtcaaggcgatcacgacgaggagaggtaagtccactcgtgatccgccatatcctaaccctgcaggaactactgggatgtcaaaagaagcaccgtctagtgactcggctgacaaggaagttcagccagaaaagacagtgccgcaagagtacggcgacacacggttgctgccattccctcaacgaaggagaccgtcagtggacgagcaattcgctcgttttattgaagtaatccagaaaatccacatcaacgtgccgttgttggacgccatgcaagtgccaacatacgcccgttatctcaaggacatactcaacaacaagagaccgctcccaacaacggaggtagtcaagctgacgaaacaatgcagcaacgttatactccacaagctcccggaaaagaagaaagattcggggtgtcccacgatcacctactcgatcggggcacaacagttcgaccaggccttgtgcgaccttggagctagcgtcagcgtcatgccaaaagacgttttcgacaagctcaacttcacggtgttggcaccaacaccgatgcgcctacaactggctgactcgtcagtccgttacccggtagggatagcggaggatgtgccagtcaagatatgggatttcttcatcccagttgacttcatggtactggacatggacacgggaaaagagacgccgctcatcctagggcgtccgttcctcagcaccgcgggagccaatattgacgtgggaacggggagtatccgtttccatatcaacgggaaggaggaaaagttttagtttcaaccgaggacggaacaatgctctatggtcagaataaagtacgggccgaacccgcagaatattcaagaggtcgaagtggagccacccaagacggacagcctggtgaaattcatgcagaatttcctgaagaaggaaacaacgatgcccaggaaccgttattggaggacgccggtaaaaccaccaataccagccaagaagctagagcagccggctcagaagaagccgccctccgcaccaaaaccaaggaaggtgtggagggagaagccgaagacgcccgctccatcacctccggagacgggtggaaaaaccatgaactaaatcggaaggaggtacagtcctgcacgtcggactttaaatgacgtgaccttcgccaacaggtaaattggtatgtatctgcatatttgccttcaacaatttgaaatttttgcatcatcacacgtttaattttcaaaattgcatttaggacttttgaattttgaggaaattcttcaaatgaatttttcagaacaaaccaaaataaaattttccacgaaaattcattgtgccacgaccacaccgaccgttggaatccaacggccgaaagtggggccggttgggcccactaggggttcggccaaacaccttggttcggcaacggttccctgccacttttggcagggtaacggctagtgggtcctacatgtcatttctgaccgttgtgggtaccctataagagccagccgaccgagagagggaattccaccccatttcaacacattttctttccctctccaaagtttgctctcaaattcattcaagccttgatagtttccctcaaattcaaacacttagctgcatatacatatatatatatatatatatatatatatatatatataagttgctttggtgaaactaatcggcgggtgaaatccttgtcattcctaacccccgtcgagttagtccgttcttgctccattgtgcggaatgagaaggcgattgtctcgtctgttcaaggggtccagctcttcatcaagtcgtcatgacgagtctagtactcgttcatcagctgatgtctcgatggaagacaccgaagctccgcgacaactcctgaacaacaccgacctcgaccttgtcagtgatcgggagagacaggcctactacatgctgagtgaccgggagtatgctcatacgtaagaatactcaccggagctgctaaaaaagataggtatggatactgaatttcgtgctatttggaaagttgttggttggcagagatttgctgtggtagatgagcctggttctcgtttgcttactttgcaatttctgtgcactttgaaagaaatagaagatgggatttcctttcgctttttccgtgaggagtttacacttacatggaaaggcttaagcacacttcttggttttcacgattcctgtaaaatcgatctccagaaaggaatttctgggttcgagaaaaataggttttgcgaagatatttctggtgctccaatttgcaagaaacctaggatgaatgatatccataatcctacacttaggctcatgcacaaatggattgctatgactctatttcctagaggtgatctgagacccataaggggagatgaattaattatcatgtttgccatggttagaaagtatcaagttctgtgctcctgttgagtgcacttctctgattactcggatagcaaaagggctaggggtcgttagcgaccaaatggcttttatctcagccgctcgtccgcgtattgatg

SEQ ID NO: 59632 - DNA, 560 bp, Oryza sativa
ggggggtttttggattttttttttttggctaaaaaatatctttgcatgcggtgggctatgtggaccgcatgcgaaaatcccctttttgcatgcggttgtgttgcccgcatggagaaatagcgatttttacagaccttttgttccatgcgggcaggctagccgcatggaaagatccatttcgcccgtatgaaaaaagctcttctgtactagtgccacccatgcctcatgtcacgcccagaaattcacgaaccataatttctaagctgaatgtgtattaaacccctgtccaggaccagccagggtacacaaacgacaattgttgacatacaaatccacgtcttacaaaaacataaaggattacaaatgcagcggaaaaggtaaaagcgagctaagcctgaagacttgactcctgcagcgggcgattccattccacaggcaacccttgacggcagcgacgaaacccacctcttcaagacatctccaactgagaagaacttcaactctggtgtgggggaaaagagagcaagactaagtactacccactgtactcagcaagtcat

SEQ ID NO: 59633 - DNA, 2362 bp, Oryza sativa
gattccatgcacggaaggcaaagttatcaaagtcttaaattcgcccagaaatctttatcggcagtccacggtgtcgcgccggccagcctaccttaacagcgcggttagtcaacgtgcttgacaccgacgttgtctaagctatccaccctaacatcctatgtgtcgttcctatcctaaccacctcgttgaaaaccagttgtggacgctcagatcttcgacattccaccgaaacaaccgctgcttcgtggcctatggtaagtggtttctagaaaaacctctgggggtccacctctcccaatccagtctccctagggtgaggcccgtgattctttaatcgtcaaaaaaaacctagctcgattccatgcccggaaggcaaagttatcaaggtctttaattcgcccagaaatctccatcggcagtccatggtgtcgcgcccgccagcctaccttaacggtgcagttagtcgacgtgcttgacaccgacgtcgtctaagctatccaccctaacgtcctatgtgccgttcctatcctaaccacctcgttgaaaaccagttgtgggcctatggtaagtggtttctagaaaaatatctgcggtccacctctcccaatctagtctccctagggagaggcccgtgattctgcagccgtaaaaaaaaacctagcacgattccattcccggaaggcaaagttatcaaggtcttaaattcgcccagaaatctccatcggtagtccacggtgtcgctcctgcggtcgacgtgcttgacactgacgacatctaagctatccacctatcatcctatgtgccgttccttccctaaccaccttgttgaaaaccaattgtggaccctcagagcttcgacattccgccgaaacaaccgctgcttcgtggcctattgtaagtggtttttagaaaaatctctggggtccacctttcccaatccagtctctctagggtgaggcctgtgattctgcagccgtaaaaaaaaacctagcttgattccttgcccggaaggcaaagttatcaaggtcttaaattcgccaagaaatctccatcgatagtccacggtgtcgccctgccagcctacgtgtaacattctgaaaattcaagacaatgaaaatcacgaaaatttcgaactttttaaaacttttgcatcatgctggttgttatgattgctattgcttgccaaaccgtaaatgatcaccaagaaagtaaagaaaagaactacatttaagcaatagatatgattttcgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtacatcgattttgcaccaagttcctacttgcatttagggattgaaatttgatatattaaacccctccatataaaatatagataaattgagctaatgtgctattatgttaataacggtctcattagaaaattatagaatctttaataaaccttaaatattggataatattaaattttgggcaaattcacatttgaacacttaatacggtcacctaaatgtttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagggtgaattcattagttaagataacacaaatattgagtaaaatgcatatatgcaaaattaggaattgtggaatcaaatttatatggaaattacgctaaaatcgggttaattagaaaacggcactgttcattgcacctaaggtgttcgacggggtcccctaacccagctcctcctctttccccctctctccgtcgccagccgccgcgcaccgtcgccatcgtcgcctgccgccgtgccgccgtcgccatctcatcaccgcggcagcgccgtcaccgtcgcgttccgcctcgcgccgcgcgccaccgctgccgcgccgtcgccgtcgccatcccgtcgcctcgcgccgcgcgcccgctgccacgtgccgcgccgccttgcgccccgagccgcgccgcaccgtcgtcatctccgcccgcgcgccgcgcgccgtcacgtcgccgccgtcgccgtcaagcccgcgccgcgccgcgccgtcctatcgtcgctatcgcgccgtgccgtcgtgtcgccgcc

SEQ ID NO: 59634 - DNA, 839 bp, Oryza sativa
aatgtacctctttattccatcataaattgttgttttttgggggccatatttcaaaccgtctaggtaagttgtcatagcatcttcataattgtgcatcaagaactgaacttcacctttacaaaaatatcccttccaaaaagtaggatctacctcaatgcatttatctgcatcttcaagcccttcagccaatgcatttagctcgatgcggcatttagctctgtcgctaaaattctgggtgatcaatcataaaagggcataaaaaatgaatgccaaaacttaaaaaggagtagctcgagacatatctttcaccaaagaacaaaatatctttcgactcacaaccagtagcggtatcaatacttactctgggattcaatggattcctttttatggctttagtaaactggattgctgcttccttgtactttttcttactgagaagttctttgcctgcaatatgtgtacatactcagcagcggcatttgtacatctcaatgagatggcaattatcattttactagtactagttaggagctggttatatcatgcttaaagaaaggatgtagacaaatagtcctacaatacaagccccatccagatattcagcttactttgagttactctacttccactgtaacaaccagaacacttgttgcaaagtacaagttctagaggaagtacacggccttaacctctatccccaggatgccacagatgccatatgatgaggtggaggaaagaagggagtagagaaaggaggagcctgtgagccacccttatgcaagaggtaacatgtacacaaacttccagagaaagaaaagataaagagtaaatcgagagca

SEQ ID NO: 59635 - DNA, 17712 bp, Oryza sativa
  unsure (1)..(17712): unsure at all n locations
ccacgcgccgccgtagtcgcgccgccgcgccgccgttgtcgtgccgccgcgccgccaccttcgaagccgccgcgccgtcgcctcggagccgccgcgccgtgcgtcgccgccttgcgccgccgtcgccgtcgttgccgccaccgccgccgccggtgagccgtcttccccccctccacctcgcgcccacttccgtcgccgcccggggaagcaaagagccgagagagagagagatagaaaggagccgggaggagagaaagaaaagaagagaaaaagagagaaagaaaagaaaaagaaaggaaagaaaaaaaaagggaaagggagaaaaaggaaaaggaaataaaaagtaaattagagggagattagggaagtttagaaaatttaaaataattagaatctaattatagaagttttatggtctcgagtctatgacatgtgggccccacttgtcattagctcttcctatttccctttagaaaataattcggtaggaaaaagaaataaacccgggtcccacttgtcagttggtacaaggctgtggatatgtcttaaaaataaatcgtttatgaacagtagcttttcgcaatttctcggattaattcaaatttgaatctttacactagcataacttattcattttaactcggatttgagtgaaacttgaacctaaattcatctaaattcataagctttccaatgatatataattcactatttaacaaaatatacttataattataaattaattaatatcaaatgattagataatagttaacctaaatagtgtgccaatgaataaaaatggatattgtacagtagcataattatctttaacatgtcttgtcactgtagcaactaaataaattagttataatcaatccttcaaattaatggatgtataggaaaatactagtacttatttaatattcgatggccatataattaaatccatggcttataggttatttaaatcaagtatagccttatgattatgtaactaaaatctaaacacacatagatgaatctttaacctgtttaggagaatcataacagagctagatgtggaggaatcactaagtaaattaatcgatgcaataccatatagaatagcatatatatgcctaaattgattaccacttattagtaacccaatagaaccaatgcttaaacttgtcgcatcacatatacaatatcactcatagaaactagctaatgtataattaaactacaatatatttaggaatcacttggagcattgggtagtacactttctaaataagctcatgtacagtaggcgaccaaaaccttatatgttgttgcacacatatattgtacatcccattatagttacacaattaatttatctttttcatatattaaactggggagtatatagcaaacatgaatagtagataagtactaattataaatcttgacctcctatgttcatagttcaattgtaactccggattgttcattaagagataatctgtaactataatattataaacttcccgaatttaacatatagagcatggataattattagcccttttataatttataatggcaagtaaaatatgttcataattaaagtaaagcttccatcaataaaataataatacaaataattcactgtaattgtttgattgatcctaaatccatctaacaaaagaacctctagtatataaccgtcctatttagatagatgaatacatagccataatccttccatagccatttgatagactaaaccaccgattagccaaatatatatgtatcccataaatgctatgttggttaactcctaaataggccacgatgacaatagaaagattaagaaactttagccttagcatgattgggatccattagcaaacacgaatagtacattttattgcgcatatttgattgttgtttgaatattggtttttctcgcgtattatagaccttgtgtatcggttagtcgtgaggcaacgtctgcaacttccaggaggtgaaggttgatcaagattatatcaataataaggattatcctgagcaaggcaagtcatcactattccttgaacatgttgatcccaattgcgaaattgttttgtttgcaaataaaattgcatgcaatgatgaacatcctacttgtgattatgccatgccttgattattgtttacccttaaatctttgtaaccatgtttacgtatgagtccctagtcaactatgacaattgcttaggaatgctattctagaatcatacatactcatatttatcaaatgctatatgcttgggcaattacctttgggaaggtaattgagatgcggcatgtggagacatgagcgccacattgccatgatgttgatgacatgatttgtgaaaggagaaataaaattaaaacaactgttttcgactggggtggacggaggatttgggtggtatctggaaaaggctagtaccgtccccagtcaattaaggaccgagccatgaagttaagcatgaaacgacccccgtacaaccgtacttctcgaatgggtatagacctagcggattagatagccgagcggaggcagtatcccagcatagatggttcacccctgagtgaggcaggtgcgctacgatgggacagccgttgaggtagggccgagaagcgtgccctacatcggtgtcgccattggtaggactgccatgagtgtgtaagagagagaacttaacttgaaccataatttaatatgcgtgacttctctttcccgggagcgccagaactcctctcactgctagaaacatggacgcctagagtgcatgaggatttaagttcatggagcgggtactgccaatgcgaggttatcgaaaagctttgccgtgatgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacatgtattacacttggctagactctaaattcttaacttgtggggggatgggatattgcatgatgaattttatgctgatggagccacatcccgagaggagggaaggtggacatcctcagaaaaccatgacgattcaatggcgggaagctatccttgggatcacaatggatggtggacagaaccgtcgttgtttaaagtgaacactggtactaaaatttgatcagtctatactaggttttaggcttgtgaaaagaattgtaaaattagctttatgcaaaagaacctgaagccattccttgaaataccctctatcatatgcattgttgttgtggtggcttcctgagtacggttggtactcacccttgctattcatatatcttttaggagagtgttgaagagaagcccttgtcggtacgcttgcgtatctaacaagatgatcggagtgcggtcttgttctaggtctcgttccccagtcgactgcctgtggcatgttaaccgggcccttatattattttgtcttccgctgttgttctctgatagttgttggcctacctggccctaatgtaagtatttaactcttttagcctaaattcattcgtgatatgttgtgatccaactatgaatgtgtgtaccaactactgatccagggattgatacggataaacacagaagatttccgattcccaaaattgggggtctacactacgttaacggcgcggttagtcaacgtgcttgacaccgacgtcgtctaagctatccaccctaacatcctatgtgccgttcctatcctaaccacctcgttaaaaaccagttgtggaccctcagatcttcgacatttcaccgaaacaaccgctgcttcgtggcctatggtaagtggtttctagaaaaatctttggggttccacctttcccaattcagtctctctagggtgaggcccgtgattctgcagccgtaaaaaaaaacctagctcgattccatgcccggaaggcaaagttatcaaggtcttaaattcgcccagaaatctccatcggcagtccacggtgtcgcgcccgccagcctaccttaacggcgcggttagtcgacgtgcttgacaccgttgttgtctaagatatccaccctaacgtcctatgtgccgttcctatcctaaccacctcgttgaaaaccaattgtgaaccctcagatcttcgacatttcgccgaaacaacagctgcttcgtggcatatggtaagtggtttctagaaaagcctctgggggtccacctctcccaattcagtctccctagggtgaggcccgtgattctgctgccgtcaaaaaaacctagctcgattccatgcccggtaggcaaagttatcaaggtctttaattcgccaagaaatctccatcggcagtccacggtgtcgcgcccgccagcctaccttgacggcgcggttagtcgacgtgcttgacaccgacgtcgtctaagctatccaccctatcatcctatgtgccgttcctatcctaaccacctcgttgaaaaccagttgtggaccctcagatcttcgacattccgccgaaacaaccgctgctttggggcctatggtaagtggtttctagaataatcattgggggtccacctctcccaatccagtctctctagggtgaggcccgtgattctgcagccgtaaaaaaaaacctagctcgattccatgcctggaaggcaaagttatcaagatgttaaattcgcccggaaatctccatcggcagtccaaggtgtcgcgcccgccagcgtatgtaagcggcgcggttagtcaacgttgttgacaccgacgtcatctaagctatccacctatcatcctatgtgccgttccttccctaaccacctcgttgaaaaccagttgtggaccctcagatcttcgacattccgccgaaacaaccgctgcttcgtggcctatggtaagtggtttttagaaaaatctctgggtccacctttcccaatccagtctctctagggtgaggccggtgattctgcagctgtaaaaaaaacctagctcgattccatgcccggaaggcaaagttatcatggtcttaaattcgccaagaaatctctatcggcagtccacagtgtcgcgcccgccagcttaccttaacggcgcggttagtcgacgtgcttgacaccgacgtcgtctaagctatccaccctatcatcctatgtgccgttcctatcctaaccaccttgttgaaaagcagttgtggaccctcagatcttcgacattccgccgaaacaaccgctgcttcgtggcctatggtaagtggtttctagaaaaatttctaggcgtccacctttaccaatccagtctctctagggtgaggcccgtgattctgtagccgtaaaaaaaccctagcacgattccatgcccggaaggcaaagttaccaaggtcttaaattcgcccaaaaatctccatcgacaagccacggtgtcgccccgccagcctaccttaacggtgcggttagtcgacgtgcttgacaccgaggtcgtctaagctatccaccctaacattctatgtgcagttcctatcctaaccacctcgttgaaaaccagttgtggacccttagatcttcgacattccgccggaacaaccgctgcttcgtggctgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctctttttttgtggggacttacccccccttttcataaatggacggagatttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgaggctnggtgtgctgacgcaccccatgcactcggagaaaaaacccacaaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagcccccggcgttatgccagggcgatcgccctctttaagggaaacggtcgggcgtgacgccactcctgagacctggtgacaggtgggaccgatctccacaattgggcagaaacccaacggtcacaaaccacgcacatcggcaatggtaactcggctgtcaacaatgagcggtctcttcaagactgccacattacttgagtagcatacgaatctggacatggcgattcgtttcgtctgaagatatggtaacgttgcttcggtcggcgagcgtaattaacgcgcgcacgatatgatctatctcgactgccacaaccgcatatccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgctgcttgcgccctaactccttctttcctgtgccctaccttcgccacacgcgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctttgcaatggtagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccacgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctgcgatcctaggggctcacaggggccatggtgtacggcgactacctccgtcgtcggattgcaccgctccagcgacgcgctcggggcgcctgggagtacaccgggtccgaagacttcacgaggacccaccagggagtgagatgggactgggctcctaaggacttcaagatattggtccaacgggtgctgaatctcaactccgtagaggcggccctcattccccaaggaatcctccccctctgcagcgatccagaccgcgcctccatcctgaccattatgatggcggtcggggcctcagaggagcgagctccaaagggtcacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttctttcgtttcagcgagatcctgtcgcgtccctcccgccattccaagtccggccagtctgaggccgaggatccggcggccgcagaggccctcaggcgggaatctgaccggcgagaggccgcggatcgcctacgggaagccgaggaggccgcccaggaggccgcccgggctcgccaggccgaggaaaccgctcgggaggaggcctcccgggcccgccaggccggggaagccgctcgggaggaggccgcccgggcccgccaggccggggaagccgctcgggaggaggccggatttcgctaggacgaggcgatggcgacttccgaggcagctcgcgatgaggccgcgggcgcgtcgcttgggcccactccctcaggcgacactcaggcgacaacttccggggcagctggcgacgaggccgcgggcgcgtcgcttgggcctactccctcgggcgacgctcaggaccaaccgggtcctggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcttgcaggcagagcgggcggagctcgacgccgcgtgggcgcgtgtcgaagaggggcgacgctcggtggaggccatggtggaggtgggccgtaaggctcaccgccggcacgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagcttgaccgccgcccagggggtgcttgacgctgccgctgcccgagaacagcgggcggcggagaccgaagcggcatcccggcggcgcgaagaggcccttgaggcgcgcgccatggcgctggaagagcgcgcctgcgtcgtggagagggatctggcggaccgcgaggccgccgtcaccatccgggaagcaacgctggcggcgcacgaggctgcctgcgccgaagaagagttcacgctccgcctccgcgaggacgcgctcaccgaacgggagcgagctctcgagggggccgaggccgtggcgcaacagctggcggtcaacctgtccctccgcgaggcagcgcaggaggagcaggcgcgccgcaatctggaaggtgcctgcgccgagagggccgtactgaaccaacgggccgctgagctcgaggcgcgggcgaatgagctggacgcgagggcgcgcagcggcggggcggccacgggcgaaagcgacttagccgcctgcctcgcagctgccgaacgcaccatcgccgatctgcagggcgcgctggactcgtccgccggggaggtcgaagccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgtaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacaacgtttaggaaattgaaactgcttttatagaaattcagatataagagaaataagaatatgcatatgttgtagcccccggccaaccctgcacgcccaaggggggtgcggggttggcccgagcccgaaacctaacacccgacccccccctcaggggtagaagcgacgaaggtgttcgatgttccacaggttaggcagctcagtgccgtcgcccgtggccagccgtatggagcccggccgggggacgccgaccactcgatacgaccctcccacattggtgaaagcttgctcaatccagcacgcgtttggacgcggcgtaggacgaggtcgtcgacgcagagtgatcgggcccagacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtatagttcggtttgcccagagcaccgctggcaactcctcgatccatgaatcgccgtgcttcttgagtatgttgaaggtcttggttttaaggcctttgaagatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgagcctgtcgatcgcgacatacagatactcaaacccgcccggggcccgtctaaacggtcccaggatatcgagtccccagacagcaaatggccacgaaagtggtatggtctgtagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcgatctaagggagttgggagcactcccctcgggtcccgaggcctggactccgacaggcctcgggggccggtcaggcgcatctgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccatcaaaatggcgctccatacgccgtacttggcgcacgtagacgtccatctgcgggtcagagcaccggtactccttacagacttggttaacgaccagctgggagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctaccacaaaattggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagcctcgcggggcgcacttatcttctgtgctgatgacctcggggtcggaggataacaggggcagccttcccacagtagcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaaaggcgataggtgcggccttcccacagtggcctcagggccttcctgggggtcgggggctcctagcatcgtctgacaagcgggcagagggccaactccggtcgtcgggggccttgggccaccgttcggctcgggagcctctcctccttgctctctcccgggccaagtcggcacagggtggggaagcgtgaaatgagagttgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctgggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgctgttcgccttgggaacgaccaccgggttcgccagccactccggatggatgacctcacggatgaatccggcttccagaagtcgcgccacctcctcgcggatgaaggcttgacgtcccggggcctgccgccgcactttctgccggaccggccttgcgcccggccgcacggcgagacggtgctcaatcacctccctggggaccccgggcatatccgccggtctccatgtgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctatgatcatccgttgcctcggggtggcgggggcggaagcgccaagcctctcgtcgccaccctcgggcttggatgcagcggcgaggtggtccgcgcgctgctccagacaagcgagcgcgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccaggcaacgcacggtgggtggtcggtttggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcgggggccttctgcttggcctcacttcgccgattaccggaaggaaccaccggggatttgccctctcggcgctcctgcctcctctcctcctcccacttcctcgtccactcagccaaacttttgactgcacggtagtccgcgaggtcgtgaagggaagtgttgtggacggtgcaccacttgccggttgggcgctccctgttgggagcgctggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactacgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctagagaaactcggcggggttgacgctcccgtcatatttttcggcgatggtgggccggaaccttgggggccaacggacatttcgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgatgaaggagtggcggccgaatggcgaacagcggctgccgctcgccgcgccctccgtcttgacgatgcggagccggtggtagcagcaccagaggccttggtagcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtctcagccagcctctcccttgttctgggtttctaatctggaaa

SEQ ID NO: 59636 - DNA, 21100 bp, Oryza sativa
actagagttgtggagctggatttaggcagctccataactccactccagacctaactcctggagctaaatttaggagttggagctgtactaaacaggcccttggttaattgttttgacggggaaatggggacccccattcccatttcgtcgatagtgtggtccatggtatactcgctggtctcggccacctaggccttcgcgtagctcgtgtgcacgaaataggcctccgccgccactacctctgatgctgattctcctgcctcaactaacaccgtcacgttgcgctgctcatacatgccaaggtgagtgccctgcaaatgcaattccaaatcaatgcatctagccatgtaggtggccatcgaggaatatatgtatatgcatatgtaccttgagggcatcgaggtcgacctggacgcagggtgacactacgcagagctcgccgatgacgagatggtcgtcggaggatgaactccttggaaggatggggaggaggaagggtacaaagtaggtccccacgacaagcaaggctggggcggcggtggaggtggcgctagccaagggggaaccggaggaggtgaggagagggtgattggggaaaccgcgcttcaggctaccgtctcctccccctccattgctgcattaattttagccacactttggctcctcggtcctcacaaatatgctcacaaatatgatgtgacagtaatatgaatatggacacatgtatgtccagattcgtagtactcagtattaggttggtttatatgggacggagagagtacatcgcagagctatatagaaattattgccatgtcaaaaatacatcatcaaatatggcaacaaaataaataagccattaataacaatatgttaactagtaatatgttcgtgctaaatgctacggtgcaattctttttgtctttaataacctttaaattttcatgttaggaaaaaatatttttctatgatacgtgcaattgagttttatttcaattcatatcatacatcaaatatgtttcacgcaaagtacaataatatgatcctgcatgggtatcaccggcacacatacatcaccacacatgcaacaccatactcaccccacggatgtttcacctaacacacgctagaaccagccatacattcctaatctcactaaattcctattgaaaacctaattgcatagacgtaatatttgtggactttttttttctttaatgacttcaaactaggaattttgcaagaaaacgcacaatttaaattgatatgttttttctatgtccatccaagtaggaagctattttccaccctgatttatgtagaaatttatagtgaaaagatatataatacttccttggttttatattataagtttagatttttttttcatagctaaactttttttattttgacccgtttataaagaaaattttagcatctataatgtcaaattagtttcattaaatatgataatgataatgtgtctattttgtattaaaaatattattatatattttttataaatttgaaaaaaaataattaagaaaaagttaaaacgagttactataatatatataagagagagagaggagatcggccggaaccggaagggagaggggagtagacagacggggacagatcagagtcaggcatggccatggctgccgccggcgacgaggcggagatggtcgaggtgacgctgcgcgccgtcggcccgtcccgtcccaccacccttcgcctccctccgtttatctcggtaacaaaccacccgacccacccctaattcagaaatccttcctccttactgctccccggcccctccccgcccctaggttgccgatctgcgccgccacatcgctcacgaccgacatctcccacaagaccgcctccgcctggtcctgcgaggaaggaatctcccgtgccaagacgacgcccatgtcaacctccgccacgggggtatagtatactagtattctttttctttctcttcacatacatcttatgtggaagacaggactattctaggatggatggttaattcgttgtctcttcaagaccctactttttttcttcttcttctgcacttgatacatcttgtggaatacagttaaatacttccttccttctgcaatttctttagatagtcttatagtggccgtggcacctaagccacctgctaatcatctccgtgacggtgatggtgacgatgacgatgatgaagaggaagagctggtatatttctatcatagtatgtcatatagcttttatattttgaggatgtttatgttttcctcataagaattatctctcccatcctgtagaagttcaaaataccagaaacaaccacctggtggaagagaaaattttttatatttcttcgagacaaattgagattacctggtaatttagctttagattatgcacctctattttctgattacatgatagcgttgattaatgtggtgtgcattttgcttctccagatatcttgttgatggtgctattttctctgggtatcaaagcatgggttcttatcgctatgtggttcctttttgcacctattgctcaaatgtacgacgttggacctttatttgtaagtaactttgggaatacaacttctccagcaatgtccatatgaacccactgttctcttgtctccactactcatttttctcatagagatatgtgtgaaaaaaatggtgtggtttaaagaagtatcaaattaataatgtccgatcagcataactactgtctcatcatgttctctcttactctacctaaacgagtccttgacattttgaattcgaatgtaccacacgctgatactcatctagtaacttataccacaacactcatctacttgggtttttctatgacatattctgagactcgtgtatttagaaggaataacagactgttttgcattactacttgcatcatgatagcattattatattgcacatcattttttacctatttgggtgactagggtggtggagagcatcagctcagagcctaagagaactgtattgtactgaggacatgtccttgccctacaaaaggcaatggcctatggccaacttgtccatcctatgaagaaaatgagaggatggagatagtcggtacagagagaagctttggacaggacagagtagaaccatttacactttgcatgcacttctttttttcctgtgattatgtccaatcaaggggaaatgaattgagaaggaaacattgcacacaactcaaaacaaaatgagcagtgtgctcatcatgacactgaggtacatattgaactcaaagcatacacagaaatggtaactgaagaattggacatatcagtttctagctagctacagccaggggaatactttgggcctcgcagggagcccaggaatcagtagtctctagatcactccatgtggttttatcttacatgtataagtcttcaatttatacaaccatacaaatcttgtatccctatcccattcttcatttctttggtctagtttataggtttttctggaattgtgatgctaatgctagtttgtctgtagaaattttgatgaccaaactaattttagctaattgaatttgttgctagattcagtttactgataaacgccactatattatccagatacttggtacaggcttcttggtcattctttgtaatcttggaagacgacagcaaggtgatgtcaggtatgttatctcatctcttcaatctacattgcttgtgttgtctagagtgaaaacttggttttgttccaaacaaacaaacattgttaacattgtgttcttctatgccatagtacaacttatctttattctcttagaaatctactttacgtcatatgaaatggtaagataattaccaactgattgcttgtctttgatttcaatggttggtgaatgtttcccatctagaatatgctccgttctataagatgtatgtcttgattccctgtgtcatacaatacatagtccattgtgtcgtaggatgcttagttttacagcacaagtgctctgagggtgttagaagtgtagtgattgtgtaactgatgtaatagtttcacgtaactctgtatatcataatgttatttgtcaaactttttggcttctaaggggaagaataacaataattcaattattatatatactgggatgtcatgttgattaacaaactggtgtttatctagtaagaacctggagagcaaaattggcatggacacgaagttgctcactttttgcccctgttgacgttaaatttgttatacttacacgcagtgcatactccatatttaatgaagacttccgggagctaccaggaacgcttaacgcggagcgcatcgatagagacattcgggcaggccaattttgagcccgaaatctgatttactgggacgatgggcttaatgggatttgtacagaaggatagtgactcttctttggttctgatcctttgtacctggaaagacttttgaaagaggcccttagcagtgtgaatttacatgtgtacttcacagatggccagcattaaggttgaatggttgagatgcaatatgagtgaggtttgaaaggagggatgcacacatacatttactaatagatcagataaatcaaaccgagtcaatagaagcgcacgtatgtatgtcatgtaggagtataggtgagatttcaatctacatcaggaattcatgaagtaaatgtatattacccatcatgcgttaacataaatatcagatattcagatcccgctgtatgtacatttgccttgcatgataaatctgcagcaatcaaatgtggctcagcactatagcctgaaattcagggaatcgccatataatatctagagtacgtactaccactatcttaagcttcttaagagcaaatagtatttgtgaaattcagaagccgttggagttttctctgattgaacacctcgacttcaacgatgaaggtggagctgacaggtcgatgatctgagaggttcaaacctgagctccaatatgatagttgcttgataccctttcccagccatagtatgcgatcacacctgattcagttaggaggtacgtaccaaatgaggatcttaaaagaaaaagaaagccggagacaaatgacagaattgactatagaagttcagaaacaaagcatatcactgtctgatcagtacaactgacggtatatatttaggtctacaaggaaacatgaatgaacaatttaatgacagaaacatgcacttatgtggttaaaaagagtatgttcagagatttcaccatgctggagatcttttattccccacttcgtcaggtttctccccaacatatttacttgaatttgtttcatacttgtaagtaggcggaaagttgatcaacccctccttccaaccagcaaaagtattcccattggtcaactcctttgttagctaaaatatgtgccaaaaagaatttataattaattttcagaaaacaggaaaagaaacatccccagctttagggtcacataatactccatccgtttcatattataagtcgtttgatctttttcctagttaaactttgttaagtttgatcaaaattatagaaaaatttaacatctaaaatataaaattagtttcattaaatctaacattgaatatattttgattatatgtttgttttgtgttgaaaataatagtacattttttataaatttggtcaaacttaaaaaagtttgactagaaaatagtcaaacgacttataatatgaaacggagggagtagtgtctaatcacgaagcagtagaaatcattatcaaacctgatcagacacgacttataatatgaaacggagggagtagtgtctaatcacgaagcagtaggagggagtagtgtctaatcacgaagcagtagaaatcattgtcaaacctgatcagacttcaagagatcatcccatctcttcatagatactaaatctcgaatttcagcatccggcatgtcaatacgataattaagatctccaaaccaaaatatttgactgctcgaaaattgaaattctgatcaaccatcaaaactgaaagcatatccatcacagtagatgtaaagtgcaatgcaacattgtcaaaccgcctagtgccttgatgggtaacagccttcaacaggaattgggaataaactgtactgtttgcagaacttaaatgtagcattaagaaaagcataataggtgacacactcattttggaagcggtgttgatggtctgcctgaactagttacgcaaaattgcagccatatgctttacaaagattgccctacatgtagttacattttttatgacagaagaaaaagggaaaaacaaaatttagattcctagattctaggagagaaaaaacaaagcatgttatgcctctaagccatcaatatcaaaggaactataattattccttttattgaatcagtgttgtttccatataaatttctttgttggttgggataaccagcactgaagacataaatttagtacaaaggggacaatggattggatgttcaaattttcacccttgcatgcaacatagcaatgcatgctcaatcagtttgctaaaaggtaaatgtaaagagtgaagtgtatatacatactcatgtgaaggaatcttttgtgggtgaccagcagcaaacaaggaaaaaaatcttgttctttgtaaaatctcatccacatcagagttccttttctgttgatccccacatttatggccagacgcaagatgtgagcagacaaagcacatccgagtttggaaaagagacatgctaatggaaatcgatccctgcactaagcaaaattgagatggccaaataaagttaaacatcttgattcaacagttacaccaacatactgtagagatcgacaatcaacagagggaaggatgaccttgtttcccatgtagcccagaagtccaaccccaactgaagctacctccaagttgttaacgtgttgcctcagcttacgggaaacccatacagaaacatatataccaaccatctgtttactaacaacgcgcacgtaatttccaggaggctttaaggattctccttttgcaaaagttgccctttcatcaggaccaacaacagaagttgtgtcatctgatgtccaatcagacatataatcaaccgaactaagaacatctaccttctcttgctgttctgaccatgacatgccaagattcccagagctacgatatgatcgtcttatcccatcttgcaatgctacaccatgtagatcaaatccttgagcgttctccaaatagtcggtgttaaatagccccatgctcattactctcctcaaccctctatttgataccgatatttttgctggaatgtctagtgggcattctggccagtccaatgaactagttccatccaaccagtcacagctgcacttacttatacttgtttgcttatctctacactgttgctgaggagataaattttctgtcattttatcatattcacgttttgtatcatcatgtccatcgtcagaaggaataggtactcgcaatggtgatagtggagcactgtagcttttacaattcgccttgggttgttgagacttattgagagcacggcggataataccctcccatttaggtactgttctactatcttctgctcccaagacattcccaacgcttaatgggaccacttcctggaaactgaaacaagtgaaagactttaaataggatcacagtaattagccatacatgcttgtctagtttggccaaacaagcacaagctccatctcaggattctaacgatatgccaattagatgtcagcagtcaagtatacaagaaaagattgaatgttgtgatcaatttatccaaatcataaagtacgattacatagtttcaaggtacgcaccctaaaatatacatgtcagctggctcttgggaacaaatccactgatctaggtcaagatcttcactaggggctcttccagcaacgttccatgttcctatcatcaccctggtggtaaccactattataaaatcgccagatgcatgacatggaatgcactgaggattaaagatgaactcatataaaccaaacctcatatctttgttacttatgtagttaacacgcaaactttctgatttccttctctgtagtcttcgcagaggcattattttatcccctaacaaaaggggttggcaacttgaaatcaagcagataaaaaagtctcacgaatttcaactgcagaagtatttattcactacacaataaacataaacttgcactgacaatagaaaaatctaccaactgtaccctgaatggtcagtagttgaatacttctggtcctaaaggctaaaccatagttaaaaagaaagttatcaagaaatgtgcataaactaatatatgcacgtgataatagttctattgtttgctatactgtcaagtgtcaattagacaaatagttaaggggatgccatctggggttgccacttgccagtatacaagatgccacacaatactcatgttctattatttagtaatctatatgaaatattcaaaaactatttctatgaccatagtaatggtcaatgtattcaatatcaagatgtggaagcaagtgactaactgcacagtggttgttctctctgtcctgttttcaatatttgcaaccaatttttttaaagagaaagttgaccacaagaaatactatggtgtgtgtgttaaccatatgaaaaataaattgatggatttctgattagaagtcctaccaccatgttataattttctagtataatactatgtcatggtcaagattccgtcgatattgtgagaactcaaaaaaaaataccagccaattattcattccaaattttatttatggaaactctgtgacttgaaaggaaattatcttccacatctaaaaagagtaatagatggttgttctgctatgattaggagcagtgatcatgatttattcaaagtgattagtgagaaaataaaatttgtaatccacaagcactgggtttcaactgatgataatgaatacaactttagcaccaaaatgcatgacttagcatgattatgaaaaagtcaaagaggcgaggatacaatttcacaatacctgatgatctgttaatggtgtggttgttttcatgtatctcaaagaagttgtcgctagcatcctctgcgcagtcactgaaatctgagagaagacttgtaaattttgattccaaacagacatcaggagttcaaacaaagaaatataaaaatcaatgctcctgcaatttaccataccctcatctcctccatctgtatcaaactcatcttcactgaaatcatttaattttggcttaatgtttagccatttcttcatcacaattaaaggccaaaatgactgtattgtacatcagtcagattagataactcatggtataaagaataatggcaaaaagctaacacaatatatacaaaatatgcacatgaggttctgatttctgcaaaccttctccgactgctttcctctttgggatcccatgatctgcaacgctatgaggcaggcaatgaacacagctccaaatatatctccagttcttaacttcatcagaaggcaaacttatatagttatatgttccaactacccaaccaaaggaagagagataaatgaaggaaagatgcaggtagttaaggtggaagtcaaaaacataacaatcaaaattcaaaaaggtcatttccactgcattgcagaaatcagagaaactaacagagggacaaagtttatagtaagttcaccattacctgttgtccatctccatcaaagtacagaataattttgaagcattaaaatccataccagatacttctattgctgatcatgtggtaatggagaatatgaaagtagacatcaatttttattaaaaacaacaagtccttttccagaagaagatgcaaaaaaataactggtggacaagatcaaatgcttgtcctgcacttgcatgaattataaccaagtgcacacggtctaacaagacattacctaagtgataaggaccagcactcgcactggcacactgttggaaagagatggaagtgtgcacatatggatggatcatgctggattagaatgtaaaatacaagccattactcgttattacgggcacttattcatgaaaaggttttatttacgtagagacaaagaatttgtcgatatggcactgtgtgtggtccttgggttcatccactttactttgtgagataaaagatgacaaaatttggttggtaagcaatcaataggagatctcaagtaactgttcagagcagcaagagtagcaaaatggggaaggatgcctgatagatatgtggctgagaaagagctgaaccagattgaaataataattatgcaatggagacgaagatgatggaacacatagaagcaaaaggtttttgaaatgggaagttgtatcttcaacttgccagtaagatgtattattctcaagcatttggaggaaacggacacatcaaaagtggcaagtatacctctaacatttttcttaaaacaattatgttttcacattcctgactgtgacttgcaattactgttttccataaggttgggtagaaaactgtcaaacgtaagcatatgcattcctgaaaacaagatagcacccatagcagacaaaagtatgatgatcaagattaataattttaaaagtagtgaatttatcataaaaatgattgtggttttattttgttattatacatgaaagattaaatatgaagatgaaatgtgaaatggattctgtcatctataatagcacatttcctacatggatgaccaactatcctttagaaaagataacttactatatgcaggggttaagtttctcactgtatcacacaagcaagctgagagaacattatatcaagatatgttctccattacagcactccaagatcagaacgaatcaatttcccaaaaaaaaagatattaaagtgtgcatactgctgtactttctatgaccaacctaaataatttatatatttcaataaatatttatcgcttaaataagtggaaatcaagcacttcatgggaaaattcgtactaaatactaaggacagttgcaaagaagtgtgctggccaaaatacgataggtgaaaactgaaatgtttgcagcagtgggaccagattctaatcccatttcttggtttcttctttgatctgtatcatcatcaatcagttctccctggcacaataccttgtcaatcagctaaaaactgcacatgtgcagctgacacattccatgcatcccactggctaaggatcttataatcaagaataggaaaatgctacttctgtaattccaaccacacttgcatacagctagttgatcttaacataagaaactggggacattgttgtcactgtgctaccagtagtccaggcaagaacaagaaccacttttgaagtggtggaaacggttacgatctctaacaactatcactcgatcatagacctcggaaactaccttcatgacagagtgacaatcctcgcagattctcaagtttttcactattcggataacagcccctctcctcgtgtttatcagtccaaaggcaactgccagcttctcactgtgctgcgagatacaaacttctttgtcctcctcatcaatgtcaaaggtaactagtttagtggcaggcttgtgccctttgaggctcaaggttttgcctatctcatcaagcattgcatatatctgatcagactgaggatgtgaatgatccccagacaagaactcgtaaacaacaccatcaagttcgacaacactcgatcctggaggcttgtgtatcctgtgttgtttcatcgagctcctgacctcttgtacaaggtcccatttcccagcagccgcatatacatttgataagaacacccaggccccggcatgctggggatccaacctgagaatttccatcgcaaccatctgccccatctcaaaattcctgtgacatctacaagccaccaagagagcaccccatagggcaacgtcagccttgaacgggacggccctaataagagccaatgcctcctctagcaggcctgctcggccaagcagatcgacggtgcaaccatagtgctctatggtgggttgcagatgatagtcgagaggcatacggcgcaggatcctcttgccctcgtccaccatgccagcatgcgtacatgcgctgagaacggcggtgagggttacggaatctggctgtatgttgtggtccttcatgtgtgtgaacaaatggagtgcatcggtggagaagccgttgagggcgaggccagcgatcatgacggtccaggtgtggacgtccttgtggcgagtgggagtggagtggaagagggagcatgcggtttggacgtcgccgcacctcatgtacatgttgaggagcgcggtggcaagatttgttgtgatggggaagctgcaggtggttgcgaggtaggcgtgcgcccagcgggcggtgtggagcgccccgaggtgggcgcatgcggataggagggcgagcagggtgacgtggtcggcagtgcgcatcgtgcggaagaggcggagcacctggacgtagtgggcgcgggaaaggtaggcgtgaaggagcgagttccaaagggggaggtccctgtggtataggggggctgaggtcgaacacctggcgtgcagcgggcaagtcccccgcggcggcgtacaaggagaggagggatgccctgatgaacggtcgggagactcgaggccgcggcggaagagggaggcgtggagggcaacccccgcagcagctgcagctgcagctgaggaggaatcggaatcggcaaggcgcgcccagccggcaagaagtggtgggtaggtgtagttgttggggtggaagcgggagtgggagagcatgaagcggtagagcaaaatggcaaggtgggggcggggcccgcgggcgagggcgcgaatggcggagttgtaggaaaaagtggtggggtgggcgcggaggatggagagtgcgtaggggagggaggcgagggaggcggcggcagcgagggggcccgccgcggaggggtcggcgaagagggcgccggaacggaggaggtgggcgtggagggcctttggacacgtggcggtggcgggcatggtaatggtggtcgtcttcctcttcctcttcctcctcgccggcggccggaccggagcgcggctgtcactgtcactctcaggccctgtttggctaattgatatggaaatgatttccacccactaaaagacatctttaaatcttaaccatttattctccctcttttatttaatcctaacccttcattcatttcctaatcttaatcccacccctcatttcccgttatccaacattatccaaacacactctcaggggaagagacgagaagagcggctctctctctctcgtgggcctctcggcccaagatctcaagggacagacggagaaagagggagctgggcaagtgggccccggagggcagtgaccagaccacaggcggcgtggaattcaaaggtgagtcgtctcgtcgtaagccatgcgcgtggtttctttcttcttccttaaacctgaatcaatctttctttctttctttctttcttgtctactagtcttctactggagtaggttctacgagacacaaattagacaggagagatcgagtttgaaggcaggaaggcaggcgatggcgagcatggagggtctgatcggcctgatgaaccgcatccagcgagcctgcaccgccctcggagaccacggaggtggagaaggagccaacctccctaccctctgggagtctctccccaccatcgccgtcgtcggaggccaggtcatttgcttccttccttccttgcttcaattaaatggattttttcttttctctttaaccttattattatttttattattatactcctatgattaatgatgcatggattggatgctgatttctagactttgtaattcatttcattttggcttgtgcacaaacagagttcgggcaagtcctccgtgctagagagcattgttggcagagatttccttccccgtggttctggtaattataataacctcattcaccccagtttccctttcaacactatcttacctcccctcatctatcatctaatctaggaatcgtgacacggaggccattagttcttcagctgcatcagatcgacaaaggggcccacgattatgcagagttcttacacttgcccaaaacaaggttttcagattttggtgcgaacttgaaatcaatccttccccgttaatttctttatacagctttgcaatattgtaatgtaaacctcacatctctgtatcctgctgtttcttgcaaataatgctttagttcaagtgtctgtcctattgcactattctgtttccactgctttatttctgatttaaaatagcactgccaaacttatatatcaacatctttctaaaacaaaaggaaaacttatacttaacagcaccacttatttttctctactgtggtgtagctcttgttcgtcaagaaattgcagatgagacagatagagtgactgggaaaactaaacaaatatcccctgtgccaatacatctcagcatctactcacccaacggtaacctcttcctgttgcaaatgtgcaacctatgttgtaatcccctcccagaaatgtatctccatcttgcaaattgaattgaactattctctggaccacccgagccctgcgattgtgtttcactggtggaactctgttaaccctgtaacataaactttttgaaatgtatgggatcttcacgaagaaagaaagttttaggtgggccagtttgcggcctttcatataatcttcaaaagatactctatgagtatatctggacattaagatgctttgaatgatataccatgcatgcaatagttttgtgattatccaagtttgtagctttctacagtttatccagattctctcatactatataggattttgaatcattgtcaaagactcctcaatttaaactaggatttttaatgtctgcttcacatatttctctcatactatacattgattggctaatagtagtttactcccatatgttgcagtcgtgaacttaacattgattgatcttcctggattgacaaaagtcgctgtaggtatgcactattatgtccttttttaatcaaagatttaattctctctcttttgatactgtgtttagtttatcgtgcatcccccccccccaccttcctctaacttgttcaacttctaattcacagagggacaacctgaaagtgttgttcatgatatagagaatatggttcggtcgtatgttgagaaggtaatcaacaaacgaagtagcattttttttaataccatgtcttcagcattcttgtactagtagcaaattgatgacattaacttggctgctgttttggttgtttaattattcacacccaaataactttaggtgttatattgtttaattaatttctggtgttcaaatttgagaacttatacaaggctaataggttactttgtatgatattttgcagcccaattgtatcattttggctatatctccagcaaaccaggacattgccacttctgatgccattaagctttcgaaggaggttgacccatcaggtactaaaattcagtgcacatagagggcaagagatagtgactcttttacttttattttctgcggagaactcatacaaataaagtaaagtatgttgctgtaaactttgatggtttgttatagctctacagctaagattgttatcttctacagaatgctgcagaatagtttgcttttatcatgatcctatctgactggatttaccatccatttttattttctggatgacaatttttctcttttacaaggtgagaggacattcggtgtgttgacaaagttggacttgatggacaagggaacaaacgctcttgatgtaagattgaacttgcctgccctgacaaacagtagtctgtctgcacattgtcagtttcagaatatctacatgcagcctttttttgttcttaatgttcatatcatacctctgacctgtcatttatctgtaaatttaaccttgttctatctggactacctcgactattttcatttcccccaaaggttcttgagggaagagcctatcgtcttcagtatccgtgggttggaattgtcaaccgctcacaagcagatattaacaggaaagttgatatgattgttgcaagagaaaaggaaagagagtattttgaaaatagtcctgattatgcacacctagccagtaagatgggttctgtgtatctagctaagcttctttctcaggtacctcaaacttgaaatttctcgtttctttgagttggtatatgagcaaggcttaggacttgcataattgctttataacattttcagcatcttgaagccgttattaaagcacgcattcctagcatcacatcattaatcaacaaaactatagatgaacttgaatcggagctggataccattgggaaagaagtggctgctgatccaggggtcagtcattcatatatattttgtactaaaagtagtttttgccgggtctgtactaaaagtagttacaggagtatttgtcttgttcaattttatattcaccgcttccataatgttgtgccaggctcaactgtacactatattggagctctgtcgtgcttttgaccgtgttttcaaggaacatctggacggagggtgggtaattaattatctgtcatcatcttaatggcttcttgtatctctcttctaattatgtaaagcgctttaggttcagttctaggttttcattttagaaatacttatcgttatcataatattttgacttgttgcataaatgttgcttatgaaccataggtagttgcatggcgtatcaacatcactcgtctcaggataatacatgctgaaagtgcacctgtttatgttgagttcccgggacttatattgtatcttccatgtgaacatgaaaagaatttacagaacatgcctatcttttcagaagatggaagtgcatacttcataatgtgtaaacggatttagtcaaaaaaaataatgtgtaaacagaatttataaagtgttcataagttttatacgacaccaatatacctagatttttttttaattagttgtcatttaatatgatgagatcttgtccaattacaatattataacgttcattttactcctttaactgtttgggtgcctaactgttgcaggagatcaggtggtgataaaatttatggcgtgtttgatcataagctccctgccgcttttaggaagctgccttttgatcgttatctatccgtgcaaaatgtgaagaaggtggtatcagaagcagatggctatcagcctcatcttattgctcctgaacaaggttaccgtcgtcttgttgaagccggccttgcgtatttcaagggaccagctgaagctacagtcgatgcggtagctgactttctatatatacatctgtgctgattgatttgttgtccgttagtttctttaatcagtggccaccaggccagtagagtaggcactttgtgctgtacgctttacttcctggagtatatatatgctagtagttatatttgatatgtgccaattaataatactctgatgttggtgttaggtgcgcatttgatgaggtgtcctagcttccaaacctttggaaggaataatgctatatatcccaatgtgtctgatctgccaaatatattatttttttcaggtccatgttgttttaagggacttggtgaggaaatccataggagagacagaggttaggaagaatgaatatatccatatttctttgtgttttggaaaatggtactttatatatgttttctcactaattgcagccactgagaagattccctaccctgcaagctgcgattgcaactgctgctaatgaagctctggaaaggtttcgggaggatggacgtagcactgcacttcggcttgttgacatggaggcatatttgacagtggaattcttccggaaactcccgcaagatccagatagtggcagcaaggttgggaataataccaatgaatccaatggctcaggctcaggctcagtgacagtggaccgctacggcgacgggcactacaggaatatcgcgtccaatgtgtcccagtacataaagatggtgggagaccaactgttacacaagatcccaaaggcggtggtgcactgtcaggtccgagaagccaagaggtctctgcttaaccatttctacgtgcacatcgggaagaaagaggtactaattaactagtagtagtagttaatctccttgtcatctagggtgaatgcatggaatgaaagtaatgagttttgtggttggagcaggcgagccagtttgggcatttactggatgaggacccagcgatgcttgagcgtaggcagcaatgctggaagaggttggagctgtacaaatcggctagggatgaaatcgactctgtcgcatggaccaggtagacacaaacatatacatggtggctagtatcttttgtcgcagctgcgtgtagtttggtttgggcagatctaacttccatttgtcaggcaggcactattttcccttggtatatagtatatactatactatcttacgaattgatggacgttatatatctgtatattttgtcagtagatcatccttcgtacatgtgcaccccgacccgtgccatgctggtttcaacagtttttcttttgttattctttctagtggttggcttctctctgttgtcacggtattacatatgttgtattattccctccgtttcacaatgtaagtcattctagcatttctcacattcatattgatgttaatgaatctagacatatatatatcaatataaatgtaggaaatgctagaataacttacattgtgaaacggtgggagtatatggtaagccataaatgcctcatgttgtgatgcatgccaaacagagtaggggaatgaatttaccgatgcatgctaactgtcctggtaatctatgtactcttaataagttttggatacgtcacgatttaactatattttttattataatatataggaaacaagtaaatatcaaattttaatacagtactttttacgactaatttatacatcatgctctagtgttttcaaactaaatattttaaacttattggtacttaaagtttaaattgcttgacctcaagtttgtccaaaatatcaagaattatagaaatgggggaagtgtctagattactcggcaaaacgatcgagatttttgggtaaatcaaacgcacctatatataagtttactaattagcaagagctggtattataagtcactaagcactttccaaacatgtcatataggctcatatgataagaaagagataagagaagaaagaggacgaggcaccctacatactactcacgtgtaatttactttaatatttacatactactgtatttgagtccttgtaatttttatatttacatttaagtccctataatcttgcaataagatacttgaggttgtttttgttaaaaaaataataaaagggagataacaaaggcagaaaagtgcataaaaagaaaaagaaaatccgcaaaaaaaaagaaagaaaaacaacaacaacaacaacaacaacaaaagtctgtttctcctaagtgacaaaaaaaaaacccgaagatccgaacggaaaaaaatcctattcttataaaaggcaaaaataaaatggtgaaaaaaaccgctagatttgatccctttaaaaaggggggaaaagaaaaaaatgcgattcctttaaaagtgaaaaaaataaaaaaaaacatttaaaaagttcgtccgattcctaagaaagtggtgaaaaaaaggttcgtaaaaaataagaagctggttcgtataaaataaaaaatgcacccgagaaaaaaatggaaagggcgaaacaatgttcgatttctaatcagtatatatctcttctctatctctaatctaatctaatctaactattttaaaatagaaaatgcacgagaaaataaaaactgttcaaaaaacgtgtgagaaaaaagcgcaaaaaacacgctaaaaaggttttccatcttccataaaacaaataaaaaacgcacgagaaaaaatatttccatcatcggtaaaaaaattataaaaaacatgcgaggaaaaaactgtcagaaaaaacacgccatttctaaaagaatggtttgaaaaaacaacgcaagaaaaaacaccgtctattaaaaaacaaatcgctctgaaaaaaatgtcagaaaaaacactaaattgatggacggttgagtcagataggatccattgattttttgtcatctactacatggcttttatttcgtcatatattatactcctgtattggaaaaaaaggcaaaaaagaacatttgaaaaaaacaagcaaaaaaacacgcgagaaaataattgttagaaaaaacaggcaaaaaacacacgagaaaataaaagcaaaaaaaggggagaaaaatatggttttcgtcgtcagtgaaaatagcaaaaaaaacatgctaggaaaaaaactgttagaaagaaatgcggcatttctgacaaatggtttaagaaaaccgcgcaagaaaaaaaaacaccgtttataaaaacaaaccgctcattaaaatacaaaaattgtcattaatatgattatacatgaaaaagtatattatgattagaatattttcacccattataatgcacgggtattttttcagtataatataaatataaaagcaagaagaggaaataataataaagggagcagtgtaggaggtagctagtagcttggtgcggtgccgagcgcgtagctcttgagaaggtcaccgcagatggggagtgggcgggtcttgaggaagccgagaggattggcgcggcggaccatggtggcgaggccggcgtcctgaacgagggtgaccggcgcgcggtcgcgacccacctccgtctcgtggcattcggggtccgggctgctgagcagcgccaccgcacacacctcctcggcgccgcggttgtccaccagctcgatgcggtagtgccccgccgcgtccgtcgtcccctccgccgatctttccaccgccccg

SEQ ID NO: 59637 - DNA, 2037 bp, Oryza sativa
agtacaacgaatctagacatgcttcctgtccagattcgttgtactattaagtgttccatccggtcctaagtttctatactatgagacggaaggagtagcatttcccctttagagccatagcgggaaaaacgacactccattgccctgcctcttttcttcgatggctacacgctctaaccctccctcatctattccccacccccaaagccatcgatatattccgcgaggctgtccgctgtcctcactcaggtgaatcctctgccacctctgttggtggtttcattgtggtcatccacgtcttcagcgaggttaccgctctcaggtgagtcctctgccgcttccaccaatcatgagtcatctcatcatcaggtatcgtctcccatcttgcgtgttgctatccacgacattctcgttggtgtgttgagccaccttaatcctcaattttttttgcatctccatatatattaattttttcgcgaacgcgtaaaagcattacacatcaatatattagatctatatatatacaataaacttgtcatttttttattttctagtagggagtgtgtcatcaaccgtcaacaagaacgagaactcatcgcgtttagacttttggaccgagggagtagttcactacagtctactagactactacggatcagaagaactctgggaaaaaaaagacactgaatgaaatagacttgccggcagtttgacaccatgagttcgcaggccgtgtttagttgcaaagtttgaaaaaaaatcacatcgaacttttctacacacacaaactttcaacttttccgtcatattattttaattttctttaaacttttaattttaacgtggaactaaacacacctgcagtttcagacttcttcaggtccggatagaaatatcacggaaaatgctggctcattatcattggaccgttgggtccatgcaacgtcaagcagatactcctgtaaaaaaaataacttttgggtcactcgtgtaatactagcacaaatcaaagtttgcaatgtgaaatgaattagacgaggatttggattttggcacgcttaattaagcttagctgctttttatttttagttagcacgcttttcaagcagttaaacgatatatttcttataaagacataaaaagatgcttttaaataaacaaatttattttcatttttttataatttataattaattaatcgtacgctaataatgtttgtggttgtgcttgcagctaatcatccaacacttattgaccgaaaagaacacgccagaaattgtattgtcatgcagagagcagagaggacctcaagattatctgcattcttctttttttttcactttttttttagatgtccacgacgactaaatggttggaatgattggtatcttggtcgttttcatgtttccattggccttattcaaagccattgtggggttgagtatttgtttcttgcttttcttgtcactttctttaggtttcttatatattacttttcgagaaatacgtaggaatcaatcgttcttggtcgcctttaatggatttctttttgcacgatgaaatgacgtgtaaatctccatcataaatattctcagacagggaaggattcaggcctagggcagccctaggtctaggttcttgacttcatgtaaatttcatttgaatttctaaattttgtatgaatgagtggaacatcagaacaagtaatgcaaatgagactgtgttcggaactctgttttccaaactctcccctctcgtttttcgcgcacacgctttttaaattggtaaacggtacattttttaaaaaaagtttatatacaaaaattgcttcaaaaaaatcatattgatctatttttttaaaaaaatagctcatacttaattaatcacgtactaatgaatcgctctgttttctgtgcatggaagatgggttcccaacacacacctccgaacacagtcttacttgttcttagaaagaaagaaagaaagagacttcgcacattcaagcctcctttgaaacacggcaatttttactgatcc

SEQ ID NO: 59638 - DNA, 706 bp, Oryza sativa
gtttaggtttttgattgtttgcgtatagttgcggttaccggattttcgtcgatcgcgggttttctcgaagattcgtgaagcttcgtgaagaccttgagcaaggcaagtcaccctttgatcaattgctcctataattggaaaatcattattattttgtttgcaacttgcattattagaatcactcacttaacttgcttggcctcggtttgcgtgccaaaccgacggacctacccagtagtcgcactagttcctgtaggctgtactaccctgattccttgtcgctccacccttgtggtacttcggtatccatgctctctgagcgcgcataccaaatatcccacatacaccattgattgtcgaaaacttgggaaatgggtttgtgaagccttcaaaacccgacatgtggtgtcggtgtgtttggaaataaaatgaattgtgaaaactcgcgatgcgggggttgtgcctatgtggcactgtcccgtattcgcatataaggaccgattcctgtgggaaactcatcgagcataatcaaagtgcaaccacaaggtggaataggacaccctggctaagtaactagtcggttcagggaaacctcgcatgccaatagttaggaacgccggggcggggtcggacaaaccgggttcctggtaaggcaaggacaagaagcttgctgacttaccgatcaaggtggttggagtttgatttg

SEQ ID NO: 59639 - DNA, 749 bp, Oryza sativa
tttctatataagatgtactccctccatataaaaagtctaagacatatttcattctttgtttttttaaaagtctaagtcttatttgtagtcactatgtggtaattaaattgttgattggaaccgaagtcattttatattagtacttattggtttcatgctcattggttttatcacatggtgaataaattaattggtcattggtcttgataaaaaagaaatatgccttagacttttcaatgatggagtatttggtcaaaaattttcctaaatgggttattatatctttttaaaagatttgtttcccataatgggacataatttgatttaatttgtgcgggcccatctattttatgtgcatttagctgaatatcttcgaattcgtacgagatatgttacatcgtgtatgtcttctcagactcatgacgttttccgccctacttctacaattactcgtgcttgtctatttgtccactcgtgacggacctatgtttttttttcttttgtcctgggtgtgctcacatagtcccaatcagagttattcatatacacgaaacacactaaaagatcttaatttatcaaaagtacattaattacaaatagtgcaaataaagtcttacacacataacgtataaacaatgaaaacaaaatatatttgtgtatgctttttatagcaaatatggcttgattacatcatgattagtgattcatttctaatcttaggaaaagctatatgaaggtgctaatcttta

SEQ ID NO: 59640 - DNA, 8839 bp, Oryza sativa
aatcaatcaatctcgataaattaataaccgatcctgcttatatatatatagcagctatatatatatcgaatagttgaagcgatcgatcggctgggaatggaacgacggcccaattaatcaggtgatccatacattaatttgcattgcatgttatatatgactctattgttagttagttaagttgcttgcgttgttgaccaatcgaaagtactcctaatgaacttcccctacaattaattaaataataataatgcatgagagataatcaacatagtactagacatatatataatcaaatgcctcctctaaagactaaaatactaatcatataagtacaatcaatccggatggatgaggatacaagcaaaaagctagctgggactggtagtatacatggctctctcaggatcggaaaagaaaacaaataagctagcagctaggagtattaattaattaagccatgatgaggagggcggcgagtaggacggcagctgcggcggtggccttgagggaggtggcggcggaggagggcggcgaagggggagtagtggtggccacaggcgccggggcggaggaggaatctgcctgcacgacgtcgatctggatcttcatgttgccggtgccggtggtggtgcagtgaccggggaagccacagatgaagtagcgggtgccggtggaggtgagggggatgacgtcgttgccggtggtgtgggtggcgatggaggtggaggtggagcacgagtcgtaacccgccttgttcacctccaccacgtcgtgccgctgagcagagtacttgaacactgcaaccatccccatccattaccatatatatgtattcaccggcagcccagccaatcgatatatacgatacgattctgattgcatacctatctggtcgcctggatggaacctcttttgggcgacccagtttgtgtagttggtggtgagatcccatgcgccgcccggctcgcccacgttgtaggtcgccgccgacgccatgcccaccagcatcgccgccatgcccaccagcaccaccgctactcctcctatactacccatatatactctacctggaaggggcaaactaattaaagcagaggagctagttaagctaactactctgaatcaattgctgtatgctttaatttgtctgtgatcgatgatcgatgaaacaggcagcttttactggagtatatatataagcctcctttgcaaggtcggttggtcagcaggtaatactagtccacggttggtaggtactcctactaattattattgtctttttttcttatttttcatttttgctccttctttttcttcataaaaaaataaatacattatattatttgtgatggcacgtctatccgttcacactgctcatagctctagtccttaagtacgactcactcaatccatcagaccatttctaaatatatacgcatgcttgattaagtaagtatgaattattatatatttagaaaatagatttatttttttaaaaaaatctataaatatactccctctatttcaggttataagatgttttgactttggtcaaagtcaaactattttaaatttagctaagtttataaacaattataataatatttatattaccaaattaattttattaaattaataattaaatgtatttttataataaatttattttgggtcgaaaatattactatttttttctataaacttggttaaaattgaaacaatttgactttgaccaaagtcaaaaatatcttataacgtaaaatgatggagtatttctttttcttttatataaaatccaccgtttagcggttaagaaaacgtgataatagaaaaatgagaaggttgtagtatggagcgaaagtttagaactaaatcaattgggtcgcatgaacgattaattggaactgtcaactagcgtttgtattacgtccgtccgtgcatctacctaatacgagtatagtgcaatcccacttccactatacgcggaccatttcaattcgattgactttgtctcttaggttgctcgatcatttgcgagaaatttgataatatgtcatccattccaatgccgtgtacttttgcccttcgccacgtacacatgtcagatcttaggtcccgcccaacgccgttgccgctacgcccttccagttgatctatccactcaagatcgatccaagccaagcttgcccgcccctatctatgtgcctcgccgcctcggccacacctttgctgctgtcgtcaagaggaggagctggtaattaaactagcacctgttttcttttcaattaagtaataatataattttcaaatagtaattaagcttatttacacctgcttgcctgcttaattgcaaattatagtatattacatggtcagcatgtactgcaggtggccggtcgttgtacgcgtaaaagcgtaacaccgtgtttagatcctaatttttttttcaaacttttaactttttctatcacatcaaacttttctactcatataaacttctaactttttcgtcacatcgtttcaatttcaactaaaattgaaagcgtgaaataaacccaggctaagaagaattggaggaagaagaagaattctgcaggttgttggcctgctgcagtctcatcttaataatttccacacgatataattaatttatactagtaccacaagagagttccaaattggcggctcaagactactgcggctaactggtcatgtgacacgtatgttagctgccagttgactactctgctggcctgtggcgtattacgcaactaaactaatcagatcgatccattgatagatcatcattcaaattaattctgctgacgacaattcgatgtacactaaggctgcgttcgtttggagaacaaatgggggaatgtttgtttcgttttccgcgcgcacgtttcccaaactactaaacggtgcgtattttacaaaaaatttctatatgaaagttactttaaaaaatcatattaatctatttttaaagtttaaaatagttaatactcaattaatcatgcgctaatggcttacctcgttttccgtatcttcccaatcttctcaatctcctctccctcaaacacagcctaaggctgcgttctttcaggagagataggggagatttcactcgttttccgcacgcacgcttttcaaactactaaacggtgcgttttttgcaaaaattttctatagaaaagttgctttaaaaaatcacattaatccatttttgaagtttaaatagttaatattcaattaatcatgtactaatgactcacctcgttttgcgtatcttcccaatcttctctatctcattttcctccaacacagccttaagagcaggtacaatagcaggctataagccagctgcaaacatattttaaagagataaaagatgagagagaagggcaatgggctacagatttgtagccagctgtagcacggactccaagacgcagtgtatgtatgacaggtgggaacagatattaatagtgtagtatataactattgtatgaattggctattaagttggctataagtgaattggagctagtaattgtctatactattaaacttgctctaagggcagttccaacccatagtgtccataagcagtgtctatgatgccatgtcaataaaacatcacaatagaaactacactctataacccatggtttcttaaaattggtcattaaaaaatacatcatatctcttctctaccaatcatatttattcttcatctattatgaagacactattctcttccaatgcaaaacttgatagtgtctagtgtataggttctcatgttgaagctgtcttgcatgagacccaatttctttctctcttcactctttctcttagttaatatagtgtcacataagctaaaaatcttacatggcaatgtagttaatgccatagacaccgtcttaggtggggttgggactaccctaggcatatccatgcgtcaacttgctactagcatttacaggtttaggacctttgatttgttggtgacagaacccaaggcgcttggatcagccaccgggcatcgatcagttgatcatcaaattaaaatttcagttgattaaaactacgtactaactggtcgtaattatattaattactcctaactagtatactatatagttatattagcaaattaattaaggacagcaatcaggggtaaggacagtcaatcgtatcgatcgagtgtatatgcatacgtgcgtaaattaagctagcatgtatgtaggtaggtactgtagctatatactgtataagtgaagtagaagtatatgacatattatatagatagtggtagtacatgtatagagagagagagagagagacgatcgatatgattgattatgcggcggggcgttggtcatcgtcgtcgtcctccggcggctgcagcttctggggacgaggggcaggctcggaggaggcgccggcgacggtgaggtactcgagcgcggtgacgacgtcgctgatggcagggcgcatggtggcgtcctcctggaggcacatggcggcgatggcgagggcctggtagaggcccttggtggggtaggcgccgcggagcaaggggtcggccatgtcggcgaagagcttcttgtccttgaagcgcggggcggcccactggacgaggttctgctcatcgtgagggcgggccatgtcgatggcgcggcggccggtgatgatctcgaggaagacgacgccgaagctgtagacgtcggagcaggtggtgagcttgccggtgagagcgtactcgggggcgcagtagccgtaggtgcccatgacgcgggtggagacgtgggtcttgtcgccgacggggccgaccttggcgaggccgaagtcggagaggcgggcctggaaggaggagtcgaggaggatgttggaggccttgaagtcgcggtagatgacggggggacgagctgcgtcgtgcaggtgctcaaggccgcgggcggcgccctgcgcgatgcgcatccgagtggtccagtccagagccgcggcgccagggggcaggtcaagcaggtggtcctccagggagccgcgggccatgtactcgtacaccaggatgcggtggtcgccgtcggtgcagtaccccagcagcgtcaccaggtttgggtgctccgccagcaggctcagcatcagcacctccacaaggaactcccggttcccctgcatcccgttccggtccagctgcttcaccgccgcctccgtcaccgtccccttgatgctcagcctcccccggtacaccggcccgaaccctccctcccccagcagcgactccgccctgaacccgcccgtcgcctccgacagctcgccgtacgtgaacgcccgcgccgtcaccttccccttgccgatcttcaggatctcgtccgccacgcgcttgtgccggtaagtcactgtccattcatttatccatgaaaatatacaatgtttgtttctttgtttgttgtattccgaaaatgtaaatatatggagtagcttagctaactaactaggagtacatacgatacctgactctgccacgatctcgttcaccaggttcaccaggttgctgttgttgtccctgctgctcccgcccaggctccgctccgacgctaaattcttcttcttgctgctgctgctgctgttgctgcagccgctagaggaggtcgagggaggcgctccgtcgccatcgccgtccccgtcgcctcctctgtcctcggactggaagcagcagaagatgcccattatatttatggtgtgctgggccctccaccaacgccaacaggaacgaatcctggaaccagagggatgatcctccaactctgctcctcaaccagcatccggttccaaactgataaggcctagccagccagccaccaatctgatgatcgatgatcgataacaaagggatgtataattttaattgagattatcaaggatgatcgccggacggcgagcttgtaccgtacgtacaaactgccgacgagcgaggcgcgcgcgcgcgaatggaatggggaaatccgattgcttaataacctttctggcattgcccattggaatggatggggtaaattaattcgtccgttattagtttattattattatttgttccgatgaaaaaaacaaaaagcagaggtgctctgtttttttggatggctcctaatctgagccagaaacacaaccaaccgcatgccggccttggcctggcaacgccaactatattaagactgcctgcagttatctatcgatccatgtagtgtacgtagtagtattttatttatttatttattgggtaaatatatatatgtatatattgccagtgcccagtggcaggctgtgcatactgttgctgatgagtggagtagtagttaacttgacagccaatcgatggatataattgaggtttgtatgcaggaatataatggatggaattatacatggatgcatgtagagtaagagtagtagtagctgctaggtcccgacgtagccgaagccgacgatgaaggcggcggccgactggaggagcaggtagatgtagaagctgtcgcggccgtaggcgatgtcgtagagggcgcagtagagcaggcaggcccccaggaggatctcggcgacatggacgtcattattgaagaagcttgtgcggctggagctggtggtggtcttcctcccaggcctggtggtggtattagctggctgctggtgcttggggttggcgttgcctcgcttgtcggtgacgacccactcgttggcgcgggtggcctcgagcaggccgatgagcgtggccttggtccggtgcatggacatgacgttctcgaagaggatccagaagatgaggagatggcaggagcgcggggtgcaggcggcgttgaggagggtgatggcggcggggacgtagagggcgacgtacttggggaggcggacgtggtcggagccggcgaggacgcaggcggggatgacgacgcagtagaaggagaaggtgaggaggtgggcgacgagcttgcggaggaagaagaaatcgtagaggaggtggagcttcttccagggggacacgcgggcggtggggcctcgaggaaaatcttgcggaacaggttggcggggccgcacgaccaccggtgctgctggtaccggtacgcgcgcagcgtgctgggcagctcgttccgcaccccgacgtgccccacgtacacgaaccgccaccccctcaggctcgctcgcaccgccaggtccatgtcctccaccgtcgtccgctccttccaccgcccgcctcctccagggctcgcacccgccacacgcccccgtgccgttgaacccgaagaagccgtggcacgccgaccccacctcctgctccacgcggaagtggtagtccagcgacatctcctggatgcgggtcagaaggcactcgtccgcgttcacgaaccgccacctcgcctgcaccagcgccacccccgggtccgccaccagcaccggcactgtgcgcaggaggaagtcggcgtccggctggaagtctgcgtcgaagatggcaaccaactcacactccctcgcgtacgccttccgcagcccctcccgcatcgcccccgccttgtacccgctcctgttccgcctgttctcgtaccttatgctcacgcccttccccgcccatcgcccgcactctccctccaccatctcctgcaatccattatatatatgttctctaattaatttcctctttccaaattactagtatatactgtatgaaacacagacgtacgtacccttatggctggatctgtagagtcatccagcacctgaatcaccagcttgtcagatggccatgtcatcccacacgcggcaccgatagaaagccggtaaacctgcgcattgcaccgtacacccctgttttattaggccagatcgatttggtaaaaccaactcttcatatatatgcacattaatttcatgttctgttctggacaatatactagcactatataattactgtggaaattaacatatattatattaactagcgtagtggcccacgcagattgcgcggctagcattattatattttctgtcatataattacatatatgttttctcaatgtattattcaaatatattaaaatgaaaacattattttaaattttgtactacctttacaaaactactaatgtataatattcatgtataatattcatattgttttttatatacatgttagttattaattatttttaatattaaattttagttatttgtaaattatattcctatatggactttaggctcttctttcaatattatttatttttaattctgaatttttattatttctaattgtatttctatgtggactctaaactcatctttcaatattctttaatttttaatttcgaatttaagttacttctaaattgtattcttatattgactttagactcctcttcccatgtttttttaattttgaattttagttatttataaattatatttttatatgaactctaaactctaattttaattttattatgtttattctgaattttagttagttttaaattcttatatggactctatactctacttctaatattccttatttttaattccgaatgtctattatttcttaattgtatttctatatggactatatactctacttctaatattccttattttaattccgaatttctattatttcttaattgtatttctatatggactctatactctacttgtaatattccttatttttaattccgaatttctattgttctcaattgtatttctatatggactctagtcttctcttccaatatttcttattttttaattacgaatttcaactatttctaaattatatttg

SEQ ID NO: 59641 - DNA, 1255 bp, Oryza sativa
aattttgacgatttgagtatgccaatcaaactaatactcaccaacgagcttgattcccaattccacgtaaagttctttaggtgattatatatgtatatagatcgaccgagttcatgattagtactagtgtttagtaaataaatttactaagggcatgttcaaattgttttcaaaataaaccttattaaattttagcaagttgacatattactaaaataggatttttttcatgcatttaccaaaattggcaacaagctaaacgtagacatttttttaacaacttttttaaaaaatggtataattaaaaatggtatcattctgaacaacccctaacgttacttcataaatagaactctcttgatcaaccaccactactccataagtagaactctcttgatcaaccaccacatgtcataccatatactccctccgtcccataaaaaacgaatatatagaactgaatatgatatatcatagtacaataaatctggacatatatatgtctaaattcgtagtattggttttttataggacctaaaaagagtagccactggtgcgactgcagagcagagaggcagagtggtcaccggcgcaacgccgtgcattcatcagcgccactagtgcgagtgtgcgactgcaaagagccagagcgatgatgatggtgattggccttcaatagtcccaagatgagaccgttttaaagtttccggatccatctcaagatcctagtatttagtgtatgaattaaatgaatcgtaatagcacatgacctcactgctgccttcacccaaattatttgtttgcaattactcctacttgcaaggagtggtggaacgtatacatctatgtttctattcggaacaaatacgaattactccctccgtttcaaaatggttggtatcgttgacgttttagcacatgtttgactgttcgtcttaataaaaaaaatttgcgaaatatgtaaaactatatgtgtacataaaagtatatttaacaatgaatcaaatgatataaaaagaataaatagttacttaatttttttaataagacgaatggttaaacacgtactaaaaagtcaacggtgtcaaatattttgaaacggatggagtacctctctaaactatcacggttgctcgatttacccccctcccctaactataaaaccagacattttacaccctcaattgtttatattggacaaataacccccctaaacactgttttgagcggttttaactggagcgtgcacatgtga

SEQ ID NO: 59642 - DNA, 523 bp, Oryza sativa
aataaataataatttcaaaaaattttgaataagacgagtggtcaaacgttacaagcaaaaacttaaaaaacttaaaatcctctcttatattatgggacggagggagtactatcaaaagcgccaagaaatcggttttttacattgacatgctacacgttaattgagaacaagggtcagcaaaagatagcgccttctctttcataacaagtaaattcaaaactttgcttccttccagtaatatcctcattcaaatggcatagacacacgaagaaggaagcaaacacatctcttggatctcgataacagtaatatcctcatgaggttggtacaaaactttgaagtggttacaattagcacagctcactacagcatttgtttcaaaaggctactacagcagtattcttggccagcaagttgaacagtgaaacattccccattttttatgtccgtgccgatcagattcttggtgctgcattacatatcgaaatgtgcctcaggttaaaggtaggagatgattaacata

SEQ ID NO: 59643 - DNA, 7198 bp, Oryza sativa
aataaatctagacatatatatatgtctagattcattaacacatatatgaatgtgagcaatgctaaaatgtcttataatatgaaacggatgaagtatatattttcatccctagagaggataatctcatttttcataagatagatcaaatatatattttcaagctgggaaagcatatattttcatgcacttcaagtttatattttttgataatctcattttctcaatacacaaacatgtaagttcaaatttaatttctataaattataacaaaaatatcaaataaaattgtggattcacatcaactgatttcagtttaatttattattttttacaactcgtagaagtcaaatttgatcttgcatatattgtaaagtgatatgtctcatattaatttatcttatcaattttttttaaaaaaatatgactatttagatggtaagagatgtctcctcgatggataaaaaacccatcttccttagatcttaaaatctactttctgcatgtgcttttgttagttagtgcatcatatgtgtctattcggtcgtttcgcacgagctagctagcgatctaggcactacaaaaattgatttttgcatgcttctaaaggtgcgtatcatggtgctttctctgtttcatgctacaacatgttttgatttatttatttgtcatctaggctcactagtgttcatataatatttttagatgggatacatccatataaatttggacacaaacacattaattcatatataaatatgttcaaaatctaaagtatatattataattaatgtgaaatagataaagtagttgtttagaaacgaagatcggtacggctgggaagcaataaaaccagaaaggaaacatgacagtagtgatgatgcgtgggccaggcgcaatcaatggagattttctgcaatactgctggtgcagtagcagtggctgacgtgtggacccggaaccatatgtcagtctctgctactacatcagcagtactgcagaggatgtgcatctaggcgcaatatatgtatatcatcgttaagtactagtttgtttcgagatgtaatgacgtgcactcctatagttgacatatatactgttgcagtgccatgcatatattataaatgcacttttcatactagctagctgatttgttttgcgtgtatatataattaatttcttactttacattagacgacgtggacaggcatgtagtggaagcacggagagcaagttcagcatgaacgcacccactgaccatgcatttgcgcgaactaacaatgtactacatgtgaagttcgttttttttttaaaaaaaaaagaagaagaggaagaagagaagaaatcaggcattttgcatgaggaatagaaaccacaggcgcggcagcgcgcagctgggggatcgccgccgcggccgaccgcaggccaagcttgattaattgtacgttctggttgctcgatcgcttaattaattagtatatatgtgtgttaattaattaatgttacacatatgcattgctgtttcccagcgtggtgtggtatgtacatatacaagtgtaggcggctaggcggtggcagtgagagatggtggatggatcgataggagtaaaagtgttgggtcgggaaaagccaagaaattaaagaggacgtatatacagtacagtacagtacagtatagcaagaggtagcacgcacagattactactgacctgtttctcattgaacatggggatctgcaccaggaccatggggctgttggccgcctccgggtcctgcagcagctggtcgttttcagcgccatcgtcgtcctgctccctcctgttgctgcggcggcggcggcggcgaatcagccacagggcggcgacgacgagcgccatgtagagtcgctcgaggaagagcatgatcgacatggcgacgcagacgtagacggccagctgcagcgtcggcaacaccaccccgcaccgcactgcccgccatgcccatgccaacccgccgctcatcatccggaccgacctgcctagcttgatcgatcttacttaaattaattaattgatcaacgtaccagccgatcgaatatatcgatatacaggagtacagtatatatgatcaattaatcgatatgatcgatcagttccccgggcgcccttcgacttggatttgaccgcccaggagctgatgacccgcctgttctatttctatacatatgagtatgtatgcaacattattaatttgggatcgatcgatatgatgtgtagtggccggcctagctctagcgctaagctagctgcgtgcacatatacatatcttgattgagcagctagctagcttggaattggtatatatagtgatatatatgatcgatccagagaggaaagctacagaaactgctagctactacttaattaattaaagttttcttaataaagggaaaagggtctcctcctttaatttgtgtgtgcatgtatatattggccggtcagcctggattcatgcatgtttttttctttaacaatacgcaaaccagccggggtcctcctcctcctgttttcaatacaaaataatgcgtattttttcttggcctgttttgctttatttgctggctgcctacgtggtatatatgggtacagcactagagccaggtcagggccggtgcatatgcggtgaggtctacacgtatctacgtacatacgtacacctttattgtcatatgtagcctaccattgccatacagctaggtgcctactcagaagacatgtttgagactgctgctacctactacgtccgtcctaaaatatagtaacttttggctaaaatttagacacatagttgtccagatttatagctaaaaatacttatattttggaaattcgtcctaaaatataataacttttgactataaatttagacacacagttgtccagattaatagctaaaaatgcttatattttaggatagagtgagtataattctcatgtaagcctcttcataattagtacacgcacgcatcgatcgtttccttcacattatatatatactctctcacaagtcagatccgttctccccccctaaaaaaaaggaacatgcatttgtttaattaatctctgtttaaatctagagttgaatttgccgttatactaaatacgggatacctcaaagatatgcacatacatcaaagaagtaacacttacaacttctacgagaagacaaatcccttaaacaagagatggctagcaacctcactctagccagcccgatccaaacagctagcaggttgagaaggtcgcagatccgatgcaactgatgacctcctcgcttggtgatgcggcggcaatgattgcggtggttgtggggaaggggagggaggatggatcgtgggaggggaaggaatgcaagggtcgaaggggccgagggacttactgcaagctaacttctccttgtttcatacattccaatttatttactgaattaccacgattcatgttgtgaaccgacaatgatactgtcatgtatctggtgggctgcatgggctgctggagaaatgggcttggcctagctcacatactgaaggtgcaagcaaccaagaagtataaataccaaccgtggcagtgagagaaggcattgatgaattagaacctgatggctgtggcctcttcttcctcctcttgatttctcctctaatcccctactctgtgtttctctgattccctttaccccctgcttctcttcccaatctctgctgctagttcttccaatttgtatccctgaacttgatatacagagttggagaggatatattgctcctgtgcttgtgttcaccagtgagattcatgtgggatcgtgacagatacaaatttattacggtagtcacccgagtcgcctaacaacccatgcccttcccctacaagggtgatgatggtacacgcgaccgatgtgcaggcatcatgccatcacttgtcactccttactaaatgcgaaattcgcttgtggacgagcacgttgcatcccgtcgtcattaataagttgttgtttccctcgagttacagatgtgcaggctcgatcatcccgtcgtcgcatatgctttcaatagttgtatatagctttgtatttgcacaactttaacctccctccatactaagaccctgtttggatccgaagggctatttaacagtcctttggaatcttgctatttaagagtattaaacgtagattactgacaaaacctattccataacttctaggctattttgcgagacgaatctaacgagatatattatcccatgatttgctacagtgatgctacagtaatcagccgctaattatggattaatatacatcattagattcgtctcgcaaaatagcctaagggttatgaaatcggttttgtcggtaatctacgtttaataatcctaaatagcaagattccggagggctatttaatagcccggaggatccaaacaagacctaaatgtctaggggcttgtatgtacttttttccaaataattggctcgatcatcccgtcgtcacatatgctttcaatagttgtatatagttttgtatttgcgcaactttaacctccctccatactaaatgtctaggggctcgtctgtacttttttccaaataattgaaatgtaaacataggagtagggtgtatttataaataaaaatatattaaatgtttgagggtttattggcaatattatttattagccggcacaaactgggtttcgtgcaaacatcgtcaaaagtcaacgacattatctataaaaaaacagcaaccgagaaagtgttatttgtgcgcctacatttaaataaaattacattatgcattattgtgaatataatataacttgctgagatttattcttatataaagtggctcaaagtatagccagacgatttaaagttctttcactattccactaagtaccgatctaacctttttcttgccatttgtctctctgtattgggcctggtattccatagcccaaaggctcacatgtggagacccacttagtggagcaacctaagcagcgactcgatcaagttggtcgatctctctccctcttcgcttgatccctttctctctccagtcttatcgcgtaacaccatccttccggtcctcagccgcctctttgatactccctccatccctaaatatttgacgccgttgacttttttaaacatgtgtgaccgttcgtcttattcaaaaaatttaagtaagtattaattctttctctatcatttgattcattgttaaatatacttttatgtatacatatagttttacatatttcacaaaagtttttgaataagacgaatggtcaaatatgtttaaaaaagtcaacggcgtatatcggttaaatatgaggaccgcctccgatattgttaaatattgttaaatatgagggagtatatcggttagattggtccacctccgaggaccgctaccatcaccacctaccggaatcaacacgtcaagttccctcgaattcggcctctctccgatatccgtcgctctcggcggcggcaggatcttgggccaatgtatctctgaagcatctaggccccctgtaggatcaaggaggccgactagaggggggtgaataggcggttttaaaacttaatggcacttaaacaaaactaacctaagttgctaggcaaggtgaggtgaaaggttaactaagcaactaagttaagttttgcaaacctaggtgatatgggctcaaatatgtctctatgaatgtaaattgcacaaatataaatgcaataaataaatgagacaagagacaaggaatttttcaccgaggttcggaaactcgccggtttcctaatccccgttgaggcgagcccaactccaccgctcaaccacgaagccaccgcacgcccccttcgtcaaggggtgggcaaggtgggagccggcccacggagaggactacccaagcctcgatcactagggtagttcttccttcactccgaaggtggtgaactccaaaccactcacaaacggcgccgggcctcctccacaatctcctcggagaggtcaccgggcaacacctccacaagccgtctagcaggcggcaacctccaagagtaacaagtctaggatgcttgccaaggatgatcaagtgccacactagctataacaatgaagcaatgcacttggattggcttaactcactctctaacacctcactagataaactaagtgtccaagggtgtgagagctcttgcaagggttcaagataatgcaatggagtgccaaaacctttcccttgttgctggggagtgggtatatataccccaaccaccaaaactagccgttggaaccgaaatccccaactccgtgctctgccggtcagaccgccgttgtgaggccggtcagaccggactactttgtaacagctagttttagccgttacagggcaatcattgagcccactcaacttggtcggtcttaccgtagtgtagtggccggtcagaccgtccacggctcggtcagaccgccgtcggctcggtctgaccggttgcggctctggcggctctgtatcgccaccaaaaaccagaccagtgcaatagactagtggggccggtcagaccggccttaccacgccggtcagaccggctaacaggcccggtcagaccggcctaatgcccatggttagaccgcaggtcacttttcagctcaaccgaccgttagtaaaacggcgatatctcttgactcgggtctcggaatttggcgttcttgtactctatggaaagcttattcaaagggccatccaacccatgaaaaaaccatgcaagaaacacaacttaagccaaggataaagggctcacactccaaaggatatccaccggacatacccacaagatgtcactcactcctattggacatgcccacttctttcttggtttaggacttgataaaaactcatcacacttggctagacaagcccaccaaatgcacctatatgcatatgaactaatatggcacaagatcatccacaagctcccgcttcatagacccctcttgaaagtacgacgactatctagcaaatccggtctacaccaaacaccaagaccgggaaaagactaagaaaatattcttagctacattatactttgccttgcgccatccatcttggggtcaagcttgagtcgagatcaacacttgtgaccatttgattcaaccatgtttata

SEQ ID NO: 59644 - DNA, 630 bp, Oryza sativa
atttagtaccaatttgcttactcccagccaccaaagcagaatcttcattgaaaccaacattcccttgtcatatgataatactttttgacattcttttccctattcgaaagtatgggatgttgcaagctattaaatacacccataaatcaaaggtatctatctgaattatttgaatgagggtgtttggtttgtgcaggcattcaaaaaatcgagttctagccaagtcgaaaaacttacgatgcagcgcgatgtcgtcactgtggagcttaagtcagccaaggagcgtaacgctaatctagaactgcaactctcagaacagataggccgtattgaacggcttctgtcgatccaaaacagtgaacctccacatttcatctgtcctatatctcaggtgagcggaaaacgatatttcaattttcttggttcatgctggtaatactttttttccccctgaaaaacactggctactgtaagagtataatctttgtaccattgtccaatgactgaccataacattacttacatacgtggtcaaaattccaggaagtcatgaatgatcctcactttgcagcggatggacacacctatgaagctgagcatatcaggaaatggctcaacgatggacatgac

SEQ ID NO: 59645 - DNA, 1589 bp, Oryza sativa
ctccggtagatcatcttattttttttagcgtcttggtcttaatttcctgacaactaccggaatcatgtaatcgtgacgcataatatagcacgtaattgggactacgcatcttgttagctacttaattaatttcgatggaatcaattggttgacagaccttcattttgcaacgcaaaatatatttttctcgcaataagcagttataaaattacctctaccaaacagcacattggtcgttgacaatagctactcccatctctatttaatgtaacgtgctaattaaattaaaaatattaaccacgagatacacctgtatctacgcgtataatacagtcctataccaatccatacccgtaccttcccagtaaaggaatattgcaatacgtatatctctctctgtgttgcagttaattttcttttctttaaatatacttgttaatttgaagatcatttcctaatgtaacctgctcgaaatcttcaaccacaaaatacacctattccagctcagacgcataccttcccattaaagatatattacatacttattctctctgcgtttcagagaacaattccaaatataattgtttctttgaagatcatttcctatctaatctaacctagtagtgaaaaaaaattccagccataaaatatctgtattatacgcatcctcagttctatgcatctcagccacaaaccttcccatcaattgaaaaacaatttttttatatgtaaatgaagtaggaggtctgtcccttttattttatacctagaagggaacaataaagaacaaactattctaagatataccatcacaataccagtagtacatatttatctctgtatttcacggaattatacttccaaatacacacatgttactatcgagttaatttcataatgcgttgcagccttatcctgcgatcaattgattacacgattaatttagacctaaacgcagcatttgtcgcatcgggtcatgagtcatgacgcgaggccagcgacgtaattacattctaaactttgtggtattttcaccaatatattttccgtctgaccttcgcgcggcctgatcccctcacggtcgtcgtcgtcttcttcccaacgaccgatcgatcgatcgatcgatcgtcgcggcgagaagggagatcgatcgcgatcggagccgatttgatcggcggcgggcggcggccatggccgtggtgctcggcgcgttcgtgccggacaccgcggcgcagtggcgcagcgtggtgaagggggaggtggcgcggcagctgggcgtggaggcggaggcgaggaagctgggggcgaggctggagaaggtgggcgccgcggtgcgcgacgccgaggcgcgggtggcgcgcgggagcgacgccgcggcgcggtggctcgccagggtgcgcgccgcggcgtacgaggccgacgtcgccgtcgaccggtgcagggccacggcgcgccgcctgacgaggggccgggagcagcagctgcagcagcataaccaggtgagatcgctagccttgaattccgacaaaagcaagaacaccttggtgacaatggcgtcgcagagcagctaatttttgtttcgtgttgtt

SEQ ID NO: 59646 - DNA, 2273 bp, Oryza sativa
tcgtgaggtatttgtggctacatacgtataataaatcgatcgatcagttccccgaatgtggacgtgcgcaataacgaacatgtaaccgtttctttttcgggacttgtcaatgtcagtcgagcaatgcattataacctcgcccccaattatcacttgtagtccccggacagagagaaacagccgcacatcaacgtcgcttcttctgtccgttcctccgtgccatttctgagtggattgcaattttacgtatgttcttcactcaagtacagtgtaatatagaacaaattgaaaagagagaaaaaagaaataaagggctaagacgctgaaatgtagtggcccgtgtcctctggcgctgacgaggggcgcaaaaaccgggagagctcagccaggagataaaccaaaaaaaagctacaattatactactgtgcgagatacttatttaaattcacgaccaacgtttaatcattcgttttatttaaattttttgtacaaatatgaaaatatttatgtcatgtttaaagaacatttgatgataaattaagtcataataaaataaatgataattacataaatttttttaataagataaatggtcaaacatagaataaaaaattaagggcgacatatattaaaatatggagatagtaataaagaagaaaaggactcgtcgtcgtcgttgtcgacggtgcacgcgatggacctggacgccaccacaccaccactcgtcccgtcatctgctgtgtggacgagacgacgcagatgccactacgccccccaaaagaaaaaaaaaagaagcactcgcttttgtgagagggtactccgcgcgcgcgtacgtgacgacgtcgtttttccggcggcgcggcgctcgcggggtcggcgcgccgacgaagagacgtcacggcacggcgcgtcgcgcgacacgacacgactcacgagcgtctcggtgtgcgggtagttttttttcctctctccctctggagagatcgcggtgtgaaacctggtcggcactgggcgagcggggtggccacgcggtgcgagggaaactcacggcgttttttttacccacaagcggaggggatccactaattgggtgcttgtgtgtgctagttgtgtgacgaagaaaatggagttttccattaaaaaaagaaaatggagttgttaacttaacccttctttcaacagaaagtccatataaattttgatttattaaatatatttcgtgatttatgttacatgtactttttattcaactccaacaactttcttttttttccacatacataataggcaaaatttgctacaggacattcaaaatttatgtaattggctggaggacaccgtaagatcgtgtcattgccgagagacaccaaaaaatagtgtaattggctataggaatattattttataattttcgagtaaaaaggggagagagaaattaaaaagaaatacaagtttgcccctgccttggcctgagcatcagttgattttcgagtaaaaagggactttctgcttctgctcgaaaaaacaaagcgctggtttagtgatccgcacgtattcaaccaacaaaagatgatcaaataccaatcaatacaatgtaaaaaaacgcgtggacatacgtgatgtaccaggttggccgtgctgtgtggatgaacaaatacaaatcaatactggagcttcttgcggatgctaccatagtcgttgccgtccggctcgcctgaccgtccgccgacgacaccatctcaccgttgatctcctccacacactcccacttcaccgccacgccgacggacagctatataatgacgcaatgcgtagggccacggtcaccgtcgcagctgcatctgccgcgtttgtcaagcatgctcaggatcagcgatggctccagcgcagcaatacggccaccacagtgtgccgtcgcgttggtctcctccaccgctgccgagggacaggcccagcgccggaccgttactctagtggctgacgtccacctgtgcgggccgcccatcgcagcaggtcactgctttgcttgcactgccactcgccaccgttgaagctgccgtcgcctcctcatagccatggggagaaagggtaatcaggggtaaacttgtctttttaaaaaattctctctctactttgccttgaaaattataaaataatgtgttcggcgtcctgtagccaattacaccgttttttgatgtcctttagcagtcacacaattttacggtctcctatgaccaattacacaaattttagatgccatgtagcaaattttg

SEQ ID NO: 59647 - DNA, 683 bp, Oryza sativa
tgctgcagctgcagctacaccacggctgatcgtatcagttcagggcctaggttccgggtgtacagaagtgggcgaggccagtaatcgtcatggtgctgtgcgggtggtcagatgatgtgcttgggtacaactgttttcttcttcctgtaaccgatcaggattatgccggatgtgttttggcactaatggcggctctggcaattttagatgttcacaagaatcccggtttttttcccatgtttgatttcctcgccactacaaactgacgagaattggcaacaacgctttgcgtcgatccgtccacggatcagagacgaactacactagatgaagctaaaacatgaaatcaagaaggataagcttcacctccaaatacggggcagttgaggaggagcggcaccgaggcctcgcgccctcgccgatgattgggaccctgtcagatctgcggccaccggtcgccggctcgccgccgccatctctctctgatctccaattgagcaaggcaagttcaaggcttcgagaggctgtgggcccgcggccgaggatgaggacgtgaggtgatacctgggccttcatagatagtacagcccatatgatgtggcctgcacctgtaattccatgactagacaatcctgggcaaaatcttttaaaaagggaataagtccacatgatgaactacttgc

SEQ ID NO: 59648 - DNA, 5750 bp, Oryza sativa
cctttagtagatcaatttccttaaccgaatatagcaagaatccgacaactgacgacttgacaactctcatcggctaatctcaggacttcgaagccgatgctgactctaagccgatgactacttcgggcttgccaaatttcactgttaacacattggtaagtggtactaagcagtaacacatctcattgatgttccttatctcaggtagccctattatgctctacttcctcgtcaatgttgtccctcttacgctacctatgcacctcaatctgctgtttttttcccaaaccacatcactgccatttactacctccgttacgtaaaaaaccaacataatactggtgtgacacaccctagtactataaatctgaacaaatatctgtccagattcatagtagtagtactagaatatgtcacatccggtattagattcactttttatgggacagagggagtatatatcagtgtaaaatggaaatttgctaattccggctactccatcatccttcacaaaaaaatgagctataaaatattgggaatgtgtcttctggtcattagattgtttcctagaaaagaatcaaccgattccacgtttgcaatctcttcaagatcacccaattaaaccgtgcaagcacacaagaagatcagatcaacactgttacgtagacgtcacgttagcgaaactgtcatctaaaaccatcgagagagtcaaattgcaccagttttaatagttgcgggtcaagatatccggtattgcggttcaaaatacaaactagattcggtcactagttaagatagacaaactgaacttattccattttcagaggaaaaaaatattccaattgttacccacgctacgggcccatcccacctctcaggaatactgggcctcgtgtcgtgccaggcccaatacgcgtcccctgttccaccaacctcctctcctcagatgccacgtcacacactgtcacacacaccagccaaaacccgccgctaccgatcgcgctctccagatcgattcccccaacatattagggctcacgcctcccaaagtcaaaacagcccagcccgaacaagcatttcctcgaacacttcgccctccaccaccatggccgccgccgcctccaccctcgcctccctctccgccaccgcggccgcggccgccggcaagcgcctcctcctctcctccccctcccgctccctctccctctccctcgcctcccgcggccgcatcgccgtcatgccccacctccgcgctggcatcctctccgccgcaccgaggagggcggtgtcggcctcggccccggccgcggccaccatcgcggtcggggacaagctccccgacgcgacgctctcctacttcgactcgcccgacggggagctgaagacggtgaccgtgcgcgacctcaccgccgggaagaaggtggtcctcttcgcggtccccggcgcgttcaccccgacctgcacgcagaagcacgtcccggggttcgtcgccaaggccggggagctccgcgccaagggggtcgacgccgtggcctgcgtctccgtcaacgacgcgttcgtgatgcgggcgtggaaggagagcctcggcgtcggcgacgaggtgctcctcctctccgacggcaacggcgagctcgcccgcgccatgggcgtcgagctcgacctctccgacaagcccgccggcctcggcgtgcggtcccgccgctacgcgctcctggcggaggacggcgtcgtcaaggtgctcaacctcgaggagggcggcgccttcaccaccagcagcgccgaggagatgctcaaggcgctctgaagcgtgaacaactcaagccatcctccacttttcatctcaaatctccatagctcggttcgttgcctacttctctcaagtgttcgcttcttttcctgaataataaatcatgtaataaatcatggcaccaatggtggaccgtgcagagtagtgttgtcgttttgatgtgtgaagcttctatagcgaacatagtgtgcaatttttaggtaacatatatgagtcttggccttgcactgtttgtcaggtagtaacaacttggcacagctatagactgtagtaacagagttcctttcatgttgaatggtgaggctgtgatgtgttctagagctgaataaacgtgctctggtaaatactgtcaccagatcagactatggagtagtagtaagattttgcttggttaattgggcaatggctatttttcaggatcgttcagttgagataaacatgttttgctgttcagatgagttcgaaatgccgttgtttgttctttttttaatgccgaatatatggtgagagattcagcaagccaggggtcagatgccccttggcatgaaacaaaggctcttcttgcatttgctgacagtagtcactagtcagatcttatttatgtatggatttctcaaaatttgcccatttcaccaaccctactgaaaagaacagacactgccgagtgtaacacatgttttaggcatctcgggaaaattcctcagtaatgcagtgtagtgcactttggcgactttgttataatgctttgggtgaactcgttgtttactttgttagttgcgttcatagaggtttactgtcggtgatatgggcccgggggtatcatgtttagaggcccagagattggacggaggaggctgccccccaatgccacgtggccctcccccgaggggagtgaggcctgaggtggggtggcggccactccttcccaaagactagtcggaggaggttgccccccaatgccacgtggccctcccccgaggggagtgaggcccgaggtggggtggcggccactccctcccaaagactagtcggaggaggctgccccccaatgccacgtggccctcccccaaggggagtgaggcccgaggtggggtggcggccactccctcccaaagactagtcggaggaggctgcccccccaatgccacgtggccttcccccaagaggggtcgggcccgaggtagggcggcggccactccctggtcgagactagagggggaaggctgccccaggcgccacgtggccctcccccgaggggggatcgggcccgaggtcgggcggcgaccgccccctctcgtgactaggggtcgggctcccccaaccccctctctaggtcatcacgtacggtgggttaggtgtccgcctataggtgtccacttacccgcatttatggcgacccgagcggtcgcgccacgccgcatttaatgtgccgtgcagtatactcaaccggtctgtgaccggtcgaatcaccgatgagactgggtagtgcgcctgtgcgctgctcgtgtgtcaggcggcgtgcagcctaacatgtcctatcaaataatgatggtgagaggttctcatcctcttatcccagccggagtcggtcctcccgccctggtcaaagctaggctcccgtttcccggtgtaataggagcccggaagtcttcacccattaaaagcagctgacatgggcgcccctcgtgtcaggcggcaagatttgacaggccccatcatcaagatgacgtgcgcttgcttcccaagtcaagagataagacaggcatttaatgcaaaacacttctttaccggagctaggtttttgggcccatgtggtaaccccttgaggtatgaaaggagatccaggcctagtaaaagggggagggatccgggacgatccattttgatgctctagagcagtctctagccccgaatgatcaacaccacattttacttcaacaagaggatcttgtaatccttcacttaaggagcatagcacaggagtagggtattacgcttcttagcggcccgaacctgtataaatcccttgtgtctcttttgcctcgaaaacctcggatctcacccgctgcccccggccaaaccaaaaaaggggatctcacgatctcccgctagagaggatcactcctcgacatttacattagcatgccgtgattcaggcctccgtgtagactacttctgcattcttttctccacttcaattgatgaaacgaaaaaaaatcctatttatctctttagttattgtctgtccgaattaccctcctcaacttcaatacaggacattataccaccaaacttcttaaacctaatgaactaccctttgatcccagtccatgtaattttagccctacctggtagacactcgacagttcagttagcaaggttataaagatttcaaaaaaggtatagttgatcccactcgttagtctcttattcctcttaattctctctcaactcccccctctccccctcatggaggtgtccctagagtttagtgccctagaacccatggcagggttggagtacagaggtactccctccgtccaaaaaaaaaaagacaaaccctgggtttccgtgtccaactttgactatccgtcttatatgaatttttttttataattcgtatttttattgttgttagatgataaaacatgattaatattttatgcgtgacttatctttttaattttttttataatttttttaaataagacggacggtcaaacgttgggcacggaaaccagggtttgtctttttttttggacggagggagtagctgtgtagctcggtgtcgttgatccctgtggacgagctgaagccccaagcagtggcacttgtgtcaacatcaatcctgtcggaggaggagcttcatggcggtggtggcgcatgaatgggggtggttctaggagagactgctttaggaggggagcgtagttaggtggtgccgacatctacatgtgaggatggatgaggggagcgcaaacgccggcattgccgaggaggaaggggaggcgaggctgatgggagaagaggttgcacatcggagtacgaagaagaaagcagagaggaggaagaagactaggaagaaccgaaggggcggacaggtgtgcccattgtcattagggtaccacaataccttgggagtactgaagccaccctggagtaggcggtcgatgggtggggctgttcatccatgggttgaaagaaacctgcctaaccggccgtattcattttttctcgtaccatatgattatgaagtgtgttaatgtgttattggtacctagacgctgttctagaagacaatgacatcgatgctcatccgtgcgttttgatgtaaacccgtgcttttcttcagctaattttttcttcgctgccttcgctgcacaaaggcagccaggacatgggccttcatgggcacgaaattggcgccctttcatccctggaagacaaagtagacttattcctttatccagcagcaatacgaaagcccattaaaagatcagcccaaagaagcccacacgaacaggtataggtgcaatgcaatccacctcaaccctaatccccatccatttcctgccgccgcactcctgttgcgcaatcgcgtgagtaaacaacaggtagcgaccgcccaacgccgctcctcgcgcggtcgcgcccaacgctgcgccgcccattaggccctttacagtgcaacaccgtggaccggtgctccagctcgacacgtcggattcgagcttgcgtggcgctagggtccgcgccccagcagaggacctcgctcccgcggagggaagtgcgattactccctgccgcgagcccacgcgaggcgaggaaacggcggcttttctgcgctgtggagcgcgttgccccgcccactcgtgccctcgcggcaacaaatcaacaaatcgcagcagccgtcctcttgcttatgctcctcctcctcgcagcg

SEQ ID NO: 59649 - DNA, 1685 bp, Oryza sativa
tttttcttctgtcgccatggtactgctacaacatgttgctgttactgcagtccgaagcagcaagccgctgcagctgcccaagatgcagccgtgctcgccgatgttgtttgccgcagcttcacaagcctctgccgtgctcgccgctgctgcttccgtagcgtcacaaactgccgccgcgccgtcacgccgtggccgcccgccttgctgccccgcaaaatccatccccgccttgctgccttaccatatcctactttattgcaaccaatttttgtttgatttgctcttgatttggaagaagagatgagaggatttggggatgtagtagggttcgaggatagggaagggaatcggccaatcgggacctgcctttctgggagatgggggcttctgcgtgcgagaggggtagggaggggggcaaaacggtcttgttgtgcagctttgtttttcacattagttttatgaattatttttgtcttcttatttgcactagctcaaacggtaatggtaaacggaaggtacacatcagttttaatggcaaatttgcagtttgcgtttttttaatggctatttcgaattagagggtaagagtagtggtatatttgcaattctcccaaatatatgcatacaaataaatatacaagagatgcaagtgtatgaataattagagaatgaccaatgggggtttatcctatacacatagagaaggcatatgtagtaatgatgtagaccaacataaaacacatacattcatgatctccatgttcttaatgtaaatgagactaaataagatacgactcgagtaaaaattaatctcacacttatatatcaataacatggaaatcatatatatgaacctatcaaaaagtaggagataagaagtggtacacatcattttatctccatacatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttaaatcttttctctctttggtgatgggtaataacccgatataaacaatatagagagatgagatgaaagatgatttcaaatcaagatagaaatcttataataaacaaaatatagaataagctccccctcaagatgtgcatacatatggatataaaggaacacatatgcacataatcaatcaagatcaatgagggctctcacattatattttggatccacaagagagaccaagttagaatatgtgaagtttgatacatacctctcatcatttttattttcatatccaaatgagactagtcaaagaaaggctcataaaaacgttagtctcatataattagatttgtcattaatcaccaaaaccaaattaaggcacttgaacttacacccccattgttaattttggtaattaatgacaagtactaattgtggactaaccattgtctttgagctatatattttttgagttaggttcacattatgtgtgtgcgcatgagtgactaccgatggattaaaattgatggcgcgaagcgaagaaaagaagacggtaaaactagtgctttagttttaaattgatcgaggtgtaggggcgatcaaattgcttgttta

SEQ ID NO: 59650 - DNA, 7062 bp, Oryza sativa
gccctccgcgccctcgtcttcagccagaactggaggggccgtccttcgctgccgctcggcccggaggagaggagagccagcgccggcggagggaggaggggagagagccggtgttgagactgagtagtagttgggggatttggataaagtagtatttgtgggtgaagatttacattgttctctcgattttagggtggttactgtaaaatttggactcctttgcaaattgataaacacatgagggctgaaatggaaagttacaggggctgaaatggaaaagtaagtcactcatgaggctatttgcaccgtgggaataaaaaaacttgaatccgggtcttcagcctatgtggaatgggatgagggaacactgcactgtgaaaagccttagttccttgcgcccagcgccgcaccgtgttgctgtgccctcagcctcggcgcacattctcctctcctattcctcccgagttgaagcctgaaagggtagcctcataccctaaaaaaagagaatgttcccgtgagtccaagactgacgccttttgttgattccgggcccttagatgcatgatcagatgcgtgatggttgagattgtccccaacgtgcaggtcaagcacagctccaaccctcttcgctgcttcgtcattgccatcaacaagcttcgttgtgttgtccaccatcgttctctttgctgttgtgcatccaacgtgcggggccccgatcgggttccgaggacccgctagggtgagggtgggggcgggagatttcgccctaaactcccgaactcctggtcagggccgggggtggggcgaagaatgcggggacagggccgggggcattctacctccaccaggccccgactcatcccgttgccatcctattcacgtgtcgctatcgtcctcaccgctcaccccattgccatcctattcacgcgtcgctgatcgtcctcaccgctcagtctcttacatgcaaatgaggtggatgctgcaatcgggaacttagtcgagtcgctagatgtggagaaggaagatcgtgagattaggaattcgtggattggggcatgggaatatgttgtaatggttcttttttgaacccccaaatcccaaattgggatcgatgtgtggataccataggtgatgcttaccaaccttcagtttggaggtagtctttaaaaaagtttcgaggtggatagcacaatgtcgtctcgtctacatgcactctttgcaatccatatggtgaacaatgccgtcgtttaactgaagtttcaaaccattgacacgacagttgaaagtaacttcaataatttccaccattagcaaccagcaccgccgaagatgtactattcgccgctaattgccttccaagaagccattgttaacgtgatgagctctacgttttggcaaacttcagaaaccaaaacagtgaagcgttggtagttatccactacggatccgctttggatgagcttatcctgtacttcgaaaggccatatatatagccacatcacagatttccccaatgtacatatcacggaaaacattcagtatttctgatcactggaccatccagaccagttagttttgcgtgccatttcaagactagtatgacgaacctaagtctgcaggccagcaagcacccactgcagcaaaactggttcaccacgtttgtcccttccaatgagaattttttttatttataattttttttattaaaagttttacaaaaataattttccattttgaaaattgacggaaatagtcgcctaccgccctctgggaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacgataggaccgcgaggccgtgggtgtaccggaccagctgaaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtcacacttgctgcagcgtaaagtcctcccacctgcttctgactcatccatatcatttctgatgcgtctagtttggcgtcgaccctttttcaccctaaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttttgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcctatcacacccaattgctgtcaatatctgacctcggtatttacctgtcataaaagttccatctatgcatagaacaggtcgacaatgcacaaaagcattgatgcaagcacccaatgagaaaaaggctctttgcagcacactcttttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcgggcccccgcacagtgcaaaatcgccctcgcggagggcggcagggggccggctgcaaatttcatgccccccctcgccgcccaattgca

SEQ ID NO: 59651 - DNA, 2467 bp, Oryza sativa
accttcggagtgaaggaagaactaccctgagtgatcaaggcttgggtagtcctctccgcaggccggctcccaccttgcccaccccttgacgaagggggcgtgcggtggcttcgtggttgagcggtggagttgggctcgcctcgacgggaagtaggaaaccgacgagtttccgaacctcagtgaaaaatctctcgtctccttgtctcatttacttgttgcatttacatttgtgcaatttacattcctacagacatactagagatcatatcaccttaggattgctaaactagacttagaaagtgtgatttactttcctagtgatagacttgagccactttcaccctaggattgcaaaacttaacttagttgcttagttagacttgttcctcaccaagcctaacaatttaggttagttttgattaggtgtcatttaattttaaatcgtctattcacccccctctaatcgatatctcgatcctacaatctcgcacaatgagaaggggatgactcatgaggggtggcctttgcttgctgacgaccaagaaagatcaagcaacagtgacgctcagatccagaagtccgtggaattcagggtcgatggtgtcctccatcttccttttttttttcgaacacgcaaaaaaattgcacgtcaatatattagcagaaaaagagtttttgttacccaaagcaatcagctagactggcttatgcctaaaaagggaggggggagttgaagctaggaactactacgacggttgtgtcctccatcttcccaatatcgtcttttaccaccccctccccccacccaaatggtaggcgtcactatcgcgtgtaccagacgccagcaactaagaggcaggagacggaagcagggaggcgcagcagggacgggtggtgattggtgaattgctggcgaaaccaaccgaggcaaggtcaatggacgatgccaatgtagtgtttgtactttgcagtgttatttcttttttttctttttattgcgctctacctctaccacattgaataaggtgatagaaagttcaagaacattgtgttttgttgtttttaccaattcgatcgagctatcccctcctacatagatggtacttacttgttttagtggatcaaagcatgtacaatagcatactataagctagctataaacaaatattgagaagataaaggagggaaaagaagagcagtaggctacatatttgtagccagctgcaacacggactccaaagcgcaatgtgtgtatgacacgtgagaccagatattaatagtgtagtatatgtttgtagataactattgtatgaattagctattaaattggtttagatgatttggacttagttgctctcaatcaattgacgtttgggggttttacttttcacatagggtgtgtttagataatagaaaatggggggtgtgatcgtgattaggaaataaataaaaggttaagattaactggacgaggaaaacgaatagttacggtttaaactttaaagatgtgttttggtgggtggaaaatcatttccctatccattagccaaaccctgtcggatcaattttttttaataaagttaagttatatagtgctttcaaggggtggtgctggcctggcccagaaagtccaacacgtggcagggaaagggtgtctctctccaccgccttggggccacgttttagaggaaggaagcccattgaagcacggcatctagtatcttgttgttggaagaaaagccctttctctctctctcattcttgtgtttcttctcgatcgatctctcgatttctctctgtgcaccagcatcagctatggtgtccgacgccagcaagaagaaggcggcgcagaagaaggccgccgccgctgccaagaggggtgacaaggccaaggccgccattactctctccgagcgcacctgcaccgccgtcctcacctcccatcccctctcccgcgacatccacgtaccactatttttctatttcttccatccccaccccccgcccctatctatttatctccccctaagtaactaattaatccatctttgtctcgcagatcgagtccctctccctcacattccacggccatgacctgcttcttgacaccgacctggagctcaactacggcaggtaatctttattatttttttcatcaatcaatcaatccatcatctgtaagtaagtactagtactatagagaccattcatctcgtctcttaggcgatatggtttgcttggcttaaacggctgtggaaagtcctgtctcctcaaagctataggatgccgggagcttcctatccctccacacatggacatctatcatctcacccatgagatcgaggcttccgacatgtctgcgctacaagctgtcatcagctgtgacgaacagagactccagctcgagaaggaggctgaaatcttggccgctcaagtatgtttattttacttcccttccttcttacca

SEQ ID NO: 59652 - DNA, 2576 bp, Oryza sativa
acggatgtttgtacctgatctccatcaactacatctgatgctatagcccatatggtaccactactgtgtttattatctatattcgtcttgttgcaagcttggtagtaactatatatacttgacgctcttgctgctcttccatttgcagcagatgtaccgtcctcttcttggggtctctggagaatgaggaaacagcaagatccagccagcatagcatgtatgtatagtgtaattagctggtttgttggcggtgcacatgcataagatatacttcctccgtttcatattataatactatctattattgcccacattcatatatatgtctagattcattagcatctatatgaatgtgggcaatgatagaaagtcttataatatgaaacggagggagtattatcttggtttgcacttgcatgatcacctgctgtagttattattatcagtgaccaagttcccctagctagcagtagcactccatgaaaagatatctacatgaaactgtaccacccccacgatattatatatgagattggattttaaactcttgaggggatgtctcatcgttgcttgtatgttaaattgagaagatgtattaacatgtgatatatcttattataagcattcaacttaaaatttaacttctacatgtcgcaacgaaaaaacaaatttgactgtgaatatatgttaactagttgtagacatgtagtagtttaatttgtttttttcgatatgtaggagttggattttaaattgcatgttaatttgtttttttcgatatgtaggagttggattttaagttgcatgtttgtgaagtaatacatcacacattaatacatattgtcattttttttaattttttccataactatttgggtgacacgcaaacaatgagggacattccctcgagagtttagaatagttccctattatatatacttggatcgatacctatatatgatttgttcttagtaatgatggtccattattaattgaaagcttggatgacaaggtttagcccaaatgaggaaaattaaatcggtgaattaaacagaatatctagatcgaacctctattctatatagcctatttttattataacaaagaaagtgaaagggcggtattttaaggtctcatttagatgcgagattcctaaattttgtggggattggaccgattccttcaaatgtgctgtagatatcccacgagaaaagaaccaaattaacctactaaatagcctggatttttactactactggagaaaaacaaatcactagattgaatccataataaacaagaaattgcagtggtggatattaacatgcaaaagtaggagcatacacttgtttctttcatgaaaagtgtagatttttcatgatgggatgttgagaaccataataagattacgccagcatggaatttgaagctaaaacaaagggaaagggaaaaaaagtatcagacagacagacagaactgatataaatttaaccagatggaaacgaaatgcatctctgacctcacagaaattatgtatttggggacggccatatataatactctctccgtttcaccgtttcacaatgtaagatgtctagattcattagtatcaatatgaatgtgaaaaatgctaggatgttttacattgtgaaacggagggagtaacaaggatgaagatgatgaacaactaatgtatggtctttgaatagcagaggagcttacctttgaaaagaaaaaaaggcgcttgtctgcggatgcagcatcatcaagattctcagccaaatcggatgtatatgtgcgtcttgtgatatatgcatggatgtgaatcttgatgatgccacgcccgcaaacaccgactctaccgttccatccatggatttactgtactactgagcattgttcgtatcttctactccagagtacagtaaattcaagagatgcattggacacaagggagaagggagagatttgctcttctctagcctcttctagctaggggtttactccaatttgcattgcaggtagacgagagagcactgtcatactatataggagtacatctgtcagaagtagatcgagttaattaaaggagcttaatggtagtctacgtggcacagttggcagcgccagcaagtgcacgaagatgaaagtgatataatatatagtaatatacaccctctgtcaaaaaaagaatttaaattctgggtttgaatttggatatacactatgtccagatttaaatctagagttaggttttttttggaacggagggagtactacttatattattaactactacgactagtataactagccaattaaccactaaagtagagtactttgtgttaattgcccggagttacaaatatgggcaagttggtaaaaccgtaaaaggaaaagctgctgcttggccacctgatgacgtccccgcacaacctagccaaaatgcaacagccttttcctgcagatcaatggctttacttttccattgtccgttttgcagatcgatgacttggctgtgttcgggaggcacccgacacggaaaaccaagcacggattatagtgaaattaattagtat

SEQ ID NO: 59653 - DNA, 19335 bp, Oryza sativa
gagggcggtaggcgactatttccgtcaattttcaaaatggaaaattatttttgtaaaacttttaataagaaaaattataaataaaaaaaattcttccaatgacgggttggtagtctcttatatatatttttttttcgccaggacagcggcaaaggaaacgcctgaccaattatattaagaaaaataagaagatttacataaaacaaccagcatggttgttgtggacacaaacagggtttcccaaactgccggggccggggttaccgcaccccgacggtaagcacggttatcgtgcggtaaccacgttaaccgtgaaaaaccgtacaaaatttatcaaaaattcaaattattttttaaatttatttgaatttaaggaggttaccgcagtatttatattaccgtacccccacggtaagcccggtaactggcggtaaggtaaaccctttacataacccaaccctagaataggaaaaggttttttaccggtaaacgcctaattacatgacacaactaggataacatatgtcttatctctcttcgttcgtgatgcctccaaagccagcagctcaatgttatttacaaatgtattttttttactcggcctttacatccaatcgactatataaagctatttaaattgagaatttagtctcgcaaataatccaatttaaaattcgctcctaacatgatacctccaaagccagcagctcgtcatggccaccattcttccgatatgcactggaagacctcgatggcgatcttactggctccttcgaagatcccggtgtttctgtcgcgaattaaatcatccaagtaatcaagatagtttgtacgtctaagattttctactgtgatgttttgtatggcagcctgagaagagtgccaccaagtttccatgtcagttgacatatccgggctccgaatgaaatgtaatcgggtgcagatcctatcccacacttgtcttgtgaaagcacaggccatgaagaggtgatggcaagtcgttggctaaacaccacaaagagaacagacttgttcttgaggccaacctcgccgtgccaaattctccgccgtcaaacagctcctgccgtcccgcgtagtacaagatactcctccttaaaaaaaaaatatatgactccgttaatttttcgcataacgtttgatatgttctattatcaaagaaaatatagtattaacttatagtttcatatatttatattaaatttttaaataagacgaatgatcaaacattatgagaaatatcaataacaatatactaaatttttgaataagataaatgatcaaatattatgaaaaaaaacaattatgccattcattttgaaaggagatgttacataaagaactttcatttcacttcttaggtaccttgaccttccaaaggaaaattagcaccgatggagagagttttatcaatgaaaaacattggtagtctctatgagagtatgatcattgtttttaattatttatttgtaatagtataatatgtgaatatgttttcatgataaatctactaataccattttcacatatcaaatattttttggttgcattttactagcactaggttcacattttgaattttgtctcaatttttttttcgaaatttgaccacactcattctaaaacactattcaagtataagcatttcttgccttccaaatttatacacggccatttgccctatactacactactaccaaacacctctcgtttaattattatccaattttaccctcaccatcctcctacatctaattacatcatatttaaaactaaaagggatatatcacagttttcttttcataaatttagcctccactaaacaacattccgcaacagatcagggaatacttttggtttgacaacacgacgagtaagaaattaccacggcaccactacgacgacgcatcccactgtaccactcgaggaccgaccagaccatcttgcgtgcggatttctcacctccctgcagactgcagtgaaggacaagatcttcacggctgcagagcgggtaccacccaaatcacaggaaccgtacatctgcctcatatcagttacccatagcatagcttattaagaaatacaaattaatttattgttaaaattgttgtatattttttttccgtagtaacttaaaagccgatattaaaaatatcttaaaattaactttaaaaaaattaaattttagttttaactttagtttattaggtcaaccaatagggcgatcgaccaaaaaagagaagccactctgctctggcattttgcctgctggatcgtcgctcccggccataacgggcaaacggacagggcttactacaaaagcatttcaattttgaagcgagggaagcaagcaagcaaaaggatggcactcatcccgtccactcagattcaatccatgcatgacaccgtcgtagctttcaaatatgagctcgcggttacctagttaattaaaatcaacttgtattaatgttgacgcccttcgatcatttagcatatacgtactatacatgtatctaagataggtaaggtacaacatatactgtgcataaccagtggcggagacaggataaagttatagcgggggctaaactaaaatgaccaagaacaactaagagagatttagggttgggttaggattttttagcctttttagtcttttgggccttctaacaacctcaaacaaagtctatattagcccctcatctataaatatatggattagaattttagagggtaggggggtttcaagaccccccgcccccacgctgtctctgcccctgtgcacaacgctttggagaagttgcaacatgcacaaaacccattgaagtttggtttcatggtatgaagtatgcctgttcaaatatggcttgtttttggttgcaatgatgatgaagttactaaggctgggtttagtaatctctctttccatcttccactcaccagtctttcataagcacacttttactaaattactaaacgatgtatttttaatataaaaattatataggaaagttgtttttaaaaaattatattaaaatttttaagtttctatagctaatatttaattaatcatgcgctaatgtgtcacctgttttccgtgttagtgagaaaaggttccaaaacctttagattctaacgcatcctaagggtttcaatggtgcaaaagaaaagacctcctacaacatatgtaacaagatcatccaaagggttgagtcttcttagctactccctccgtcccaatatactacaacctacccatataaaacaaataatagccaaatataattaatagccaaatatacctaattaaatctgatatatatttgctagattatttctataagaaagtgtttgctagaaatttgctaaaatcgacaaataaaggcaagtgcggcggcctcgcgctgaaggtgcttggatggtgatgcctgctattaatggtagggacgtaatcataatagtgggccgacgatttcaagcgaaaacccagtctttttgaggagcggcagtcccgatgcttttgggcggcgtagtccccccctcccaccccctcccgggggtgggggctttcgtggtatctctcattctttctctagtggaatccttcaggtgaaaaatcacatcctagtttcctaatggtgagcgacgacggcatcatctgcgtctctcgttctcttcatggtggaattctttggtcgaaaaccacatcctaattttccaaaagaggtgacgacagtgtcacaaccttcgtggaggcgttgtttgaaggttcgtttctatcaaactcttctccaaatggattgttctcttaggacgacaccatagccatcacaagaaaaccatgctggtgggagatcagatctattcttatctttcaccatatccccctccacccaaaggcatgaatggattttcattagcagtgggtgcttgtgttgtaggtgcatgtgcaacatagtttggtacttttgtttttcttgattataccctaccagtgctttggtctttttttctcactatattgatatgaaacctcgtactatcacacgtgaattgttttagaaaaaggtaactacaatacaataatatctttgttttcaagactactccattattgtagtttcaaatttaatcacacaaagtttacatacataaaacatatcaaaacacaataatgaaattttggagggttcgaatcatgaggtaaaatttctattaggtccgccaggatgaatcgtatatattataagtaagagatacgatagaaatatgttagatcaatatatgaaaggcacgttagtaacattgtaccaatcttgtttcgaacacatttgaaatatagcataggaaatatttcgttctggtcaaatcctgtagttgtagttcttaaacacaagttacgtcatgagtacagccatatcaaccacccatatcaataaatccaactaatactataaatgccataaaaatgcaattaaatatgcataagatgaatctatatctcaattactcaatactagaatcagactagcattaaatgaccatattaaccatatcaaatctggtggatacaaattcaataaatagagtaatatcacgagcaaatcctcaataaatgatatcaaagctctaacacatttatacatttaaaaccctcgtatctcaattactcaaaattgcaatcgaatttaataggcgcattcacacaggtagaaaatcatctgtccacatttgcatcatcacacttcgaaatcacaaaacccccaacccaacccacaaccaccccatctcactgacctgcgggccccatgagccagacagagccacttacagctgggccccaccatcccctcccctcccgcttgagcctatcctacccagtgctacagccgacggaagccggcactctcttcggctatttaatccccactcctcgcccgcttcgagctccaccgccaccgccaccttcttctcgccgccggccagccaccgccgccgccgcattccgcgcctagcgtgttctcgcttcttcgtggtctcagcatttgccccgagaatggcggcggcgggggcggtgttgccggagcagatcgcggcgatgtgggagcaggtgaaggcgccggtggtggtgccgctgctgcggctgtccgtggcggcgtgcctcgccatgtccgtgatgctgttcgtggagaaggtgtacatgtcggtggtcctcgtcggcgtccacctgttcggccgccgccccgaccgccgctaccggtgcgaccccatcgtcgccgccggcgccgacaatgacgaccccgagctcgccgacgccaacgccgccttccccatggtcctcatccagatccccatgtacaacgagcgcgaggtaaccaaaattattcaaatcaatccgccatgcatgcaatgcaaactcaaataaaaaaaccaaaaaaaaaggaaaaaaaaagggcactaaaaagttttttgggtttattttttgttttttttttggggtggcaggtgtacaagctgtcgatcggggcagcgtgcgggctatcgtggccgtcggatcgggtgatcgtgcaggtgctcgacgactccactgaccccgtcatcaaggtgagagccagcgtttttttttcctttttcacttcatttaattacagcgctatctgtccccgcgtgtcagtgacacaccagtggcgttggtctggtccaaggagtgaaattaattgcggctgtctgtcactgacagtcgccgctgcgtggtggggccacaccatgccggcatgaggcgcgtcgtattcttcaaaattttttcatcgctaagagctttcaaacttttttcatcacgagagctttcgaatttttcacacggggaaaaacgtattgtaggtacaaacaaattagaggccatgtctctgttgtcgtagtcgcaagaacaagcgagtctactttcactgaggaatttttggctggctgtattattttaaccccgagaaaaaacttggatttttttttgaggaaaatattggaagtgttcttcttttcttggcctagctagggacagggagggagtgacgtgatgcatcatgcagcgaatttatatttttctggtactagtactccattttacacgaaagttcatgggcaactcgactggctagctccttgtcccaccgcacgactcccgaggtggaacaatctgaaccataccgcatttaactagcaatcgttaccagaatggtttactgtagtagtaattaactagcagtaaaaataactggtggcaaaagaagagtcaggattaaatttagttaaaagccacttaattatagagcttgctaacaatgagacgatgagtgcaactgcaggagatggtgcaggtggagtgcaagaggtgggagagcaagggggtgaggataaagtacgagatcagggacaacagggtggggtacaaggccggggcactgagggaaggcatgaagcacggctacgtccgcgactgcgactacgtggccatcttcgacgccgacttccagcccgaccccgacttcctcgcccgcaccatccccttcctcgtccacaaccccgacatcgccctcgtccaggcccgctggaagttcggtgagtcagaagtcgtagttttttagataatagattaaaacccgacctctacatccacacacaaccagaagtccatagatgagtccaagtcacatttttttaaaaaaaaacacaaagtggctattggtaaaacgattttagtttttgaatggttgccttggctctcgtgttaatggatttgtctttgtcagaagaattgagtggttggttaggtttctgaatggtggtaagcagatataggaacagcataaaaatggcagttcaaaagggcccggataaagcacatgcacctaggagtacacacatactcctataatcaacagtgagtgcagcagataggagtatgttttaggaaatgagtgcactgcattagtttagtgttcacggcagttatagtagttggagataaggttagttgttgaagccaaagcatgggagcagtacacttggaagctggaccttggtttgtgatttgggggatcatgtgcacctgtgacttgtaactgtagtcctttggaccatgacattgacatgtgcgttgttctgaaaaagctggagtagtatagttaaatcttctgcatcactattggataaggccgagtaaaaattgtcagtatggttgactgaattgtttgacttatctttggcattgatgatataatgcccttttttaactataatatgatataatgtccttttttttaactatactatgatataatgtcctttttaaactatactagtgtagcacactggccttgttttggacttttttcttttggcatggtgatgacatgtttgttgctgctgacggtggtgatggcgtgtgagcagtgaatgcaaatgaatgcctgatgacaaggatgcaggagatgtccttggattaccacttcaaagtagagcaagaagtgggttcctccacacacgccttctttggcttcaatggtaaaacttgatctcaattcatcttgtcttttttcttctctcttgtggggcattatgtgtatccatttctcagttccatgattctgcctctccttctgtagagtacatatgtttattttacttaataatgagaaactgtttcgtaatctttggaaagaaaaagacatgttaaccacatctaaaaatcatatgcaattgcatcattctagtttattccttaaaaagtacaatacccagttagatcttacacaaagcagaaggaaagagtagtgcaagaatataacacatgcacaagattttcaatgttgagaacttattttctctagtaaaagtcatatttagcagcatattttgttttaccctgcaaaatgttatgtgaatagggactgctggtgtgtggcgcatatctgcgatgaacgaggcaggaggctggaaggacaggacaacagttgaagacatggatttggcagtcagagcaggcctcaagggatggaagtttgtctaccttggtgatctcatggtaaatatgcactagtagcctaacaattcatgcaatatccaatgcatcaatttgcgcttctatatattacattgttattaagctatataaggaaggatgtaactaacctggtaatgttgtttgaaggtgaaaagtgaacttccaagtacattcaaagcattccggtatcaacaacacagatggtcctgcggaccggcaaacctgttcaggaaaatgttggtggagattgccacaaacaaggtcccttgcaccaagctatattatggaaatattttataagttataacacacatgcatcttgttgctaacaagccattgatcttgatgcagaaagtgacattgtggaagaagatctatgtgatctacaacttctttttggtgcgcaagattattggacacattgtgacctttgtgttttactgcttgttgtcccggcaacggttttaattccagaagttgagataccaaggtggggttacgtctatttgccatccatcgtcaccattctcaattctattgggactccaaggtgccaaatcttctccatagctttgcagttttactttcagaatatgaatccaacctacagtacccaacctacagttttacttccagagctttgcagttctgagcaacctaaaaatttacatgaaaatatgcaatgatgcaggtcattgcacttacttatcttttgggtcctcttcgagaatgttatgtcactgcatagaacaaaggccacgctgatcggcctgttagagacaggcagggtgaatgaatgggtggtgaccgaaaagcttggcgatgctctgaaattaaaattgccaggtaaagcattcaggaggccgcgcatgaggataggagacaggtacgcagtcgaaacattttagtcctgcattttccaagttccaatccttgcagctaaactttgatcttgaaccagggtgaatgcattggagcttggtttttcagcctacctgtccttctgtggatgctatgatattgcctatgggaagggctattacagtctcttcctttttctccaatccatcacctttttcatcatcggtgtgggctatgtggggacaattgtcccgcactgattacagaacctcgatgaggctatccatcttggatcaacgaccggctctggttctttccagtctcatggtgttaggtatgcaacaagatgacagatcaagcaggcttctcctgtgtgcaagtgcaaagtttcctgacaacaatgaagtgtaaaagcactgcaaaacaagcaatagataaggcttttagctgctaggaatatgctgttatgtgcattacaattgtgatgatctagcagtctgttcagagtctctgtgtcaccttagcagaatctgtagtgggaaagataggagttgttaaaagctttatattttctgcaaacaggaaaaaaattggagtttttggttttagcatgtagctttagttctgggaacaggaagaaaaaataatatgtattggttcctcaatatgctcacctggtacaaaagagaggctgtacatctttgctttaacttttctttctcctaatgttcaagtgtaatctgggaatatccatttgagatacagtattttgaggagaaacagagatactgacacagaagctgacctctactgttccatctcttgtctcagactctctttgagttcaccagtcaccacactgatgattctgtcatgtgtttcattcagaaacttcctcttcacatggtacaatcagtactgtctgtctgcctgtctgtatttctgtctcctggcaatccgcatactgacatttgattcttactgaactgctgacattcgaggatctgcatgtgactcgagaacagtgaggatttgtttcatggctctgcaagtctgcaaggatccaaaccacagactaggaccagatgtcattcaaagtgttctgaatctcaataacatgaacaggtgatgtgatcttgtgttacataatgctagtattctggaagcaaggtcgtgatcagtgactgggatagagcaaaagggtaaatacattacaatggtgtactttcatgtcgtttgctccggaccttctcccatatgtttatcttggcgccaattttctcatgcatcagatttctccaagatgcaacttttgtagttgcagcccgaacccggctaataacagatcaaaattgcagtgggtctagaacaagggcacaacagttctcaagttgcaaaaaatctacaggccctgtgatctctttgaaccctctttgaaagaggatgcaaaatttgcaaatgttcatgaaattgagcgagtgacaactgacaactgacaatcgatcatttagcaggcttgttgcttcatagaagcaacatctcaaatgatgaaaatgcaatgccacttcacatcaccaatcagctcagctgcaatggctggcatcatctccatccataaccggaggcacggactgctcggcgacggcggcggccaacgcgttgcaggccgcgtatatcgccgagcgctcgtcgtggtacgagtcgccggcgaggaaggtgtgccttttgccccggacctcgacggcgctccaggccggatccttcttgattcccagcgaccgcatcgcctcgtgcgcgccggcgacgctggcccacatctcgcgcgcggcgtacgcgttcgccaggacgacgtacttgccggcgttccccggctgcagccggaagaagcggcgcgcggcgagctcgaccagcctcacgtcgccgtgcttcctgccggcgccgagcagcgcgccccagaccaccgagtgctcctggcagtccggcaggttcttgacgagctcgtaggcgtcgccgagccggccgaccctggcgagcatgtcgaccgccgccgcgtagtgctcgcccctcggcgtgaggccgtagcccgacgacatggacgagaggtggcgcagaccctcgccgacgagcccggcgtgcgcgcacgccgagagcacggcgaggaacgtgacgtcgttcggccggagcccgtccacccgcgtcatccggtcgaacagcgccagcgcctccgcggcgcgcccgtgctggccgtgcccggagatgacggcggtccacatggtgacgttccgcgccggcgccgccgcgaacgcccggcgcgcctcctcggggctgctgcacttgaggtacatgtcgacgagcgcgctgtcgacgaagacgttgccgccgccgacgcgcgacttgaccatgacgccgtgcacgcgccggccgtgctccagcgcggccagcctcgcgcacgcgcagagcaccgacgcgaacgtgaactggtccggcctcatcccctccgcccgcatcgacccaaacatctccaccgcccgcgcctccgcgccgccgcgcgcgcacccggatatcatggcgttccacgccacgacgctcctctgcggcattccgtcgaacaccttccgcgcaacaccaagctcaccgatcttgacgtaaaagatcagcagcttggtgacgatgtagacgccgccgccaaaccccaccgacaccatgcgcgcgtggatcctcttccccatcctcgcgtcccgccggttcacgcattcctgcagcagaagcgcgtaggtcccctcaccggggcacaccgtactccgccacaggagacccaccgccctagcgagatcgccggcgacgcacagcgacctcagcattcgcgccaagccaacggagcccatgatccagctgcccaactctcttctatccgaattcgagctcgctctaatggcgtcgcatctctgcgccgctcagattagtagtgtatacaagatgaaatccgagacctaggagaaatcaggctactacatttacaacaaaaactctcgggtcaattacaagatcgaggatatacaagcgaaacttcatttttgtttcgattcgtctcctgttttgtctctcttcttgttcttctatctatctatggtggtttgattttttttttgtattagacatagtaaatcatgccgacctcgagggtggaggcgtgagggatggtgacggcgtagttggggccgcggctgttgcggcggaggaagtcgtagcagaagttgatgaccagccgccggaagaagctggagccgctcttggccttgacgtaggagtggccgaggatgaacgccatgccggcctcgcgcgcgtccatcagctcctgcagctcctcccgcacgccggcgtccggccgcgggctcgccgccggcagcacgaaccgcaccctcttcctcggcgccaccaccaccggcggcggcgacggcgacggcgacatgatctcccttgcgccgccgccgccgcgcgagctgcctctgccgctgccgctgccgctgccgccgacggtgtcctccgacgacggcgcccccgcgccgccgtcctcctccatcatccgaatgctgccggaggggatgacggacatccgctcctcctcctctttctccgactcctccgcgccgccgccgcagacgttcttgggcttgaaagaggccgcggcgtcggccgcggcggcggcgccggagcggatgaactccgcgacgctgcagacgagctccttctcgaactcctgatcgtccttgtgcacgtcgtggtagccgtacctgacaatgcaccggtagattctgtactccttggggccaattcttccgacgaggaacctctcctccggcgagacatgcggtatcgggacgttcttgatgcagaggaagatgagcacctgatcatcatcaagaagaagaagatgatgagcactgtaaccaaaattctgaatttctgaacaatgacaacaacttcagaaggcgaggaatgatggctgatgagcaagattacttgatgaaatgcaggtaggttggtgacgaaatgcgagaagattgccgggatcccagagtcgagctcggtgtggatgaggccgatgccgcggactcggacaatgccgaggttggggctgaggccaaggagccagttgatggagaccttgttctggagatcgaactcatacttcttgatggtgccatagtgccagatgcacattatcgccatgaagatgaaggccagcacaattgggacccaggctccttctctgaacttgatgagtgatgctgagaagtagagtgcctcaatggtgccgaagaagatgatgaagccgaatgcgaggaagatgctcttgtgccaacacagaactatcaccagggacatcagacatgtcgtgaccagcataacggttataaccgccaatcctgttcaaaggacaactattgcatatcagacaaattccttactcattagcttcagtatgcataggtaattcgaacatggaataatcaggtggtttgatatgtcaaaaactaaaacaagtggtacatacctgacgcattgcccaggtgttttgtgtctctgaaaccaatggtaatagctaagcacagtatcatcaggatccaattgatctcagggatgtaaatttgcccgtgtactttgtcagatgtgtgaactatcttcacccgaggaaagcagccgagagcggtgcactgcttgatcattgagaatgtgccagtgataacagcttggctcccgacaactgctgcaagaatggcaattgccagaactggccacctaattttctctgaggatggaaaacttttaaatattaataaacagtactaggagaatgatataatatcgatttcgctgttgatgaaagatctggagaacatgacttgccaggcacagacacatagaacccgatcctgtagtcactttcaatgatgtgatgcttacacagataagcagcttgccccatgtatgcaaggatcaaggatgggtaaaccatgcaagtaaaagcaatctgcaatcaggaaatgcttatcagagacaaaactattgaccgcatgtccgcatattgctactatgatgaaaccaagtaaaacaaaacattgagattgcactctatttcatcacctgtatcgacagctgattaaaatgccccagatctgcaaacattgcttcagaacctgaaaaacaacactcaagttagtaaagttgtacacttcagagatcattggcatatggtagaaaatggttgttgatcatagtaccagtgatacataacaatattcctcccagtgacatccaacctcctctctgcgtcttcttcaaaaacttgtacatataatatggagataacgctcgatagacattgggctcccaatgcacgatattgtaaacaccaatcatgcttatacatagaagccatgtaatcacaattggtgcaaaaaggaaccccacccggtgtgtaccatagtgttgcagacaaaacaggcaaaccagtacaaaacaagcaataggaacctccacatctgcagattcaaatcagtaaaaaaaactttgcacagttagtaatgggttaaaaaagaaacaaaacatattagcaaaacaagaatcagaataaaagcacatgcttaaatgattaaaagtcaaaatagagtttctttactccgcacttcagaattcagcacttattttattactttcagcatgtgtagcttccattttccagaatttccgaaccttattaccactagctgaccatatttctgcccagagtgaactctatcctctgccaaagcccaagagaatatgaactgaacagatacagtaatttagatgatgaccggcttatttaggaatcgctcaaatcttttctttctgtttcccactacagttcttcacaagaatcacaactgcttgagtagggtagttccatttattgtagtcatcaatgctactagataagagtattaatcttctccagttcgtaggctaatagcattatagcaacaactgttaggcatacattgactaacaacagtacggagttgattgttggtgtccatgcgacaacgctgcgttgctcatggtcattccctgtcaaagaccttcctaaatgaatttggcacgcaattgatcatctgatatctgagccgataagctcgcacggaaacttccaaaagtatcaatcccattgaagcaaactgttcagacttcatcagttaacataattcctggttttacgaacaccaaattgcacagaatccatctcttgcgtgcatcttacaggtaaaatttactcgaattgtggtgcactagtatgactgaaactgcacacttttttcaactaaaaaaacaagaaactgcacccttttgagtttgaggtggaccctgaattatctaaaaaaactcagaacatgatgatccaggaaacagtagttaacaagatgaggaagacaaatctacaatcatatcaaaagacagaaacaatggaagggacaaaggcatggttgggtgttcagatccttacatttgtgctgatgcttttccatggacaattccagcccggataccgccgagaacactgcaaaaacagaacacgccatctgaaaatcagcacacgacaacccaagaacacaaacaagccagcaaatcaagcgggggcgcgcacgcaccggagatggccggcgtgagcacgccgtcgccgatgaccatgcacgtgcccaccagcgccagcacgaggagcacgcgctgcagcaccttgtgccgctccagcagcctcctcacgccggcggcggcgccgcctccgccggcgcgcccgctcagcgccagcgcattgccgttcgccgcggctttcttgtcggcgcccgcgtccaagaactggtccttgtcgcccggctcgccgccgccgccgccgccgccaggcgggaggagcgcggcgcgggcgtggcggcagaggagggagtagagggcgaaggtgccgccctcgccgttgtcgtcggcgcggaggacgacgcagacgtacttgaggagcggcacgagggtgagcgtccagaagacgaaggagagcacgccgaggatctcctcgttggtctccgagtgctggatgtcctccgcgaacgccggcttgtacacgtacagcggcgacgtgctcaggtcgccgtacaccaccccgaggctctggtacgccaggctcatcgtcatccgccatggcagccgcctcctcttgctgctgctccctccctgctccatccatccacccacccaaatcaaatcacacgcgcacacacacattagcaaagaatccaagatcgcaccaagattcaacaacaccatgatcaatcaatcaatcacgaccaccacaaccctcgcaaacccgacaagattagaccattaaccatcaaacatgacacgacctccaccacccaacccataccttgcaatcgggagaactcggcgactcaggatccacgggagacgggctcttcattcctcaatcccaacacaagaacagaggaagcaaaaccactcctactcctactcgtcctacagcagctacagggtttcttggctctctctctctctctctctctctgaatccctgggggtatcaaatccaacgattcagaggagacggtaatggggattattaggcggtgggaaaatttggagttattgaggtttttaagagggtcaaagcggaagcaaaacagggggcactttggagggaggcagcattggcgtggtgctgctgctgctgcgactgtgaggcagggagggagaagcggaacaatgaagaagaagaagatgagaagcagcagaagagagagagagaagaagagggccagggaggattggaatatttgggagtgggacagcaaaagagaggggccaacaatactgggggaaaccgaaaaagcagcagttttttttttctactgcaaaatgtacttcctgtttggccggctcctctgcatagggtccttgtgtggactcacaagggatgaactcttgtttacatcctgctaaaattgtactacttcctccatcccaaattaggctgtgttggataccaaaagttcccactccccatctcgttttccacgcgcacgctttttaaactactaaacaaaacagtgtgtttttttgcaaaatatttctatacgaaaattacttagaaaaattatattgatccattttttaaaaaatagctaatacttaattaattacgtgctaatagaccgctttgtttttcgtacggagaagatatgttcccatcctcatcctccagtaccaaacacaaccttagttatctttctaccatttaatttttgtctcacagtacttgtcacttccaagtattacttgtctcatcaatcacatatcattcaaacttctgtcaaccaaccttctattcttaaaacataattttttttataagggtattgtagttttttattctaaaccttagaatatgccaaacaattttaaaggaaaagcaatttaggacggtggtagtatactctatcggtctcaaaataagtgcgatgtgatatatccaagaattataaatttagataggtatatttgaaaagaaacacaacctaaataagatagttcatcaaagcatgattaattaagtattaaaaagacttggaaatagatcattatgatttttctacagtaaaatttcaacaaaaatgtttcaaaaaaaataacatcgtttaatagtttgagaaacatatacgcaggaaacgagggtatagtgttcttaaaaagttgtgatgatattaacacattattttcagtgatgatctatttataagaaactgacaattaatgttgtgaaaacgggtttcatacttctaatagtagacgatatcaggatttatgatttgtgtattagtttggcagccataatgcggtttctagtagtagtatgatacgggtttgggattatgtaattgttttctaattaattgaaaaaaatgactacctctttcaatgttatcgtagtaattattgtttattaatttaaaataaatgtattgtgctattaggagacatttattaggtggcatagatagcagggcaataccagtttcatgtagatgctctataaatatagaggttctggaattagaggtactattacattcatatgttagttacacttgtttattggcctgaagctaattttagtgacaacaatagttcccagttggcatatatttactgcccctaaactggatcagtatgggagatagtaacctagttgcttttgtttattgttggaagcatggatttgtcatgtgaggtagatgtttcctttgtagattaaacctttttagtacgagtactgtcaatcattttgctattaatgcatgaaagtaagattcaaagtactatctactagtttagaataaaactcaagaaagcatctactcctgcattttacccttactatatgtctatatcccgcgggttattcttgaagcgcataataacataagaaagtcaacaggtgaaagttttctgcataattttttttaatacaatgcaatgctccaacctttcacctgttacatactatattttattttttccatgttcatatgttgttggggctctatctatataggcattttttgggtcttttttccacatctaatgaaatggctcacaaagcttttgcgttcttgggagaaactccaatcatttgaactaagactgataagctctgagaaaaattaactaaacaaccaaaaatatttaatgagcaaaacttttatacatttgttattaacgatttgaaagataatgttaaaaaaaacaacgatgaaatgcatacatggcaacctttgaatatgattttagtgattagggatgcctctttgaatgtgttttagagaacgaacttatgtgttatattgtctacagcttgaaagaggcactactataaaacatcaaataggtgtcaccactataggtgccggtagtgctaaaaccggcaccaataggccttttcataccttcgtgggttgaaattagaaaaaaaggtatctttaagtaatcataggttccgttctaaataaaaaccggcacctattatattttgtgttggttttttttaaaaagccagcacctttaatatattataggtgggaaaaagtacgaattaacccccccaactatcgcggtcgtccgaattactcccctgaaccacaaaaccggacattcttcacaccaaactatgcaaaccggacgaattaccccttggatccaatccgcggtggttttggtctacgtggcggtacacgtggccatcccagtcagctgttttctaataaaaaaaattgggggacccgcatgtcataggcttcgct

SEQ ID NO: 59654 - DNA, 2305 bp, Oryza sativa
acgtgaaaacacacccctagaatggcgatgaggacgaagctgatgtggagtttgatggcgacggagccatcgccgtcaagcacgcaaacttatctagctgcgactcctgatgttcctggccgtgatcgagctcctgcgttcttgcttaatttgagtggtcggatcggctactgagctggtgcggcggcggcggctaatcggcgcatgaggatcgcggtgacgggcgcgacggggtacctcggcagccgcctgtgcggtgcgctggccgacgccggccacgccgtgcgcgcgttcgcgctccgctcggcgggcggcggcggcggcggcggcgacgtcgaggccggcctgctcccggcgtccgtcgagctggcgtacggcgacgtcgccgacgtggagtccctcgccgccgccttcgacaggtgcgacgccgtcttccacgtcgccgccgccgtcgaggcgtggctgcccgatccctccatcttcatcacggtacgtgtacaatcttttaaaaagaaaagaggattttaaaaagaaactcgcgaaagttttcaagcaattccgaaaaatatatgctctataaaattgatttggtcatttggtgttaaaaaaatgggcatttaatcatatcctcggacgtgttatgattatcaggtcaatgtgggagggctcgagaatgttttgaaagctgccaggaggacaccaacagtaaagaaaatagtttatacgtcatcattctttgccattggcccaactgatggatatgttgcagatgagacacaggtaccatatttatattggagttctccttaattagctccctcagttttcaaatccttcggtctagaaaatctgccatttcttgtgtgagatgtccagactgagcatgctaaaaaaaattgtgcaaaatatgatgatatgtatacttcaaattcctttcgtgaaagaaaaacatttttgcagagtaacaataagttgctgatattgcagatgcatcaaaggaaaaacattttggcacggaggtatgagaaatcaaaggttctttgcagaccagatcgcattgcaggcagcagcagaggggatgccaatcaccatcgtctatccaggattcatgtatgtcctggaaaacttacagcaggaaatcttgtttctcgcatcgtaagacaatttctctactcctagttattcatcctgcatatatggtatatctgaatgacccaaaaaaaaagaacttgttcctgaaataattaacagccatgaatcatgatcagaaacttgaacatcactggctcttaatttgcagttgatcgagaggttcaatgggcgtttacctggttacgtcgggcatggccatgatcgagaatcattctgccatgtcgacgatgttgttgctggacatgtagcagcaatggagaaaggcagagaaggtgaaagatacctcctcaccggagagaacacgtcgctggttcagatcttcgacatggcctccaggatcacgaacacaaaggcgcccagattccacgtacccctctggttcctgaaatttacgggtggatttcagttcttgtttcaagaatcaccgggaagctcccgttcatcagctaccctgtatgtctctttctgtgctccttttatttccagtacttacttaggttcagagtttgtttttgcagggtctagttagattcagagtttgcacattggtgatgatgatgatgtattgatgtggttacttagatttcagttcttgttgggttttgcaggcagtgcgtgttcttaggcatcaatgggcatactcatgtgagaaggccaagaaggagctagggtacagtcctaggagcttgactgaaggtctatcagagacgctcttatggctcaaggacagcgaaatgatcagattttagtgttctacatttcactcatgtaaacatatcagcattgctgtaactgcataaatagttaaatcaaagaaaacatgtggtttgaaatttgaagatgaatgcgtgcaccaaacagggccaaatttcttcttagatggtcaaatttgttcctgctgatcactgatcagacttgagactcgagaggcaaaagcagatcatatttgggcccggcccacaagtgacttgggcccgcttgcttgtgggttgactaggggtactactggacaggctggtggctggcctcgccggaaggcttggaagcccgcgttgactagtggcggtggattggcggcggcggcggcgactcgacgatgggcggcggcatgagggtggtggtgacgggcgcgacggggtacctcggcggccgc

SEQ ID NO: 59655 - DNA, 886 bp, Oryza sativa
aaaatttgtcgacaaatgtataggtggtcccatgtgatatatttggtccgatataaagtgtggtcgcgtacggtaacagtgagaagggaatttttctactacgtactacatccgtcccaaaataagtacagccgtagatatccgtgcccaacatttaaccgtccgtcttatttaaaaaatttgtgaaaaatttaaaaatatttaatcacacataaaatactattcatgttttatcatctagtaacaataaaatactaatcataaaatttttttaaataagacgaacggttaaacgttgaacgtgaataatgtaaaactacacttattttaggacggaggtagtaaaaagatgggtatgcaacttgagtacgtgcttgacataactgtgatgcagtccaagaacttgatcgcgaaggaccgagatcctctgagaagaccgtgactttgatccattatcagtcgtccgatctacagtatctggtgaatagtaaatcaaagcagtagtttttacttttttactgtgtctacagtaaaaaaactgcagagcaatgttttgcactgtaacaccagattcattttactatgtttatcttccgttcgcttccaaagtcagaggagccggatccgattggcgaatgctgccaacgatcctgacgttgttgacctgacctggcacgacaatgcaaatccagtacagctgctgtttcagatgattgacgacaagccgattgcctttcccttatctgaaaaaatttggtcagatcagatgagtcatgaaatggatggatgcatagaggtcggaactgttggatttgtctgacgctgaacgcgatcgatcgatcgatcgagtgatctctcgaaaatgatgccccgtacacgtaggact

SEQ ID NO: 59656 - DNA, 1417 bp, Oryza sativa
atagatctactaagccctcggtgaataattcaatcacaagtaaataattgagtaaaatgaagtcacctttttattgtcaaagttttactttggatcacacttaaaccaatcttttcattttagaccggataactttgcctatagtatttggcttggatcaccccactctctttactattcatgtatagatatgagcagcatataaaaggggaagttcaccattataccgaaaccgatttgattgaggttatttatgggtgtttgaagaagttaaggatgatccaaacttaaaaaaaattgataaaattttctgatcatccaaactaaaaaatatacaaaactatctgattctaaagtgaaagattgatttgagggtggtccaaagtaaaacttaggcccaaatcacaatccactcgcaataatttgatccagtgatcacttgggcctcatttctctcatgggccgtgaaagaggtttcaaggcccatgacgcacacctaagattgaccagttcaactaacgtttgctaaatttaagcggaagccgttgaaaagccaaggaagcaaaaaccacccgtttgtggcgcgcggtgatccataaacagtaggggcctcccttcgggagccccctttcctcgcgtcgtccccttcgcggagcctccccttcgggggcgcgctccattgttttttcccttccaacccaatcctattatgacattacgatgcctatccccattgctttctttttcttcttccccttcttcttggcggcttcttcccatgcaacggcttcttcccatgccacggcttcggtggtcccacaaactcgaggtaattcatggtactcccttcattttatattataataaattttatcttttttattaaataatccattttggtaaacttataaaagaatataaaaatattttctacaaaacaaacatatataatcatagtatatctaatggtggtggtgttgtatatgttgctaattgtttatgtaaacttgattatatctaactgatcagaaaaaaaagtttaagccactaattatatcacaaacacggagtaattgattcttgcatgcaagaaatgggacgtgtaatggtgggtgatcgaaatgttattatagggttctatataaactgtggatcggagaaggaggagcagatagggagcatcaagtggatacaggatgaggggttcatcgccgtcggcaacatgtccgccgtcgacaagccgaacatcctgccgctgctcgccaccgtgcgctacttccccgacgcgacggcgaggaagtactgctaccagctccccgtcgtcaaggggtcgcggtacctcgtccggaagaccctacttttacgccgggttggacggcgccgaggttccgccggtgttcgaccagatcgtcgacgg

SEQ ID NO: 59657 - DNA, 730 bp, Oryza sativa
attaatggaggaggaggaagaagaaggagctagctagctgttagtataagctatgggggcagtatggagcagagcagctggctcacatgcagtgtggttgaaagctcagtccagtgcagcgcagctctagcttcacgatcccatttacttctctgtcgatgagcgatggagtattggagtgtagtaccaaagagtgtgtacttctactgttctactacaacaatcatcactgtattctccttcatgttattataggtttttatgaaatttatgaaaacatggtggagagactgaaagcctgaaaagaaaatctattatgcatttgcccataattaaatcttaatattttgacgatcggaaacagtctaatacgatattttcaaaacgaatatctctctatatgtatatatatataatggaccaaaattcgtgccttctaataagggtgtgtttagttcacgtcaaaaattggaagtttggttgaaattggaacgatgtgatggaaaagttgaaagtttatgtgtgtaggaaagttttgatgtgatggaaaagttggaagtttgaagaaaaagtttggaactaaacaatgcctaaatggtaatggtacatgcatgtacatccttatagtatactaatatgcactacttgtagtagatttaataagggtagcatgctgtatgataaatgataatagtacatgcacaagcatctttatagtttactaatatgc

SEQ ID NO: 59658 - DNA, 2456 bp, Oryza sativa
tatatcacattcgtttaaaatctcttatttttttgggacggacggagtacgttttaaattgagtgaatattagatgttcgaaggtgcattgcagttttacttctgtttggagcaacgaagccttccatgtgattatgtgaaataattcaatttgaaaagattccttccaggtttctgttttccaatttccattcaaggcccaaacaagaaatttatttctcgctgttggcgcactatcccatccaaatggaccaatgatcatctagattcgttgcattatgatgtattacattcaactaaaatctttatatatagggactgagggagtacatgagctgcctgacttttgcttttgtgtcatctgtcactgacatcgactaattaattcgagaagacgcaaatgaggaattttgctacacttggcggttgattagcatttgggccttctaattatgcgtgattgaactttgcacgttgtttctttgccaaagagtggtttttctacgctttattagtgctttacagatcaactgaatggtggttcgagtcaccacaatgtcctttggatgttcacaaatcacaaatacttcctccatttcacaatataagttattctaacattttccatatttatattaaagttaatgaatctagatagatatatatgtctagattcattatcatcaatatgaatgtggaaaatgctagaatgacttacattgtgaaacggagggattgtgaaccggagggagtagtgcttagcactgttcgtttcagaggttggaggaaggagcaattgacttatcgcaaaaaggcacttaattgagaaattagttaaatattaactatgacaaaattaaaaataaaattatttattttccttaaagaaacttctatataaaattttacttttcaaaaatcacaacatttagcaattttaaaaagcgtgatcgcaataatttaatatagccaatagctgaaaagaatcatggcgcctaatgggttggtctcagagtgaagcaagacagttcaccttacgaatctttggagataatccggagtcacttccttaccatctggtaccccaaagccagatgaaaaagccgcaaaccaagatttgaaaagatgaggtttgagcaccaactgtttcctcggcttcatcatctccgagagagcagttcaaatcaaattgctggctcaagggttagtgaagtgaaatgcagataccatatgacacgaatttaaggttacgaagtactcctttcgtcctctaatataagagattttgacattttgcttacactggttgaccattattacttaaaaaaatttagaataattatttattttatttatgacttaatttattatctacagtactttaagcacaacttttcattttttatatttacataattttttttaataagacaagtgatcaaatcttacaattaaaatattaaaatcatttgtattagggggcggagcggcggagggagtatgaactatgatcaataatgaatcgtggtggcattttgcatcatgccatcatgtagggttgactgccgaaaataggtagatgaagggggtctagcttgtagattttagatggtgttcttttctcctgaaaatgaagatgaaaattaagtttttttacgcaaaacgatatggtattaatgtatgattgattgaattttaattattataaacttgaaaaatagattaatatgatattttagggcaactttcatatagaaagttttcgcacgaaacgtaccgtttagcagtttgaaaaacgtgccacgaaaatcttaatgttcatccaactcttattgaagaaaagatcaggattttttagaaacaaccccaccttttggcttacaattataatctgtaacggcttattaatatgaagtaatttataagtaaatttttttgatttatatgttctatcaggtatagtaagcatcgtggagtactaagaagaacactgaataaaaaatatttattattttgctatgtatttgtcctcacctctctcttcatgctattatttgctaaatggtatttcctccattttatacttatataagtcgtttgattttttcttagtatttaactaaatttataaaaaaatagcaacaactgcaacaccaaattagattcattaaatttaactatattttatattataagtcgtttgagattttttagtattgaaaatgtaattatattttctacaaactagtttaactaacaaaaaaaaagtatacgacttataatataaaacagagagcgggagtatactattattgcttgttatccatttgtaaatttttaacaatagtttttgttgtggttggtagagatacattggtctgcctgccgtagcagagtttgattaagctgggatgtactaattgatcatttctcacatataaagcgtataaattata

SEQ ID NO: 59659 - DNA, 2866 bp, Oryza sativa
cgcgacggtcggcggcggctcggcggtgaactggtcggcctgcatccgcacgccggcgaacgtgttgcaggagtggtcgaacgaccatgggctccctctgttcgggggcaaggctacgtgcaggccatggacgccgtgtgcgctcggctcggcgtcaccggccggtgccgggaggaggggttccagaacaaggcggtgcgccgcggctgcgaagcgcttgggctgcgcgtcgaggccgtgtcgcgcaactcgtcggaggggcacttctgcggcagctgcaacctcgggtgccccaccggcgagaagcgcggcaccgacacgacgtggctcgtcgacgccgtcggccgcggcgccgtcatcctgaccgggtgcaaggccgaacggttcatcctcgagacgaacaccggcggcggcggcggccggcgcaagaagtgcgtcggcgtcgtggcgaagtgcttgggcaaaggcatcaccaagaagctccggatcgaggcgaaggtgtccgtctcggcgtgcggcgcgctcatgacgccgccgctgctgcgcaacagcgggctcaagaaccgccacatcggccggaacctgcacccccacccggtgttcatggcgtggggctacttcccggacagcacggcggagctcccgggcaagtcctacgagggcggcatcatcaccagcatgcaccgcgtcaccaccgcaccatcatcgagacgccggcgctcggcccgggcgcgttcgccgccgtggtgccgtgggagtccggccgcgacatgaaggagcggatgcggcggtacgcgcgcacggcgcacgcggtggtgctcgtccgcgaccgcgccgcgggcaccgtcggcggcgagggccgcgtccgcttcaccccgagccgcggcgacgccggcgagctccgcgccggcctgcggcgcgcgctgcgcatcctggtggccgccggcgccgccgaggtgggcacgaaccgcagcgacgggctgcgcctccggtgcaagggcgcgcgtgacgaggacgtggaggcgttcctggacgaggtgagcgtggagaaggggccgatgcacccggggtcggacaagtgggcgctccttgcctcggcgcaccagatggggagctgccggatggggaggagcgccaagcacggcggcgtcgacggcggcggcgagagctgggaggcggaggggctgtacgtctgcgacggcagcttgctcccgacggccgtcggcgtcaacccgatgatcaccatcgagtccgtggcgtattgcgtcgccaagggcatcgccgagtcgctcgcgtcgcgcgcagcgcgctcagtggaaaaccgtgatgtgtccacgaaccctcctctagcttgtgaatcgtaatacgattattaacttcttaattaatactgtgctttattttaagataatgaaaataaatctcagcgtttagcgcacgagcttccgggcaatttaacagtttattactctctctaattcatactccctccatccaaaaaaaaaaaagacaaactattatgtctgtgttcaacgtttgaccgtcggtcttattgaaaaaattatgaaaaaattaaaaagataagtcacgcataaaatattaatcatgttttatcatctaacaacaatgaaaatactaattataaaaaaaattcatataaaacggacagtcaaatgttggcatggaaacccacagtttgtcttttttttagaacggagggagtattgtttattactttctatatttaatattataagtcgttttaatcaaatatgtataaaaatataataatatttttaacacaagacaaatatattatcaaaatatatttaatgttagatttaacaaaattaatttggtgttatatgtgttgctatttttcttcacaagtatggttaaactttaggaagattgattaggaaaatgtgaaacgacctttagttctaaattttttcttcaaacttcaacttttccatcacatcaaaactttcctacacacataaacttttaacttttccgtcacatcgttctaatttcaaccaaacttctaactttagcgtgaactaaacacaccctaactcctcttcataaatcactggtgaaaatgtgttgttggtcacgtgttgattccaaaaatcagtcgtaagagcatcgaaccactagctgacaacttttaacactgagatttcaaattaaggggtacaaaaatattctgaaaagggaaggagtagaacaaatgatcagctctcgggcaagcatcgacaccaaggtcttattacggatagatgtggatggcggtggagcatctccgatgaacgcataagagtaaaggcaagtccatgccatggtggatggcttcgcgatgctctaggagcatcgaggactttgacgatctgcggaagacagtgatagcatggcagagtgctttacgacacactagaagtgttcagaatgtggtggcgacgtaaggtgatttggaaggcgatgacgaacaatagacacaaatagttggcaaccgatagtggttgtgatccgtatagctggagatggtgtggcaacgggtagcacggagtactttccattcacccctttcgccctctctcatttcgttaggaagaaaaagtcgttgataaaagattggagtataattaattttgaagggaaatggaaggcatccttcttgggtcccattaagatcttattcggttaatcccttccacaaaaaaattggggggatttggaaggatttttccatatctattgtgatgtattctcccccaaatcccttttttgggattaaacgaacaaggcctaatgctggggctgaaaaagaatcggcctacgtctgacgcatgcattctgggcc

SEQ ID NO: 59660 - DNA, 519 bp, Oryza sativa
acacattataggctgctagaaaatatacaaaaatcctctaagccttaattgacttttaactttgcacattttaattgttggaggctttcacacggtttttaattattctaggcataatttagaggatgtattttagagtcgttttgggacgtgacattgtgtaggtctatttcatcaagattgaagcaatggggaaactacccttaaccctaaagattgaaatagaccgatttgagagcaatgcacaagagggagagggatttaccggttgaaggagttgaatcacaccaagaaactaccctctattggtgcaaatcgatgaacacctcttccttcacctagggttccatgccatggatcacaaactcaataaaaactcaaatcaatccatggaatagagagaggaagaggaggggattcacttacggagtaaccggagtgattttgacggttgaaccggacggatttggtggagggaggtggctagggtttgggagaggagagagcagaagaaatttc

SEQ ID NO: 59661 - DNA, 37332 bp, Oryza sativa
  unsure (1)..(37332): unsure at all n locations
ttccccaaaagccactgaaaagctgtactgtgccttgtattagccaaactgaactggtaaaccttaaaaaaataagttaaggagaaaacgaaagccgatctgaactatcgaagtatataatgaaggcattaggtatcttggcgtcactctgaagataacaaattcatgggcggtgatatgatctgatctcagcagataaaaattatacggtcttacagccacagacagttgtgctttgcgtcagcatgtggttacaaaaactcgaatttttaattttgtggttatgtagcatcctattatggccaggaccagtgtattggtcatgtcttatttcaacgagttcgttttcactactctacttttttttagaaaaaaataattttactactaccttcatgtttaaatagacgatgatattagttttttgacgtttgctcattcgttttattaagaaatatatacagatttataaaagtattacataaagtatatgtaataataaaacaagtcacaccaaaataatagtacttacatttttctctaatttttgataaaacaaataatccaacgtgcatacatatctaaaagttgacaacgtcataaacttttttaagaaccacttaagtgtatcaaccgcagaaaaactcagtttgatacactaggatggcttgatactgagtgtatcaacttttttaaaaagtgtatcaaccgcagatacttgagaaaaacgtcatatactaggatggcttggtgtcttctcaagtatcataaaaactcagttttaagcaggagagtatacctacgtacaccgcaccgggtagatcatgtatatttcctgttcttttatgttcttttagactatgttaattattgcaaaatcactcaacaatcagactattacttggatatacaaacccaaggtatttttgttgtaagtttgccactgttcccaagttatcaagtatgagcagaaaacactgttgctaaaaagaagaaaaaacaatcaacctccatactgctctaatgttctatggccagcacacatatcggatgacaccagaaataatcatagagtattagaataatgaggatcacagacaaaaacgtgcaaggaggcacgcatcaaagcgagattgcagatggacaccctgtagtgtccctgaaaatgtctcgttttccctgacatgagctcaactactgcctgggcattgctgcttctgctcctgcaagctgcatgctgaaatgtactatatgaggatgatcacatcttcatatatgcatggctgtcctggatctatttgtttagtaggatgatccatggaattaagaactggaattattggagagggatttctatactgactgaatctttatattccatccaatattttccaacaagatacagtacctgtatattattatatcatgattatcccttgatttatatctaaaccaaatcacgcttccgtgtacatcataagctgaatcatgacacgcatgtttcctacatatgccccaaggtatcagtatttcaaaagaatttgcttgaagagaaacgaccagaattaacgggagctatctagccaaacagaaaagaaaggcactcagctatctcacccttgcaaaattgcatcaacatctccatcaaaaacaggccaaaagaacaagaagatgctggtgtcaccgtcagtctgtccttggtgcacaaatggacccacgttttcatgccacgttgaaagtgaagcgacatcgccattttcaggaaatacaccgcactgccaaaactgaccacaaagaaaattacatcgcttctctagagtattaaaaaggaaatagaaaagaggatatctgcaggtattctgcattatttttcaacttccgatatgccaaaagtttcttcttctttttcctttgaaaaaattggctctgtcaaaagttttggagtgtaactaaggtcatgtgctggcacaaccgaatatattgtcttgtgatgtgaagcgagcaaatcttttctttttttccttacctgaatattttctcaagctgcataatgaacgtacaggatcaacaattcaacatagtgacgatgcttttggctttggagctgtatgtgctagtaaaacttttcatagttgcggtcattttcgcatcttgtgcctgtcagtcgcggtaggtgcagaaagtactcagatactacggtattagtgtttgcaaatttttacaagttatctttatgtgtacatctaattgaaccattgagataccacttctttttttttaacaaaagaaaagaatttctcgaatgtgtcataattttttatccatcttagttcacaatttgcacaacttgtgtaacatactatctgagagtcttatcaaggccgtaccctacggtgatgaatatggctagttcattgcttttgatctaacgaattttattaagggcatcctcaatgtatgtttattaagtgggtagtaaggtgggacccacgaaactaggttataattgtttctacctcttacaatgtgtgggaagtaagatataacccacatgtaaaacaatgattggatagaaaagagagtgagagaatgagagaagagagtttaatattttttttatgcttgttacctggtagtagtactattgcctgctatagttattacctcctctactacccacctccacaatgttaaagtaggtagtaaggggtcttactacccacttttcatccacattgttgatgccctaagtactgtgaaaacgccctatttgttacaaagacaatgaacacaatcgtagtggtaggtagacatggtgcattttttcaaaaaaaagagaagaaattatagatcctgatatctatatctttaatatacgtatccaagcgtcgccataatatggctttcgagtttattgcactgagaacacccaagtccgaagttgatatcacccatggaaaagatagcaaccggtacttcgattcataaaaccgctttctacatctgtatggtacagtggatatacagtggaagattattatctgcaatatgatctggtggccacaagttggatggcccaatccaatgacaagctccaacttgtctacggaactcgaatagacatctcaattattggccatcgaatggaatggagatcgatccatcgatcgaacatctcacctcttggcatcgattcttccatcttcagagtatgcacatgctctgatatgctcatgaagaagtactcacaatcatggtagttacatacaacccatgcttcacctggagatcgattaatcagtagcttctgtagctctgttcctatagcaaattttaacttcagtaaagaaaaaaaaaaccatctctgaacttaattctctcgctgatgtccatgcatatgtacttgagtctacatgacatttctctgtcatgagagacaaacaaacacaaatgtacggtgtgagtacggtgatgcatactacaccctgctacgtacaaacatgccgtcacagttgacgatcagagtgaacagtttgactgatcgacagtattgcaacaatcgtgctccaggccgtgtctaatccttgaacagtattcgagtagtgatctgatctcagagacggcaaagatttgtcatctcaagagggcgacatgaacaaggtacatcactattatgtgtttgttgctttggaaaatccgtatcatcatactagtaatactactgtacccatctaatcaggttagctgtacatcttagatctttttcttctcgtcctctctaaaaaaaaaagatctcctttcttttttgtcatgaaagtagctataggtttttcatgatggtccaatgaccaaaaccaaaaaaagagtacacttgatggcgccttttccgcttttaagtttcagcaagttggagacgaatgaagcgtcccccggtgatccggtccccttcttatcccatcacgaattcgcgcgtggccgggtgactcatagtccactcaatgctaccaaggtttattttctgagtaaggatgcagattctattctcatttttattagcacataatttaaaccgctaaacaatatttttttaaaaaactttctatcgataaattcattttttcaaatttatagtaataattaaaacttaattaattacatgctaatgttttttttaattcgtatcctaacttcatgctaaggttatcctaagagacgcactcgctgtgtgcggcccaaacgagcagtcttttcgatgtggaggtttcagataaccttagcgagctctaaagcgaaatttttcataaatacaagtatacatatatgctttgcttatctcggtggagaagttgattccagctttggttttgtgtgatttggcggcgatcgatctctgtcggccggctggtcagatagattaatccggtaacgttttaggtatgttttggaataaagcgagagcactatcctgctagctttatggaagtgtgtttagtgtgggttattaattacaagctaatgatactccagctgattaatcagggccggtttggtgcagacatatctctgtctatcagctgcgacgtgtgatgtgtatatacatgcaatgctttggttaattgcttgtgtggtcgaattagtggcttgctaaacctcttttttgtggtgaaagtggctcatcaatctttggctatagtactgctagtgcttttgtttttgattgatgtgctacacatgttgaatcctctgttggctttggctcatgactgtttggaaacgtcatttttttgcgactttctgcagtgctttttcactaggtttgattgctgcggtcgtggaggaaaatgacagcacaacgcaacactgtgttccctcattgtttttcaactaaggagacaatagtacagcgatcatgatagaactacagatgtcacggtttgtgcttataaaattgatgacacgagatttggcctgtctgagatgcataggagcccagcccagatagcccatcaacctggcccgatcattcagaccaatttgttttttttttcttctacattttacccggtccctacatacaaccgatatatgcagcattttttatatactcctttcgtcccataatataagggattttggatgaatgtgacatatcctatgtctagattcattgcactaggatgtgttatattcacccaaaatcccttatattataggacggagggagtatattgaatttagtgcttcaaacaaccccttggaacttagttactcaaacaatccaatctgaaattcgatcctatgaagatttcaactcaggatttagggtgctactcatgtcattgtaataagagatcttttacggtgtttgcgaggtatttagaggtggaataatgtgcaccgttgatcaagagaggggcaaggtacggaacaaaattattgtaacatgatggcatttgagtaattaactagtaaaacataggcaatacatttgaattgaatacctccttccattggtcggtgtatcgtagtagctattggtatcgttgtagagaaaaaagtaaatcaaggatactccgttgatttagggattgattcgattatatcaaaaagtaaatcgtgtctcctttcttctctccctttggttcgttcgtgctctagggtttgaaccagttcatctccgacgttgtcgccagcagcggagccacctccgctgccacctaaagttcctcccatcacccacaccggtgccggtgcggcagtgcaacctgcgtctctcccatcgctagtgccggtgaaggcccgtacgttgccatcttcctcttccccaggttggacatggcgctaacgaccagattaatggcactcaccggcttgccgctagacatggacgtggagaccaaatctgcaagtgcaattcacgcatgtgctatagatctatggaaatgtcctctctttgcaactccatctgcttcgttggtcttgcgagaactagttcatgagcaagcaaatgacctaaatgacgatgacatggatactactgaagctgggattggtgatgaaaatgaggctttcatagatgacgaaaatgaaaattatatggatttcgagtacgttcgtcaccaattgctagcccaaggccagaaacatgttataagaacacaatgtaaatctaaagaaaatcacgtaaaagagaacatcaaacaatacaaagtaaatctagagaaaatgaattaagaacctgttacgctagtgccgtgtaaatgacctaactcaaacacaacgtaaatctacaggaaaaccacgcaaaagtgacacaaataagaacatgtaacgctggtaccaggtagatgttaactcgtacagtcgtacctacttagtacctattataatttgggggggggggcaattttaccctttttgctctattaacaaaattatatttttatccttagtacctaagtatctatactaatacttaaataccttttatatagtatctgtgattgagaactgttggatctttaccttttttggaatgcaaacaccgtaaaagttctcttgtactaaactatatgccctttagcagaccagctgttttggcccgatcaactaaattttttgcaactggtctagtcttatttacaactcttgacagcagtagtacatggtaaactaaggtcaattttgctatatatttgtcaacaaattttctcctaaaaatttgacggatgttgtaattacactataacttatatgtaattacattgtaactataatgtaacttgtatgtaatattcaaaaatctcttcgtaacatgttatttcggtaaaatggaggtcgtgggaacaaatcttctcacatatgtgtgtgctgtgattttttttcttcctcagcagaacaaatcttgtaagagatttaacgattcaaaattacgtgaaacttacatacaagttacactgtagttacatgcaagttacagtgtaattacatacaagttatagtataattgcactacgattgtattataattacacgtgtcaaatttttaggagaaaatttgtcaacaaatgtatagttgatcccaactaagataaagagaccagctatagcttagggctatgtgtaatacagcagcgggcacgcgtgggacgtgcacgaatcggtctcgatcgcatctagtaggcactacgcggcagagcagggcggcgatcgacgcgcggaagatgcggccagtgggaatcgatcagcgggggaagtggatgctctgacgttagtgttcgcggtgacgttacttcatcgtgactgacatgtggaccccaccactcttgagcccacatgtcaaccaccaagttagtggaagttacgtcagaggatctcaatccattggcgggggtagcgggctggagtgggtgctaccaagcgtcgcttgactacacgcaggtgaatgacgtgcaagggatgaaccagacgaggtcattgctgatgtcgacgaagagcgacatggagcaggccgtggactgagagtgacatcgtgtagttgcttcccggcgcaagagctggcacaaatggggaagagaggggagagggaatgtgcatcccaggttatttatttatttattaggatgccacatcagctaaaacatgtatctatacgagaaaatatataatatgtcactgtatatgtgggggtttcgatgaaatgccatttaatagaatgcacagaataaaataccactcattatgttgcctatcggaggaaataccactttggggggggggggtttaatcatttctatgcccgaaatgcccctggctatgggagggagggagggagagcgagagagagagagaggagcgctggggaccgagcgggtaacaccagaggcctcacaaggtggcggctgcgggcgacaaggtggcaagcgggcgaatgaacggtggcgggtacaacagggtagagaaagaggcgacgacatgtaaagaggaggatgggatggcgaccggtgagcgtgctcgctggaaggcggcaacaacggggggagggaagggaggaggaggaggaggagacgacacgggggaggaaaacagagtagcagtgcctaagtggctatggagacaacgaccatctgaagctccacctctgccgcggtgatctcgtcctcatcatcgcctactcctccctctgccccgttgtcctctccactgccgtgtcctcctccccccatatattgtccccacaagctctatcgctttccagcgagacctctagcgccgccgtccctagtgctcccctttccccctctctcttcacagctagggactttttggtcatagagatggttaaagctctccaaagtggtatttttcatccattaggctacgtactaggtggtattttatccggtgtattctattgagtggtatttcatcgaaaccccatatatagagtgcatattgtccattttctccttagggcttgatttggatgattttgctaggtgaagatttttggtattgtgatttagggatgtcaattaaacatgacgtaaagataggatgataagtggtcctattccatgtacaaataaagaccatgggccacatctgtatgtattggttgagatttttcagatactatgggcctgtttggtaggggtcgaaactccaactccagtgagagctggctcctataagagctgaggtgggtatagaaaatgtttggctagactactcagctctacaccaccacattcctcgtcaccatttcatggcaacctaccgttgtcgccgcctgcgcaccgcgccgcctggcaacccgcgggccgccgccacgggtcatcccacgtccaccgctgcggggtagcccgcgagccgccgccgccagtcagcccacgcctgccgcctgtcgacgttgccacctcgagctgccgccgccgattagcctacgagccgggccgcagcctgtcgacgccgccgccatcgcctgctgccctcgccatcgcgtgccgcccaccgccgcgttcgcggcctgccgccacgaccgcggcccgtcgccgtccgccgtcactgcctactgccgccgacgcgactcggccgccgcctgtcaccatcgacacagacgcaggcgctgctaccacatccggccgtttgaaggaggatgggggaggagagagaatgggaggagatgggataggaaggggtagttcaatggaatttctgtgtaaatacactaaaaaaataaaagggtagtgggtttttgaggtgcagtggagctgtggagcagcaaaaattcaattccacccctatagtacaaatttgtggagtagctttgctaactccgcttcgaaaaataaagaatttgtattgtttggcacagctcacagctcttggtaagttggagttgggagagctacgccaaatggagcctatgtgcatctcttaatgtatgactaaatccataaagttaagaaacaacttagaaaaatttatctaagcaataccgatgtacaattcttttgtaagaaatcttgtttttgaaagcatatcaataataatccacacctccattaattggtaaaatatacttgcaactcactcagaaaactgtcattccaaaattccatcagctttgttatagatcaccaaaatctttatttgtcactcttgtggaggttgatgccaccaaactatcacaacaaaccatcgccaccaatcggagcgaaaataataggatgttaactagctaaatctatatgaaaagtaaacataaatgtttggtgcaaatttttaaaaattgtatacatcctgttgggtatcgtacactcatccacatattattgaatgattgttgaagatactctatcgatttaagaaggttttattatttcccaacaaaaaattcaataaacaatcatagagcttgctgaataagcattttctgaataagagaatgttatatttgtttctcaccaagatctcacacaaaatatataagctttgaaattagaacccattaccaaacagatttaaaattagaactcacctatggccgaagatttatagtgtaccaatagcagcatattcctatacttttcccttggtatgattttttttcagttctaagttttcacatgcaatttgtgcgacgaggatgcacaagctgcgtgtctcgtcatgttttttttagcctgccggcattgcgacatggtctttagtttctcaggcgactcggcacggacaggcggcggtttagttacagctgcttgtcggataagggtccgatcagctttacttttacctgaaattttgcctgagccaaagacagacgactcaaaaattaactatgggtaatataaaaaacaatccaagaggtgcaaatttgaatttttttttcttaaagagatgctgaaacctcagatagttggtttgtatgggcttgttccatacataaacgatcgttagtggcacgtaatagaagagttacagagtagtagtagtactatcattcactgagtatagtacagaaaattggtaggaagtaatattattcagcagtacagagaagtatttatcgtgcgacgcttaccatagaagtgcaaacagtaaccgttacttagagcaattgtgtgctacctctaaaaatgacacataggattagattatgaggtagagaagagaagtgaggagagagatgaggaaccacccccaaatcaagaggtagcctccacacaaactccaaaaaaaaatatgagagtactaaacgcattgatatttgtttattagagtgaatgaaataaataaattagggatagcaataatcacatctactgtagcacttgccatccgtagatcgaacaaaaaaatactactactgttttataaagaataggttcaattcccttaaaacaatcctataaaaacgtacatttataacatatgatataatatacgcttgttaaaaaaactaggaaggtaacccgcgcgaatgcgcaggtaagtatgtttttttacacgcgtttgacaatttgtcttatttaacatttttatgcaaacatgtgaaaatgtaagtcatgcttaagttataaagcaagtcacatcaaaataaactaaatattatttattttcaatataaataaatcatcgaacttgtactgaaaattcaacagcatcatctatcgaaaattgtacctttaataatcgtacaaatttttcaaaaatattatttatcgacattgtttatttttaagctttttgttagatacacatgtttatcatgtttatagatcaatactcactttgtaaagtataagtatatttggatttggtacggtgtttgagatactggattgtttgcaatttagaaaaaaaatattttataaatagacccctagaagaattattccagaaatgatattttttatgtgccagagtggctagtgctatcatccaacatggcggcgcgtccccatgcaactatggtaccgcgtggccgaccgtagctgacatggcaggagaatggcgccgaccccctccccttcataaggcatcaacgcctctgtggcgcgctcaccctaaggggtgggcagcacttaatccgctcgggccccaccccctccccctccccactcattcgccctcttctcccctacccgagcccgagaagagttcttgctttctttccccctcacctttccttatcaaatccactcgttttgaagccattttttacgagaatttttgggtacattgaagagcaaggtatactccacgcccctcctcccgggtctttttttcgttttacttggtgaaatttgtagatcggaggttaaccctataatccattctttgcccaaatttatgaatttgatcattgaaattggggatttgttgataatagtgttacatgtttgctatgtactcactggtgctacgatttttttaagtatgtatgcggtaatgttgattaagtttaacatgtttgacatatcactattttaaatacgcttacattttgcttctaaaaatatacttataattttggaacagaaaaagtgtatgataggataatccacatattaaattgttctctaatatttgcaaatcggtttatggcatgtatagtgtaagaatatggatccatgtaccatatattacttataatataactactaattaaattattttttatattaattattagctagaaaatagaagacgttagcttaaaaaaaaggacacgggaggggagggagtacgtacgtgtatttctaaacaataatagatctaatcaatttaattagtgggtccaccagttaagggaaaatcaatggttgggattttttttcagaatatttaggatctttctaatttattagaggccacgtggcggctcaggagcgcttatagaaatcccacgtgacggcttgagagtgtttctagaaagtttaatggacttttagtatataatagatagatagatagataattacattcatcaaataggataaaatatatgcttcattttttttgaaaaacgtgtttcatagagtgcgagttcataanataaaaatgtntnttatatgcactcttaaatgatgatttgttctattaactatacatgtaacacatctatagtaatggcgatggtggtggttctgccaccacactaccaactgacatgtgggattataggtccatgtgaggaaatagacacaacaaatatttttaaccttatctagtgtttaaacaaaacaatggacatgatttgaagttttgaaccatatttttttataacgtgtcaatttgacatattaagcatgaaaaaataagcgtgaaaaattatcttaaaaatcaacttttgaaatttaaattttgttatggcttataattaacaggtagatgatgttaggtaaaaacttgaaaaaatattttataatttctaagaaaatccgatgcagcgcacatgtccttggctagttgttcaaaaatatctttgaatgaaacttgctcctatgctaataatcatccggaataatgaatttagacctaaactcattgtttatatttaaaaataacatctagccattttagatgccactaatcgccgtgcttcacatatttcaaagaacaaccgttttagtgtattcagaattttcttttcttaacaatgcagtctgtgaaattaaaaggacaatcaaggtatttattggcagaggtattattgttaaccattcacataaactacatgagtggttgaatatatatgaccatccacagcattaagttatacaacaacatatccctcgtctactttgcttttgatttgcaagagagtagtagatcggaaggctctggaatctgaatagagtgtttctttaatcattaccaaacgttttttcgagtatgtttttcaaaagttatttagttgttgttgttattggagtatcttctagatattactgtgcatgtgtgtgcatgagaaagtgtgcattgcacagcccatgcaagtttctatcttttttttttaccactggtaaatccttgatttatctcaaatgttaaaagtgccaagtggcccaatcagaagcgggcaaacctgccggcttgagaatatttgactagaaacaacggcgcggccttgccgcgctcaactgacattggaccaatgtaatttgtcgaaattaacagtagctattacattaagaaaaatcaattatatacccctccaaagatctccatgccgcttatgcaccgtaggtccataacaacttgtgattttgctaggaaccagcagtattcacttcccttgcgaaaatcgattatgtgcaggaataatttgctgctgctgctgctatgctctagaactctttggccactgcaaatcctggatttgtgcacattttttccacagctagagcacttcctagccatgcttattaatgattgatgatggaagatggaacagatggcacaataagctcaacatagagttcttctccctgtccctgtggctagataattaagctggtgtgtgtacagtgttatagctagaggcttaataaaggggcaataaaatgtgataggggctagttgggaaatcatctagcactcccgcgtgaaagaaatggacatcttggcatcacctccctatggtagacatttcagggcaaaaatatgtcctattttttttcaaacatgtgtatagaaccaaccgaatgagtacaggtgtctgttaaactgaaaatgggatagcccacatgaacgtattaaggatggaccatcaagctgctaattaaggacaaaaaggaagagcacatgatcaggtgcgttcaacaacaaacctttatttccacagtttcactgccatcttaaaaagtcattgtatcactgaagtgcagttgtgctctgcaaattatatataactcgtggaaggtaaaaaaaatcgctataaatagatgaagtgtgatcaaaactttcaaaaatgacacaattgctagctgcggcagctggcagattcttttgttacccctgcttgcactttggcaagtcattccttgcagttgtaaacaaataacatttgttgtttggcaaatttaaatttgtaaacaacatacatcaagtcattccctgctaatgtttcccatatttccagcaattgacagtatatataaagagtatgaattagttatgtgaatatctgaaatttagaatgcactaaacagaatagagaacttcaaaataagccttatctgtgttcatcacacaaccacctaacaaaattcgttgtgcactaatataaaaattcaagtttagcaagaacagaccaacattttggctattcacttcatacaaatagaatgaaaggtgaatgccaggttgagggacaaaccaatagaaagctgagtattgcactgttggtccaatttctcacatattttcatgcaaaattataaaagaaactgtatattcagcacaaaccaaaccaatgatatgcaattaggaacctgaagacattaatttttcaaggaacagtttctgttacaagcatgacatacattcctttgtaatcacaactcgtccaatagaaaactgagatattattttccttcatggaagtttgcattgcatcttccaagtgttggctcagtgctttcatttaccgtgtagtgagaagaccagggtataacatatctgttgaaacatgtggcatgactaattaagagcattacaagcaaaattaccttcagcatataagaaaaaaaaatagcagctaactggaaagggacagtatagttaagaatacaaactggaaaaggaatgtgtgtcatgcttgattaattccataagtaaattacttccgtagttgcatctccatgttctcaatggatgacaaactgtaaattatcgaagacataaatatagactgtctattacatagacatacattgttcaaacctgaaatgatcaccgcttttgataaaggtccatttcaattttctgataagtgcatctcaaaattataagatagatcacatcacaaagtagctacaggttttgaccagctttgaccctcatttcatctacatatcaatgttctgacctctaaccttatgggcaactacctgcagctaagctagatccaagaatacaaatcggaatgttataatacatgcataaactaatgccacactctacaacagaagaagacctcagatcttctagcgcagtaatgatttgctcacgcacaagctccgtactcttcaaataaacctccagattgagtatctgctgctgccacccaatcttggggttcgcccccccccccccacccccaaaatcccattcccaagctcattgctgaagcagtctacccagccacagcgattgaactgatgaactccttcagaagcggtgacggagttggagtgctttggacagcctcctcgttggcacccctggcatatgcgcaattagcggagttgagttctccatagcagcaaggagcggctttgatgagctccatcagttgaagtcaatgcaggcgtcaaagacaatgctggggcctccggctcagttttcgtttcgtttgaaacagcaaatcgctacacagccaacaataaccagtaggagtatttcaaaataatctaaggcagattactgacaaagtgacaagtttatgcacacttagcgagctaagtttgaaagcataacaagctatcctccattacttcaattgcaacagggcacctgaaaatatgatacacaattccttcatataacaaggaaaagacataactcacacaagtggttgaccatcgggtctgctcgccttcttggccagggcgctaatcgtcacgctcggccgacgcgcgcaggctcgtcgcgggggtcgctgtcgcgcgcaacgccgtaattgccgcgaccaacctaaggctggcgcgcgcgctcgctgtatacgcggtgctccgggtggcgatggtggtccggcgcttgtcgccagggcgctcgccgagggaggatgcgctaaccttcgcagcacgatggtcgacgccggagacgccgtgctcggcaggtacccgcgcggccgcagcaagtggaggcggagggggtagagagacggcacggaggggtagaaatagctcgtcatcgtgacgtcgacctcgtcgcgcgactctgggaggaacgcgcgacggccgccgcagccgtgttgcggacgcactccacgccggtggcgagcctcatccacctcacgtccaagaaacgcgtaatcctcggccttctccaattccgggtgaaactcccgcgcgccgtgggatctgcctggccccgcgaggccctagccggtggtggccgccgagaggccgcggacgagcgcgtccggtggagagatcagggcgaaacgggcggaggtttgtggcggcggcgcacgggaggggatgagggagcagaggatgggtggatagggattgctttgcttctgcaaaaagactgttcaaacatggtatattacaacgaggtccacaacagcgaaccatcaccgtcgatcagcgatccgacggctgcgcgtggggactaaatgctagaatcgcggtgcgccacgtggcggggctttttgcacgagaatccgcccagaattcggtattagagattagcaataaaaaataatttatatctgtgtttaaggtttaaaagcctatgctcaaaaaatataatacgacaaaaaaataaattttagttgtggctgataagttaaagagcaaacgatgatgcagtatatatgttctttgctttttcaatatatatattctgttttcaggaaaaatacgtagtgtaaacatcaaaactctcgctttagattctatagtattttaattgtattcattacatgtttcctttgtttccttcattccgatcgctacctccgtatcggtttgggatggggcagcaaccaggccatggcccatgggcctagtaaagggatgactagggattgggaaaagtacacccaaggtccctcaacttgtcatcaagttacaaaatcgtcccccaaccaaaaatcagaaacaacgcaacccccaacttaaaaaactagtgcaaactaggtccctcggcggttttgaccccggctgagttagtatgggacccacgtgggccacacatgtcaggatgccacgtcggcggccagcctctcccttcctgtcctgaccgggcgcatggtcgggcacaatgggtcccatatgtaagtgaattaaaggtaaatgggtggatttaacagagaaactaggcatggtggggcccgcatgtttgtgagacattagagtgagattaggggaggattacagtgcggatctgattaggaaatcgtggggcccacgtgggtctacacgtcggtgtctttgctcctcctctccatcctctcggtctctcctaccattcccctttgagttgagagtgaggacggcggaggccggcggggcggaggaaccggtgtgaggaggctgtggccggggtcggcatcctggaggcggcgctccccctggcgcaccagcagcggagagcaggggaggagcggtggcctaggaagggtgtcgccgcggggccggcgatggacagcgcggcgcggaacgacaaccagcgtcgcaacggcggagggcaacggagcatagggggcgcgggaaggagtggacgcggagccgccagtcagcgtccgcgaagaggcgcgcgtggaggccgccacgcgggcgcctggtgtggtgcgacggcggtcccggagggcggcggcagcctcggtgatgctccggccgatggaggcaaaggggctaggtggtcgcggaggcggcgcccgtgcgggccggctatggcgtggagcgagcccgtgataggatggcgcaatggcggcggtggcaagcttgctcggggaggtggaaagatggcgacgggggatgggaaggtggtgaatggtggtgcggggcggatttcatggccgacggtaataggccagatgtggggaggaggtcgcccacgccttcggcttccgcttctgggtcggtgccggcctcccctcctacgttggcagccaccatcgccgccgcctctccgccaccgcgcttgcccgccgacgccgcctcaccctgccgccgccctacccttctcccgtgtctccgccgccgcgtcacctccgccgcatcgtcggccggccatcggacctcctcgtcctggcaacgtcctccacaccgagagaagagtgagagagagagaaaggaggaaaggagaggaagggagatgctggcctgtcgacgtggcatcctgacatgtgggtctcatgttgactcagctgccacgtcgaacaaaatcggggtcaaaaccaccgagggacctagtttgcactggttttgtaagttgggggatgcgttgtatccggttttatggttgggggatgattttgtaactcgataacaagttgagggaccttcggtgtactttttccctagggattggacatttgatcccaatcaaaactcagaacggtgtgtcaccgtacaagaaaacatatcatcatcttcttcccctactccagtgactagatcagtttgttctccctactccaatggctggatatacttcttcctccactctggcaaccgaatccaccaaatagtactaccatttcttcataaacatacctcctccacctcctcttccaccgcacaggtaccaacatgttgatgaaaaatccatgcttggccgatggtgccaaatctgtgttggcgcgaactaagttgatgaacacaatggccagagatatctacttagttctagtgcaggtccaaaatattgatgagatatgggcctgccggtcagtttgatcctccaactgacaagatagataaatatgttgatcaccaaaaagccgatcggctaacgagccgatagaacgataccagctgatgttgatagggttttgaagaattggctatatatccaaagtatattctaacacttgagtaaataatgatataaagacagtcggctgatgataatgtaataaaatgacaatataaactagtagaaaccaatcggctaataatgataatatagaataagcgttgatccgaaggttaaagcatacatcggctggaggtccaatgtcattaaatccaaaagattagataaacaatgaaccctttcttgcgaacgactaaatccaacttgtatataatccttataagccgatgcgacgtctagataactcatcgtctgaaatcccgataaaacctttattggcaatcaaaaagtaggctagagactatggttctaagcacgacttagtaggtcaaacctaattgatgtagcactaagtatgaaaagaaacataatacctgacaatcaattcttgactgatttttagggtggtagatattttagttaatctagattgacaaaataatttagtcgataccggcaaaaccgttgaaaagatatgacagatacaagtaaattgaataatcgacatagattaactaagatatatgataaataggtaggcaaatatatcaaccgaaccagagcgatccaagaggtcgaagcgatgcagtcttgaacagcaccaatgtaggcgacacaattgccagccccgtgtcaggtgccaagttccgccagcgataagtaaaaatctcggaaaaagggtggcgatgcaccaagagtagttgtattgatcgagagatagattatgtcgatgagggatacccgtagactggataaataaggtattggagtatgttgataggaggatctacacgatatgacatcactactagaaaaacaatttttcgtggcgtcacactataattttcaccggcggttatatgctaaaactgacagcaaaaacgtaaggaggggtggggggtataggatcaccagcgaaaatcgattttcgttggcagccacgttaagagatccgccataaaaaatactatatttttcgaggtggacctcttaaatgtccgccagcgaaaacgacattttcactggtggctactaaagagatccgccagcgaaaaacaaagccacgctaaaatttttatgacggtatttaaaaccacgtgcgcgagataaggatttcacccacccacccatccacccacttcctctctcctctatatccttctctccacccacctacccatgccctctcctcctcgtcccccatctctctcccctcctccttccctgcgcccctagcctcctcctcctgccggtgactggcgacggcgatgacggtgaccacgacgggcaggagggctgcgggcagcggatgtgcacgccgacgacgctggcctgccctccccttccttttccagatctagccgaagggaggaggcggcggccgccgtggcggcgacggtaggcgggcggcggcggagctgacgacgacgacggcgacgatgctaccggatctggtggctccttccctcccctccctctccctctcccagatctagccagagggagggggcagcggctgccgcggcggcgacgccaggcgggcggcggcggagttgacgacgacgacaacgctgccggatctggcggctcctcgcctcgcctcgcctcgcctcgcctccctccccctctcctagatctagccggagggaaggggcggcgatcaccacggtagcgacggcaggcgggcggcagcgaagctgacgatgacgaccgcaactgtggtgacggggctgatggtggcggtggctaggtcgcgggagagctctagtcgcgggaggggatggggccaatggtggctagggttccattgctagatgtgaatttttttgtgcatgttgttccagatgatgcctatgttttgatttgtatttcatgtttgatctgtgtaaatgatttgcatttcaaatttcctctctgctggcagctagggcagctacattgggtctacttttttggcccaaaataattttttctggcggtcgttgtaacatagccgccagcgaaaatgaattatcactggcggtcggtgtaagacacccgctagcgaaaatggatctttgttggcagttggcttaagacggccaccaacgaaaatgaattatcgctggcggtcgatattgctttgtgacggctccaaattctgctagtgaagactcaaaatggccgccacgaaagatggtttcgtagtagtgcatctaacaatcaaggagacaaagattatactagtttaggctcctcgtaaggtaatagctctaatccagtttatatgagattgatatggaaaaccacatagtacaaagggaacagatgaattcggcgtttctggcgagatccttgtcgagatgattcgacaagatctctcggcgggtaggcttcacgtcctcccgcttcgtaaactatggtgggtgtgttggtactatgattcgatgatctgaacaattcagggggtgtgctttttataccgtgagttgccttagtctccaagtagaactcggagacaacgaatcctgtatgatatagaataaacccaatcctcttcgagtaggactctgatagtcacttgcccgtgaggatattttccataatatcttgtagattttcttatcgcatatggaaacacatcatatacatgaaggtatacccagattacaatgaatccgggtgtacatacttatgcccatcaacacatgtttcctaaagataaaagtaaagatataagtcctgatcggacactaaataaacacttcctaaagataaaaaggaatttactaaatcctgcctaattaatagatagaattaagccaacatgccatagtcttcacgatttattcttgagctcggtctcttctggataagtttccatcggctgattgtgctatttccttaaccgaatccactaaaaattttttaccaaaatttgatgttaacacaacaccagcgaagcctccaggcatcaaccctcccgttgttctgctccctctccttcccctgctcgccaccagcacgccaacgtgccagtgccaccattgatgacgagttggatctccctgccacgcgacgcccttaaaatcaattggaggggatgaagaagattgtggaggagggagaagggagccagcagggaggagggaggatcttttggcggaagtggtggctttgcatcgaggggggggggggaggggttgttgttgcttgtgtgggaccatcgaggtgaggataagggacactcgcgtccaagtcactactacagataagggctatagtagcacaaccttgtaaagcatgaagaaagatgttgctgagaaatattgcagtagcactaaatatgtgttacacactaaggttgtaacacattctaaagcaagtcagagacagtgttacaggaaagacaatagtagcatataacatgtgttacgatgggtggttatcagcttcctgcatggaactgcgagtatctttacatttgtgacaatggtttgtactaaaaagtacagttatctaaatttactacttcaatgcgaaacttgatggaacatgctatgcacgaaacacaaaaattgaggttttgttgacggagttatacagagaaatcaggagaacccaaaattaataccagagctgttgggccatcaaaactattgaggttatgctgaatgtgagctaaaattggttcatgaagcataagaatcttccatgagagcaaggttgcctaaaagtgatgatatcatcaaacaattgaagcaagtggtgcttttgaaacattttcatgtatacaaaagctgtggctaacatacatgaaaaaatagtagaaagagagacagcagccagagaagatgttttacagtccagtttgtttaaaaattaaccatcttgagcaatacaagggaaaatcttctatacgccgatctgaaggatttcttgtgcacattcacagttgacatctgcataagatcaaagagggaagacataaaactaaatgaagaaatgtatttgtgtaaaggaaaataaaattctataaatggataaacccaaacttttgttctaattgagttcagaacttgaaacataacaatgggaaatttttacaacaaacacagcatgcacatttttgaaatgcccacaacaaaaaaaattaagtgcatagaactagaaaccagacaatgaaaagagaagtacagttaacattgccttgctacattaggaacaaatatcagttatgagcagtattcatctaagaaaaacacatcagtgcaaaaagaaagaaatagatgcatattactatcatgaattatgtacactgttttgtgcatagacaaaaaatcatgacttgagttttcacattgaagtatggcatccagctttatttcattgcactattctgaaacactgtcaagagtcaagactattgaagacaaagttcatacactaattctcatccccatcattaaaagtttagccagttatgtaacttttttaactggacttcaaactctgaactctgtaccagtaatctgtaacttttgaagttatagcttcagttctcccttaattcctacaaatattcacatttttcccagtatgtacatgctaaaataaatcaaaggcatcaaacatgttaatacatgcacttattcacatttattccaatatgtatttgctaaaacaaataaagaaaacgcttgtcataacatgctccggcattaagattcatggcattggctcattgatgcaaagaatagtttttgtgagcatacctactgacactagtcactaatgtactttcagaccagcaatatacttcaatcagaactatgcacaagaagaatgactgcatcaagctgcatctgccaattaaatgaaatttcatctccgcactgaagcagaacagagataaaaccatccatgggtgcaagaacagatcaagcctgttcactccagattatgggagaagcaaatatgttcctttcgataagatgagaagcgaaagagctaccggtgagaggggcaccaatgcaggaaccggaggtggaggaggtctgcaacgtggctcagcccaatgttgaataaaccccggcgcgttctagttaggatagttagttgagtttccttgttttcagctgagcccgagttttgggcttgtcttgtacagaggctcgacgtgtgcacgttcacgcgggagtctggtagtcgtgagcgagtctcgcggcacgctcgagctgtgggatggcgcagttcgtgaagagcgtggcgtgcggtgcgcgcgtcatggccggcatggccatatgtctttttctcctataaatagcaagagctacagaaaacgcggtgattctgttatggccgcactaattccctgtccacgttcgtgtgtgttctgtgttgtgttgcagctcccactccggcgagcgctccgacaccggcgagggtcggaacagttggtatcagagcggaagatcgtctggcggccattctccgctccgtcccatcggagatgcttcccacgctccgtggcaagcgctcggcgcgagctgcgtgggacgtgatcaagacgatccgcgtcggcgtcgagcgcgtgcgcgagagcaaggcgcagcagctccggcgtgagttcgcggcgctgacctggaaggagggggagaccgccgaggacttctccgtgcgcatcaccggcctcgccaacaacctccgcacgctcggcgacaacatctccgatgccgacgtcgtccgcaagatgcttgacgtcgtccccgagcacctggaacagatcgccatcgcggtcgagacgctccttgacctgaacaccgtttcggtcgaggaggtgaccgggcggcttcgcgctgttgagcaacggcgtcacaggtcggggcccgtcgtcgacaactaggggcggctcctcctaacgcaggaggagtggatggcgaagctcaagaaccccggagcgtccggagagaaggggacccccagcgggtccggcggctccggcggaggcggcaacaagcgtaccgggggatcgcgcgggcacgaccgcggcaaaggcggcactcgccaggctgccgggcctggagacggctcgaaccagcccaagaagacggacaagtgctactgcggcaagaagggccattgggctaaggaatgccggtcacggttgcgggacgaggcccatctggcccaaggcgaagaagaggaggagcccatgctgatggttgccacggcgcaagtcaacgccatctcgtcttcttccccgcgccgctccacatcgctgccggcgcttgaacagatccacctcgacgagagtaagctcttcgttcagctgggcggtgagcacgaaggagaagccaccagatggatcctcgacatgggcgccatcaaccacatgacggggacgcgatcagccttctccgagctggacaccggcatccgtggcacggtcaagttcggggacggctccgtcgtcggcattgaagggcgtggccccgtcctcttcaagtgcaaggatggggaacatcaggcgctggagggagtgtaccacattccgcgcctcaccgccaacatcgtcagcctggggcagctcgacgaggagaagttcaagtggagctgtgaagatggagtcctcaagatctgggacaagcagcgtcgactactcgccaaggtggtgcgctcgccgacccgcctctacgtcgtcaagctcaacatcggaaggccggtctgcctgcggcacaagggagcgacatcgcctggcattggcacgcaagattcggccacctcaacttccgcgcgctcgaaaagcttggtcgcgacgtcagggtgcgcgggcttcccctgatcaaccaggttgatcaagtctgtgacagctgcctggccgggaagcagcggcgcctgcccttctcgtccaaggccaagtaccgcgcgaaagaaaaactcgagctggtgcatggggacatctgctggccggtgacgccggcgatgccaagcgggaacaagctgttccttctcctcgtcgataacccattggcatcccactgtcatcaatcattacgcctccaccagtcaacctaacccattggcatcggaacagagggaccttgagaggaccatagtcaagttcccatatgtcctcgatggcaccgtaatacgtgccagttgttccatcgtgtcctatggcatcgatacgaacagcgctgttttggttcgtgctcttcatgtcttgggctctcgtgtagaatgtgtacccattgatctcatatccctggaatgtcgcgatcgacccagattgtcccctcgccaggaaagccagttgttggttgatcgtctcgttacccatgagaggttgtcataaccacgcggggaaagtatcaatgtgatgccgtgtaatccatgcatcggacttaccgatgtttctggcgcgaactagagccaagtgctcctcgatgtaaggagctaccaatgaagattgttgcagaaccgtgaaatgggctttacggaataaattgttgtctaccgtcattattgctttccttccgagagttccctttccccatagtctcccttcatggcgtgattcaggtaccccgattgggcgaaggtcttcaataaattctacgcaaaattcgatgacctcctctgttccataccccttggcgatgcttgcctctagacgagcacggttacgaacatacttcttcagaatgcccatgtacctctcgaaaggaaacatgttgtgtaggtacacaggcccgagaatactgatctctttgacaaggtgacaaagcagatgcgtcattatattgaaaaatgaaggtggaaatatcaactcaaaactgacaagacattgcaccacatcattctgaagggcttctaatctatccggatcaatgaccttctgcgaaattgcgttcatgaaagcacatagctttgttattgttgcccggacattgtctggaaggataccccttattacaactggtagcagttgtgtcatcaacacatgacagtcatgagactttaggtttgtgaacttcttctccttcgtgcttattattcgcttgatattcgtggagtatccagacggtacctttatgctatccaagcattcaaacatactttccttctctgccttgctaagagtgtagctggctggactcaagtaatggcttcctttctcctttggttctgggtgaaggtcgccacgttgttccatatgcttcaaatcattacgtgcttccagtgtatctttcgactttccatatacacctaggaagccaagaaggtttacgcaaaggttcttagtgaggtgcatcacgtcgattgcatggcggacgtccaagaattcccaatagggtaactcccaaaatatagagttctttttccacatcgccgcgtgaccatcttcgctctctataggctggcctccaggcccctttccgaacactactttaagatctttaaccatagcaaacactgttttcccgctgcgatgtttaggcttcgtacggtggtccgccttatgttcaaagtgcttgcctttcttccgtaccgggtgatttgctgcaaggaatcgacgatgacccatgtacacaaccttcctacagtgcttaagatacgtactttctgtttcatccattcagtgagtgcaagtcttgtaccccttgttggactgaccggaaaggctgctaagtgcaggccaatcgttgatggttacgaacagcagcgcttgtaggttaaactcctcctgtttgtcctcgtcccacacggggacaccttcctttttccacaacagtttaagatcttcgaccagtggtcttaggtacacatcgatgtcgttaccaagttgcttggggccttgaataataatcggcatcattatgtacttcctcttcatgcatagccaggagggaggttgtagatacacatcgtaacgggccaagtgcagtgctatggctgctgctcatctcttcaaaaggattcatgccatccatacttaaaccaaaccgtatgtttcgtgcgtcctttccaaagtctttaaattttctgtcgatgtttcgccactgcgaaccatcggcggggtgtctcaacatcccgtcctgttgacgctcttcagcgtgccatcgcatcattctagcattccccttattcctgaacaaatgccttagccgtggtattatagggaaataccacatcaccttagcaggaattctcttctttgttagctacccgtcaacttctcctggatcgtctcgtctaatcttgtatcgtagtgctttgcaaacaggacatgcttctaggttctcgtactcctcaccgcgatataggatacaatcattcggacatgcgtgaatcttctgaacttccagtcctagagggcagactatcttcttagcctcgtacgttgtctcaggcaatttgtttccctccggaagaatgttgttgacgagtttcaataaatcgccaaatgccttgtcactaacaccattttttgccttccattgcaagaactccagagtggtatccaactttttgtgcccctgctcgcaacctgggtacaacgacgttctgtggtcctctaacatcttgtccaatttatgggcccccttttcactttcgcagtcctccttggtgtcctgcaacatctgaccaagatcatccgcaacgtcgttaccatcagcatccctttcctcctcgcccgtttgatttccttcaaatccaacgtactgagcaaagtctggaatattatcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgtatggacaacaaataaaacccttatgcctgttagcttcggccactctcaaaaaataatgcatgcctttaataaactctttggaccgccggtcagcgtacatccatcgccgatccatctacatgacatgaaaaaaaatcatacacaaataattattcttacaataatgacagtcatacaataattataaaataattacaaactctttcaacaatcatacaataatgacatatcattattcatacaaaaattataaaatattacaccaaattattcttatttactatttctaaagttttaaactaatattaatgtgttttacttcttttaattttcattttagtttgttttctattatttaagattaactttcactattttatccttctcaacaattttataaaaccttctttagcaaataaactaaatttctatatattctttcttccccacacaaattttctctctcatcaacttacaactaaattttagagacaaaaaagtgtgcaaaacatagctccaaatgtaatacgaaaaaaaaacattggaggatgaagttgctaaccttttaggcacctccgatttgtatataatcaccaaaataaattcactagaaattttggcatgacctcccctcttttttgaagaaattttaaagcttgctcgggcagctggaggaggaagaagacatatatatataggggtgggactttagtcccggttggtgttaccaaccgggactaaagttacgatccaatcgggactaaagatcaaatatgcccgttaccccttttaaccgagactaaagatcatctttagccccggtttttattgcaaccgggactattgtggaattcagccgaccgacgaaagatggtttctccaccagtggctccaaccctcttcgctgcttccccactaccatcaacgtcttccacccgcaagcttcgttgtgctgcccccatcgttctccctcgctgttgtgcatccagtgcgggggcccggtcgggttccgaggacccgccgggggcgggggtgggggagattttgccccgaactcctggtcggggtcggggcggggcgaagaatgcggggccggggccgggggcgttctacctccacccacccccgacccgccccgttgccatccctagttgagccccttcatccattttttttctttttcctttaccagatgagtgggcatcttttttttccctaaaaggggccgaatgtgagtggtggagcaccacacatacatgggccttaaaagtccacatgcatgatttttttaatataaattatttttctaataaattttaaatttgtatgtataaactttatacatacaaagtttgtacgtgtacaaattttatatgtataaagtgttaaatatgtgatccgaatttcaggcccacaatatattcgaattagttatctaataggattagttatccaataggactctactttatagaattagttttctattaggactcctagatttctcctatatatatatcccttgtaagccgtacggggagggtgcgacaactcaatgtatcccgtatcgaactccacaatagtgatcattgccggtccgcgcccgttgttttttcccgcaagggttttccacgtaaaaattcgtgtctccgttttgcatctattttcataacaagtggtatcagagcattggagatctgttccgcaattcacccgctgccgtgtttcacatctacgtcgtttcgccggttcggcgatatcgatcttccccacgctgttgtcaggagttttcggcgaaaacgactctgcgtagtcgaatcgatctgtctcgccgagatcgatcttctgccgccgcatggatttgttggctcatcaagtccgacgcggagtcggtgtttttgtgcgaggataaaaaggcgatgcagcagccgtcgtccacgcctacgcagccgcacgcgtcgaggaagcagcagccggccggtgtcatcctcgagcacacacaggtggagaaaaatcagaagccaccgagagccattgcttctgttctgatcacgtgaattaattttcacggttggaaatttgtggcacacggagtttaccaggaattaaagttctgtgcattgcttggttctgtcgaggtgaatccaaattcactttcaaaatggctatatttgcaagccaagtttactaagaggttctgcacggggatcaaaatactttgttttatgcagctagagtgtttcgcgtttctgctagggttttacaaattataccagcagattcaggattttattctcaaggcgagtttgaagtttgatctaccgctcttggattgagatgcaatattctcattatggtaagtgaagttttattatggcaagtgaagttttgcagcggggtatttacctaggaggagaagtatgctgaaaaaaaaaagagaagcacattcaagtcgtcgagagggagcctcgctcctgtctagatcacatggtgatcaaattgtccggtgaattttgctaccattgtacccaacataccaggatgttatcggggatataagtacttcgttttgtgcacaacaatttttcgcgtttctgtttggattccagatattaacgccaacagattcatgattttattcccatggcgagtttgaagtttgtgcatcagtttcacgtctctgctgggttccacaatatcataccagcagattcaggatttcttcccaatgacgagtttgaagtatggtctaacttttctggatcgagggtgttatagtatagtcatgcagactatttggcgcacattgattttatcatcatgaggttcttcggagattgaagatttttatgctacaagagaaattcgtctcaaggtggagattgttaaatatgtgatccgaattatgggcccacaatatattcggattagttattcaataggactctactttataggattagtttcctattatgactcatagatttctcttatatatttcccttgtaagccgcacggggaaggtgcgacaacccaatttatcccctacgtttgtatcgaactctacaatagtgatcattgccggtccacgcccgtggttttttcccgcaagggttttccacgtaaaaattcgtgtctccgttttgtatctattttcataacataaagttgtatggctttatacatatgtattgacttattttaattaaatataaagtgaatatatactttgttttgcttatgccaatgttaatgtacaatttatcgggctcaaggctcaatgggaagagaaacctactcggaagcgatcactactgtaggcgcccaaatacgcgtggcccatccaatcatgcggattataaaggaaaccctttctcctcgacgggcaagtctaatgggcgggtgatctctcccctcttcctcctccccttcttctcttcttactacagtataccaaaaaaaaattttaaaaaaaagttaaaaaaatttatgtatagaaatactatatataaaaaatttgaatttaaattcaaatttgaatactttttacttataaactttgggtctataaactttaggtgtctaaactttagatgtatagaaatactatatatagaaaatatttgaattcaaattcaaatttgaatcagatataattcaaattgaaatttgaatcgggcatgtaaacttttgacttataaattttggatctataaactttaggtatataaactttagatgtatagaaatactatatatagaaaatatataattcaaattcaaatttgaatcgggtatataaactttagttctataaactttagttctataaactttaggtgtataaactttagatgtatataaatactatatatgaaaaatatttgaattcaaattcaaatttgaatcagatatttgaattcaaatttaaatttgaattagatataattcaaattcaaatttgaatcggatatataaacttttggtctctaaactttagatgtgtaaacttgaggtgtataaactttaggtgcataaatttactaaaatagaaaagtaatacggtgccaaaaaaggaaacttggtggagggagggagggggaggaggggggggggggaatctgattgctctgggcgtcgcccactagcatttccgctcctcgacatcggactccgatgtcttctattatcatgaaaacaatttccttcctgacttgtgtttccttccacacattttattcccatatttgaatatatcttcaatctaatatcaggtatgcggtatttctatgtattattatgaatccatgtataaaatatatgctttatctgtaacactgacactcaaatgtacgagtaattattcttttgatggtaggtgacgtacatatgtcgatccaaaattatttaccgatgttcattaatgagaaaatccaaaaaaatgtcattaacaagcgtctaattggaagaaatgtcattgagaaatgcgagttccatgaaatgtcatcatacaagtgattttgttctagaaatgccatcaccattaggatttcgtcggatgcaggtctagtaaacgcggagaacactgtttgaacagtgatatgtgtcttgtgctacaatgctacagtagcaacagtgctcaaatagtaatccaatttactggtggatgattttttactgtagcgtgatactgtagcagctgatatgtgccgttcgatagagatccaatggctcaaaatatgagccaatgcaacttatgtactgtagatcctctgcattttactcttcaatgcagaggatctcaatccggtttcgtccatcccacgccgttaaatatacccaccttaccactgaacaattaataaatggttatctttagtctttttacacgagaagactaggcgtcgggtgctcgatggggtgtggaaaaatctggcgcccacgtcatgctgatctcagcaagatgcatgcgtacaaaaccactttaaactattttttctcttaaattatttatctaaatcatgatccgattgcatcgttaaattcgttacaattaaatctttaaaacaagaccacacacgaatatattccgatgaaaaaaatatttagcttattattgaattatttttaaatgttgcacattgttgcaccaagtatatcggaatcgtttcactaagtagatcgaaaatgtttcaatcgtttaaatcgggcgttatttcaccttatataaaaacaatgtttcagcaaatagtaaaagaatgtttcaagtcactgcaacatttgatccatacatagtgaaacattacaagtacactaagtgaaatatttttggtggaagaaatcatgaaacaaattctcttaatagagggtttccataatatatgggtgatttgttgcaaaagaatgtcccaattcactgcaacattagatctatgcatagtgaaacattgtgagtacactaggtgaaacatttttggtggaataaaaaatgaaacgaattctcttaatatagggtttccaaaatatgtgggtaatttgttgcaacggagtatgtggtggggacacgtggcagatgtttacaggggcacacatggtgcgtggtgggctggcacggcatgcgcgcgtcgtgcggcgggggagcgcccgattttttgctcccccgccagttgaccgatccctgacgtttcccctttttatacctctcattggtcttaaaaactccataaatttatagttgtatactagtatattttaaaaggaatagagtaaacaaaagtggtacaattattccgtaaaagtacataaccattctatcatactagtaatcatgcacgtgcaagacacgttatgttcaatatataaattaaacccaatatattataacccaataatctgaaagaagaataggtaaataggaaatagatcataagaaagaggatctgcttcaatcacacttgaagctctaactattccccgctgacttatgcacaaactgcacaattttcataaagtgcatgcatatatgcattctgattttcatattagatacaagaatttgctcaaaaataaatatgatcttcagccaatgtgcagaggtatgcataagccaatgtgcagaggtaatgtctgagaaaacaatggaagaacattagattgatatctcaaaggaagaagatacatagcacaataaattattgaaatggaagtggccactaacactaattatatttcataacagcaaacactacatagcataaaccaaaatccatagtttatcccttgttgccagtgcgctccttttttggcaatggctcaatcaccacttcatcatcttcaactatcaccacttctggttctcctggagcattattttgttctgccggttgcagcagctcttggttcctaaagttcacaccaatcttaatggcgtcatgcaggactggttctttgaacagggagtttctcacctctgcatccattagaacaaagattacaaacaaaatatgctagaacaacaaaaataacagtgtcctaatcaatattagttttagaattgcactcaaaaataaattggaattgacttacttggaatccatcaaagcgacctttctaacactgtttggaaaatttgcataatggtctataggaccgacatcagacacaatggcagcaacatctgtacaaatgtaaacatgtttcagagttagtttcagcaagaaaagaacaaacacaatatacacttgtggttcgatataccataccaacaattgcgccattaggcagactgaaaacttcagcaaaagtcatagctgattcttagaagagagaccttactaatgatctatggaagaggaaagatgagaagaaatgcagtggtgatgtactgtaccgaagtagtgggattggggctagctttataggggggacagattgggagtaaacagcgccttgcgtccgcggcgctccagtgatccgttggccagaaacgatgctttcctgttttacagtgttgataacaaaccttccactgatgaacacttcttgaaatacacaattagattgaaccccaaaaaacgcaaagagtaatttgatattacaaattgattccacgggatattaccaggtgtggaggaagacataggtgtggaggatggcacaggctgaaatgatggctgacaatttacagtttggcttccttcatgcaaactctgattcaaaactacaattcaattgaatgtgcccaggttttagcattgtttgccataaaataagcttgaccataataagcatcgaatgaatatatcatcacctgtgcccgatgtagatgcagaattcttcctctccctgttttcagggttcctttgaaccagcgcacccttctcctcaacgctgagtgccgtgtaccgctctcgggctcgctgactttttaattcattcgcagttagtttagaaaggccgtccatcgcaaggatgtacaaccttgaagaacacaccatgagcatataaaagcagttttaatatgcaacaggttttcgttaatattgatgacagtccgctcgctataacaaaatcccaaatccacattttctaagcatcaattagaacctacatgttacagaataacaggacctactgaagacttttcattttctaagaatcaatttgaaccacgttaatcagaacaaccggaaataactttttcagcttcaaactggaacaaaaatatttaccaaggtagtataatggtccataattcacatttcttgtagaatagaatcatcgacagtattgtacctgaaaacaatatttgctcgaagggagtgtgtgagttgctcccaagtcccaataatcaagcaacttattaagttaaatgagataagtacctgaaaacaatatttgctcgaagggagtgtgagagctgctaccaactaaatcccttgtgtgaaattgtg

SEQ ID NO: 59662 - DNA, 5563 bp, Oryza sativa
tgcgaaattgcgttcatgaatgcacatagctttgttattgatgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgtttcatatgcttcagatcattacgtgcttccagtgtatctttcgactttccgtatacacctaggaagccaagaaggtttacgcaaaggttcttagtgaggtgcatcacgtcgattgcgtggcgtacgtccatgaattcccaatatggtaactcccaaaatatagagttctttttccacatcgccgcgtgaccatcttcgctctctatatgctggcttcaggcccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcacaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttcccccccgaaagaatgttcttgacgagtttcaataaatcgccaaatgccttgtcactaaccccattttttgccttccattgcaacaactccagagtggtatccaacgttttgttcccctgctcgcaacctgggtacaacgaagttctgtggtcctccaacatcttgtccaatttatgggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcttggatgcagaatactccttctgattcttacacttattgcatggacaacaaataaaacccctttgcctgttagcttcggccactcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaattataaaatattacaccaaataattcttaaaaactatttgtaaatttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattggaggatgaagttgcaaaccttttaggcacctccgatttgtatgtaatcaccaaaataaattcaatagaaattttggcatgacctcccctcttttttaaagtaattttgaagcttgctcgggcagctggaggaggaagaagacatatatataggggtgggactttagtcccggttggtagcaccaaccgggactaaagatcactgggatcattagtcccggttagtattaccaaccgggactaaagttaagatctttagtcccggttggtagcaccaaccggggctaaagatcaccgggatctttagtcccggttggtaagttaagatctttagtcccggttggtgttaccaaccgggactaaagatcccgggggggcctgacaggtcctgacagcattcgaaccgggactaaagatgatttttagtcccggttggtaacacaaaccgggactaaagatcaaatatgcccgtttcccttttgaaccggggctaaagatgatctttagccccggtttttattgcatccgggactattgtggaaatcggccgaccgacgaaagatggtttctccaccagtggactataccgtaaagataaacatcacagggaaatacgatataagcatgcattcttgggtgcatgcatgtcaataaaaggaatttgggagcaacaaatatcatgctgagttgatgactatgtgcacgattgcattcttggcaccacctattgtatcctcatttgttgcacgtttggcatgcattgtcgaagaaaacctttcatgtaattatggattaaatgcgttccagacttatcaaaattattggtcctaatagtttgctacttatggaacaatttttttttgttaaccatcctaaccaacaagatcgattattggattactcaactattgcaaaagcatacccttctatcaacaatttcagatatttgacacccttaaactataagaaaattcttctatacccttgaatttttagctaatcccttctatgtccctaaattttgcttactttcttgtatacctccaaaatttgattttgatcccttccatacccctatcgtcagttgaccgtctaatttctataacaatgaccattttaccctttggacgaacatagaaattcataaattacattattaaaaatgtaaaagtttatcgcataagactattatagttatgagtttgttgtgcgatgcattatttatcacacaatttatttttagataaagaaataaaaaatatgtatttattttttaaaaaaagtcataaaaaatgatgagcattcgtataaggataggactaccaatgctcacaataatttttttatgaatgctgccaatcaaaaatatccattgtcctattaaaatttcaaataaaaaatttaatttatttttattttcaaaatttatgtcaaaatttttcgcactaattatttagtctcattagttttataaaatgcacatattgtgcacttaaacaaaattttcaatcatttttcaaccttatattcaaacctaaagcatcatgggcaaaaaagacatttgcaaccaaaggaaaatgtaatagtaggggtatggaagggatcaagttaaaattttaggggtatataagggatcaggtaaatttcagaggtatgaaaagaattgagtgagttttcaggggcacacagggaatttactcttaaactatttaatctggacaaattacctagcacgcaaacaaatattggtacaacagctgaaccaaatacaacagtgtacgtacgtgtaccatagtcactgcctataaaaccatcatgatatttatcgtgacaggttccttttctttatatgacatgcacccacactaatgcacactttatcgtatttccatgtactatggtacactacaggtcagcctctaccttgatttgccgagaggtttgctagagtgacttttagcgatgagcggtaaagccccaagcccccaatcagcacttcaaacatttcttagaatcgtagggaaaaaaaagggcaattgcgcacgtgtttgttggctgtacatgatagttagagcgggcgggtcactggctctcgggttgcacagggtcgtaacaaattaggcttggctaggctcggacgctcggttagagaaacgagttaaagcgtgagctcgtcttggcttgttttctggcttgagctggcttgtgagcctacctgttgaagcatctcttcatgtataatttgtaatcattaagaaagcaagaacaaattattgacatgtaaaattaaaacaagttcatatattcaattcttcaaaatccagatgataaattacaatttgatatattaataactccactaaaaagtaaaataatccatataagtacatgacgacataggctcataagccaactcgtgctcacgagccaaataagcggctctagagccatcaacgagctgaaaacggaagcttgggcttgactctttggcatagagccgagccgagccatgctcgagctggacccaaacaaactggatggttggatctcgatccaaccgtttaagcctcgctcgtcagtgttgttcgttatcatcggaacaattgaaaaggtaacatatgctgacttgcactttagtgctaacattttcctgttcttgtttgttcaaagaagaattatgaaactgtttcaaaaaaaagaagaattaggaaacagtaacatgttagtagtagtagtagtattatgagcaaaagcatgggcagaaattgcctgagagattgtgtgtgtgtgtttgttattacaaggaggagcagtgtctgacgttaattggagaccatgatggtgccgggcctgctaatgggctggatggcaatgggctaaatcgactggtttgtaattaagattgcctttggttggcggattaagtctactaatcatccctcaactttacgtcgagtttatttgacatcccttgtctcccaacaccagaaatcatcactcctaaactatacaaaccgtgcaatttaggtcctataatagtataggctgtgttaagttcctgaaa

SEQ ID NO: 59663 - DNA, 3937 bp, Oryza sativa
atgtgttttctcctcaaattacctgcatacacatctttcaccaacactagtggaaatgattagtaataatccataccactgagttggataccatattttatttcattatatgtaggtattgacggtcagatattatgatttaaggaccgtcaacagtgtccttcttgttcaagtgatcaaccacggaatcatcatcatgacccataaagcacacatgatcttcggcaatggaagatgaacaaattgatgatgtgaattcttcaattaaacattgatgttcattcactttttccttcaaaaggttagtttcacaagtactataggaagtagagcatccatccatatcatcctcatgcacatatctagtgctaggtgataagcatgagtcaacaacactatcaaatatagcaatttaattattgattgttgttggagtccaatgggagagttggaagatcatcaaccttactcaccaatttattaccttgctcatagttgtatgttggtgggatggatgatgaggtgagaccttcttggttggaggagataatcacttgggacttgtcatgatgaggcaatgaagtagagcaatccccaaatgatgcttccacaagagtatcctctccatcacatttggacttgtcatatctttcctttagtgttatccaaatgagatgagcatcttcaagtggcatgatggttttgaacacatcatcactcaaagcactaaacaaaacattagtagcttgagcattgagatgtgtgcatttctcttcctcctcaaatgatagatcattatcattaggagggagaaatactcacatctacaactcactctgtatgaggacccatggccctaaacacattaagcgcacgagtactccaagatatgtaatttgaaccatctagcaaaagaggttctaggaacatttcatttcttgttgacatcttctcttagggcggtgaagtccaaaatgaaagaccttgctctgataccaattgaaaggaccttgatgtcgcctaaagggggggggggtgaatagacgttcctaaaaattattacaacttcatagcatattggaatgatgagaacttttgattcaaaacggaacttccggtatgggattcgaagttccggtctcaaccgaaaagttaggcggataacggaataaaacactagctataaacttgtacctcaaacaaagaaaatgtatatgaattaaaaggtgacaaataaggtatctaaggaagatataaagttaccaactaaatcaattaagcatgcaagtagatcgggtaaaaacaacctcaagcataatgtgagagaatgcaagaatgggcaaatcaagagaggagacgcgtgatttgtttcccaaagtttggatccacggatcctacgtctctgttgaggagccacaagggccgggcctatttcaaccctttcctcacgaggttgcacaaatgcattcctcggtttcactcttgatttctttccttgcagaggcgaaatcgaagccttcacagactttctgtggcacaccacaaccttgggtgctcaccggcaacgcctagccgtctaggagaccttagtccccaagagtaacaaacacaatcgaagatttgcctgctatgaacttgagtgctcaaagtatggagtgaaactcactagctctcaacttctcaatctctcaatccaactctctccccttctcaaatccctttcacaaagaggcaacacaaaggtaggaaaatggggatggttatttggttttgaatgtgtctaatactccccaagaacagcaggcacttaaaggaggggtggaggagtttatatacccgagcctcacaaaaactagccgttggagaccaagactgtaattttcggaacttccgaaaatttacagaagcaaatatcacgcaaccattttcggaacttccgataatttttttggaacttccaataagcacagagtaaaatgaccataagtttttgctcgggagtccttttttatgatcttggactatgtggaaagctcacttagaggactatccaactcaaccaaaaacaaggcctaaaatcactcaaatgataggttaaagtttgggtttctctcaaggtagcactatgataggtcattttgagcaccgagacatacacaaacacatcgacattgcatctgtcttgatagtacgccattcctatactcaaatttatatagtaagagaattatactaataggataggaataccttctttccatcttcctttcattgtcttaagggacgccaacgccaaaaccattcaccatatattcttcaaacgattgatgtggttacttgtagcttcaaatggtctcacacggtccattatgacaaagccgccactcgtccttcaccactagatttggttcttcggcgccaagccccttgcttgccctttacccccgcatggtccattacgaccgagcatcacttgcctttcaccgtctttcatagtagacacttcgtatctatcgacgagtgatactcgcggaccgtatgagtagagtattggggtacgttggaatgatggtctacgtagtatgacattaagcaaacgaaagacaaagattatattggttcaggccccttatcaggtaatagccctagtccagtttatatgggattgatgatgatgagaacatattacaatgagagtagtcgaaacagatgataccgacaagatcgtagtcgagggattcgacaagatctcctggcgacttggctccgtgtactccgacttcgtaaactttggtgcgtgtgttggtgatggaattggatttcctgaacccctcccagggggtcccttttataccgtggatcatcttgacccccaagaaaggtttgaggatataggacctagtacagtataacagaaactctatcccttccgagtaggactttggaaaatcacgtgactcgtagagatattttccataatttgaaaaagattccacgcgatatttacgggaacaatccatatacgtgaaggtataccttatcggtatattccataagtcgtaggataggaggtatgccttatccttaaccctgaaagtagcccccgactccaactcaaatgaatttatgttgtcatccatgacttctctcaccagcggcttgtctgtcgttcttggtgtgggaccgagaagacgagaagctattgacaacactaacggaagtccgactgcttaaacactagcggaagcaaaagggctggcccataacaggccttttgctcctccctcaccgagaagtccattttgcctccctcctttcaattaatttcaaaatattaaaacttcgaatcggaatttatcatactaaatgaacttatgtgaaaaaagttgtcaaaaacaaagttgtataacttattgagatctaccaattttattttggttatttctccatctgagtttaattgacctatgtaaaatttgaatttcaaattatgacaacttcaaacaatattttcaaatactaaacgatttcaactaaaaaagtcataaacaacaaagttgtataaatcatcaatatctacaacttttgttttggtcatttttctagatgactttgtttcaataatttgaatttgaatttcaaattatgataacttcaaacaacattttcaaatactaaatgatttcaactgaaaatgtcatcaataacaaagttgtataactcatcaatatctataacttttattttggtcatttcttcatccgataaagtgatagtaatattgttcataaaatttacatatgtcttatatggttttgaagtatttaaatcgcgacgaaattgctataacgtcacaggttttgggccggtttatgacgaaatcgataaattgtcatggtattatgggccttgtatccatagttgcatatccgtgacg

SEQ ID NO: 59664 - DNA, 14353 bp, Oryza sativa
ccgtgcaatttaggtcctataatagtataggctgtgttaagttcctgaaaaaagttggaagttcagaaaaaaagttggaagtttgtgtataggaaagtttgggatgtgatgtgatgtgatggaaagttgaaagtttgtggtagttgggggtgaactaaacacggccatagttatctggtttcgttgacgtggcatactagttaaaaaaaagatatggggcccacaaattagcctattctttcttctcttttcttgccaactatgggagggagggggaggcggaggagtcggccaccggcgggatggccggcgacggcacctccaaggacggcaagctcggcagcaccacgacaaccatctcgccagctcggtgatggtggagaagagaagggtggcggcgaggttgcattcttcccttctcactccttcctcttcctcctgatccggtgtcttcttccttttccctccgtatccggcgtctcggcgaggtcttgtgttggcctcgcccgagggaagccgtcgccagaagtagagatgggccaccatggcgaaggtccgagaggtggcggccgcgggagcccatggccggccacttttggtgtccgtacccgttgcgatgaccgagttgagccggtcgacgatcggctattgggtcggtatcaaccaacgctttgcgcatcaagtgaaagatgcaccatttgactgatgattgggtagcactggtagctggtggcccctatgggagtgggtgggcgtcggcctcagtgtttgcgggcatgcatattagtattattgagaaagacctagcgctagcggctagtgatcgatcagctcatgctgatattgcacggtctgatcgacgaggaaatctcactacgcggctcttcacgaggtggctacagcaagataggtgggcatgcaaatgagtatgcccgccctcagatacccatatatgtgttcattctagaaataaaacccgtttgctaaacctgtattttttcgtacagtatatccaagaagcttcatagaatttttatcctacttactggataaactgaatatttatatgatgatcaaagatagagtacaaatttacaaacatacactacttaaaagaacatttttgcatgcgatcaaaaccattttttctgtgcggttgggccgcctgtctacccaatttattaatgatgaaatttgttaattttcattagtcaaggccgggtcaaaggaagccttcatactgtagaaattcggtttgacaaatttatccaagattgagtaagctccggagaaaacgaaggtgtatcatagtctctattcttgttaatagagttctgagctgatggagtcgtgtgaggttcaaactcggatatgtttaagtaacgattagccgatatgagtcgtttgggagtcgaagtctataataatttccttaattagagatagagttctatatcaatacaatcgtaatagagtcggacttagtattgtatatggatataaatatgtacactcagggtctttgtaaaatatacaactttcggcgcatcaccaccctaatttttctgacgaattcttgttttcgagtttaggatgcatcggttaagttcgatctctggcaaaaaagttagtttcgtcaaaacccattgtttgtatcggtggaattagtacttctcggttaggtccaatatactggttcttcttttgctcgcattgcttaccagatttattggctcttgctttgattgatttgctttcttagttacggtttctatatcaatcgctccggaaagtacttatcaactggttcaaatctatttaagcatcttgttaatcttgaactgtcttggttatttccaatcttatttcttagactaggcgatacctattgctgcgggaattgaagaatacaactttgtagcatgggtgaaagattgagatagaagtcaattaagaccaggcaaattttggctttgttcatgaatcatggggtgtgtagataatagcattaattcaatttgtgatgactaggtagaatggagatacactcttgcccaggtagaatataaatccaagcagtatggatattctcgttgtatgggtagaatcacccatcgtaccaatcaaagtacagaccgtacacttttgattcattgactggttaagaaaagaagaaagaaaggttgggaagcaggcctcctgctattgcatctctgcgaggcggcagagagccatagagcgagaggggagaggaaaccctctattttttctctctattttctttgtcatgagaaaaagattccaaaggatagcattgaagttaatgattccttaatgaatttcttaatgtgtattgactatgggggtgtttagaaagctaaaactttttagcccatgtcacatcggatgtttggacattaatttagaatattaaacatagactaataaaaaaactaatttcataaataagagctaatccgcgagacgaattttttaagcctaattaatccataattatcaaaagtttactgtagcatcacattgtcaaaatcatggcgtaattagactcaaaagattcgtctcgtgaattagtccaaagttatggaatgggttttgtaattagtgtatctttaatactccaagttaatatccaaacatccgatatgacagggacttggaataagtccctagaaaccaaacaagccctatgttccaaaagaactacagaaaaatattgaacacagtgtctgatcattctgcaatagtaactgtcaaaggtgcagcagctgacatcaggtcatctgctgccatacagacatcattatctagatcctcagctttacatgcatatgatgaagaacaaaatgaatcacattaccaagcaagcatttccatgtgaaggaaacaatattagcaattttacacacacagagtatcaaaatcagacatcagtaaacagaaaagtatctttctttgaagttcttgaaatctgaaaagcaaatcttggttcaagatgacaactaatgccactccagtaatatctaattcttggaatgtatgctttgcatccttttgctttccccgtgattattttaccttccatgacatatgaatacactacattagcaaccgagaaaaacctaatacatcttaggtgtgattccactaacacattaatgataactgatgtaacgaactctgtttaacaatatgaggaagaaaacttttttatttttatgtcaccactaacaaatggatcacatctactctaaccatgtgtacgtgtaatgcaagatgtgtagaatcatatgatgattaatctgggtaatgaacaattgtcaaatgtaagtatttgtgaaaatgcagcgtatcgtgtttttgaatgatgaacagatcggtcgcttttaggaggccggttagaccggatgtgtaccgccggtcagacaagtggtgatcgggtggcccgacggtcagaccgatatactccaggttggagccagtttcgggttgtattcatggaacttgtagattgcttcatgttatggtttctagaaggtttctattgatatgtgatactattgtgtgttgatgtgagtcaagttggtataaacttgtactcggatatggagtctttttgttgttcatgtgcagatcttgcttgaaatcatgggagtatggctagtgatggatcgagactaggcttgggtgaagttgaggtccagatgatcaaggatatccttatgtgggatccttaggctagaaagcaatacacgtgaaagtgaaggttttcatatggcatactcatggtgttgtgtgtgtatgaaaataggagtcaaactaggattgaagtccaagtatggaagattgaagaatggaattgtatgagcatgttgtttccctggtttggtatgttttctatatgattaggagtactagttctagttggattcatggctagggaccgcgatgttgtaggtataaataaaagaggagttcaagttagaagatatcgacttcttgggggagaaaaaaatataatttgctttgaggctttggttctagtttatgagttgagagagaagtgctttaggtgcacttcgtaaagttgatctactttaaagtgtttcatcgatatgtgttttttctgaatcttaatagtcatactggctcctggcgagtggtctaaccggcaggatgatggcggtctaaccgatagcaaacaaccggttagactggcggcggtgagaagacagctgacaaggaggtagtggtctaaccggttggataacaccggttagtctagcggcaaaggtgtagtcagaccagtgtgcacacggcggttagacccactacgccgaggacttcatcaggtttgagggttatttccactaaaagttttggtttttgtgtttctaccattcacctttctggtaggcttggttggttcttgtattcgatcctataagtggtgtgaaagccacattttctcttttttctcttaccgatcttgggtttttacccacatgttttttatggagttgattttccttgttggtgcgataagatgaaatcttatatgatggttgtggattatgatatttggttaaaagttgcaaatcattacaaatttctcctcatattaattctactgctttaaatactgaatttgaaagcaattgtaaagctcgggggcacaaagacagtggcctcgggggtgggcggcgccagtgggcttggtgcagattcgccgccccagccctcgggagcggctcctgcacgcggatccggtagtcacgggatggatccgcctcccccaccctcaggagcgatgacgacgcttggaactggcggcctcgggatagggacggtggcggcggcatcggactaggctgatccgccaccggtgctaacggaagcagcagatctgtatccaatctgaatacggggggcgttgcgacggcggcctcaagcggcgagagcaagcaatggcggcggatgtgaggacaacgacggtgacagcggccttaggtgaaggaagcgagcggcggcggctgcgacgacgatgatgacgaggacgacgacagtggtggtggctgtgacgacaatggctagggtttgggatgaatcggggagctagggtttcgaattttatcctgggaatttttattttttttgctgaaattattttcgcgttcgcttgacatagatgaccgcacacaaaaatcctatttttgcatacgtttgctctgctcgcatggaaaattttggttttcacacacctaggttcatgcgggctgtctagccgcatgctaaaatttattttggacgcatacaaaaatcgttgttgtactagtgtaatccggtgcccagagcttagcgtggctgaatacggtggcggtgaggttccggttgcggtggtggaggttgggaagctgacctcctgctattccatctcgcgaggtggccgaaagccagagagtgagaggcggagagaaagagagtgagacgctagagaagggaccatggggagggaaatgtgggagattggtttagtggtaggaccaactcgatgatgcgtcccatatttcatcccacatcgaatgctcgagacgaagcattttcggcaaacaacactcagtaatataagtctgttcttaccaagattaaataacatttaaaagttgacaagacgaattctagggtattacaccactaattttatatattattccattttacggtatggtttatgcaaccttaagtgactagtaaacacgcaagtcaggtaaaatagcaaacgcaaaacaaggagtctagctgtggcatttcccaacctacaaatgcctagcagcgtgcactcatcatatatccgcccccttctgtagctttcttttgcgttaggttgtgttcctcttttgcctcttcctcgattgtgtccattggaggtgttgcggattccatcttggccttcttcagtgtttgcactaaacctgccaggcattcgtccgcgtctctcttcctcttgcaccgtagcatgaagttattggccacgtctgccggcggtgacccatccatctcgtcgtcgagcagcagtcgactgatttcaccgttcctcttgctccttaccatgaggttatcggcaacgtctgccggagtcgtgtcggtctcgtctagcagctgcccgatttcagcgaatagtgagtggtcggtgatgtccaggtagctcttggcgagcaccttgaaggcctcgaagcggcagtatgacatctcgatgtgcttgtccatcctccccggccagattagggccgggtcgagccagtcgatgtggttcgttgtgaacatgaagaccctctcgctgccgcacgccgaccacagcctgttgacgaagctgagcaggcccgacagtgtcactctgctcttctcatcgttcttgtcggcaaactctaccagcatatatatgcttgtcgcggatttcgtcgtcgccgttgactaccttgttgcccttgcgcttggtagtgagttcgtcctcgatcgcgtcaatgtcctctataacgatgatggacttgtccgtcgtgtcaaggaagagcttccgcagctcgctgttgttcttgacggaaattaggtcgaggtcgtagacgtcgtagtcgaggaagttggccatggccccgatcatggtggacttgcccgtgcccggtagcccacgcagaaggtacccgcgcttccacgccttgccgaccttggagtggtactccttccccttctggaacaccgtgagatcctccatgatgtcgaccttcttcgcgtggtccatggcgagcatgtcgaacgtcgcgggtggattgtaagggacgctggtccacacgctcttgttcccctcgctggcgtggtttgtgaacagccgcctctgccggttcttggcggtgagctcgcgccaccgccggacgacgcttggtaggtaggagctgaggacgagctggcggtggcgcttgtggaacaccagccggaagcagcgcggctcgtccgtttcgccggggtagtagctgacggtgatggcccccttgttcttggaggccttggggcacagcctccaccacatgcgcgcgccgtcgaagctgtcgacgacctcctggttctcgtcgagggtgacaaccgggtcgtccttggtgttgttgcagagctcggccttgagcttgcaggcgccaccggcacacacgcggctcaggtaggtggagacggcgccgaacatcttgttccgccggaaccgctcctcgccgtactcggacacggtgatctgctcgtaggggttgaagtaggacatcgccatggggaccaggctgctgatgatgtacctagcctcctcatggacgtgctccggcatccgggaccaaagcaagcccacgccggccatggccgacccgaaccctacccacgtctccacggatgccatgacttgccccttgcaggttgcagccactgctcacctaactagcagccactgcccactgctagctagctctctgcaatgattaattgccgttgtgtggatgtgtgcttgtttaccgttgcttcgtctgtggcggtgtggctcggcttatataattggcgtggtgtggctttaaatggttcccgccgtttcatcgtggaagaaggtgagaacgcgtcgtcgaagtttcgtcgaagcaaagcgagcgaggtgatttgacttactccacatgaaacatgtagatattgcaagtgactcagagaccacaagaggggcggcctatcaccgtatcgggtttagcaattactccttcccttgtaatatatgtgatttatactatctttttaaaaagaaaatacctagttatgatgaatccaaaaaattaactttaataataacaaatataactttcgaacattagtgtgacttatatgcaataatatgcagagaaactcataatcctatggtataggttatatagatgtaaggtatttgaaaattgttataaaaatggaacatgcaatggttggttcaattttaatggaagagccaatttttttatgaacttattacattttctccaaatagttgaatttattccctattgacattttctatttcttgttttattttatacaagttcaaatattagcgttatggatctttaaattattggtttaattatgaatacaacaatagttcgattagaggttacatgtgtagcttaaaagttatgcattgttttaataattttaattatttctcgctataaaaaatagggaggggtagagtggatagctaaagccgagaggggagggggtgggtagtactgtgttgtgcgcatgtgtgggggaggacgaagtggaggggcattttttttctacctttctaaactagaaaaaatgcccgtgcgttgtaacgggtgaagatattttaatcatgtaattgttatacggtttagctatggtgaaattcatcgtggaaattcgcttggatattttagtttagaaaatcatgagatgcagttaggtgcctgacttttatctcaagttagaatgcatgtttttttaaagagatttcttatgcgactcctttcgtatttccaaaagcaaacgaacttaaaatttgactcaaatacatatatgtatttctaaaagcgaacagacttataaaccaactcaaatacgaatgaagtactaaaataccaacaaaaacatcttcaatttttataatagtagagatgatttaagtgaaatctgatgatttgatttttttctcatattttctaatatgtcttctaatctaatatttaagatgtaatacatgttggcttaagctttttttaaaagtatacatattggctaaaaaataatggatccacctattcaagtggaaactgattgtcaaatgtttttttcttccaacttataaggttttatttttatttaagacgtaacacgtgacatgttaagtgcaattctaagaatgtacaacgatttaaggtgaaatagtacttattataattttttataatgttatataccttttgctattttgttaccatgcaaaggatcagtgtctatgttcaaataacatacttttatttttatatgttaatataggtaatacggatcttaaactatttttcttaattataaataaaaaaagttcaaatatactaaaaatcggatataacttaagaattataatcatttggctttctaattatcgatcattttgtattaattagctaaaaattaggagacgaaggaattgaatgagagaagagaggaggagagagttgaaggggagagaattaaattatattgttttatttgttattaatttattaactaaatatagaatagaagctttattgattgattaaaatttatcgtttttattcgtcttttcccatagcttcttattcatagtagatagtaaaaatatgaacattacaaatcaaataatattattttgagttattagaatgttagatgggggagtattattttaaaaacattaattggaattaggttcattttagtttttgtgaagttatatatgctgataaaatctatatcatcgttttgtttaataatgcagaaatcagaaaatacaaccgtaaaatgacatatttcttttcaaagttgaattactgtgcatatgtgtctttaaatgtaaactaatctaaaaatataaggggatcaaatattagtttttgatttagatgttgtagttgcttactttttagcataacttttgctttctactccctcggtcccataatacaacggacttttgacttcttgcttgcactgtttgattagtcgtcttatttaaaaaaaagacacaaatataaaaaataaaaagttgtacttaaagtactttgaattataaagtaagtcacaaataaaataaataataattccaatttttttttaataaaatgaatggttaaacagtgtaaacaaaaagtcaaaatcccttatattatgggatggagggagtaacatattttgggaacattactttttatgattgcagatcttatttaattactatgaagttatgtatgatgataaattatactccctccgtcccaaaatataacaacttttagctctcaggatttatcccaaaatataacaacttctccaccaacatttctcttcccaacctatcacaactctccaccattcacttttcccacctacctccactactcatccagtcataaccctccaccattcatttctacctactttcttaataaccgtgtctaactctaaaacttcttatattctgatacggagggagtatattgttactttatttcatattttttataattgcttgaatggtatgcaaaggttagaagatataaaccaaaataaaatttgttttcaaagttgaattatagtgaatttttgtcgtaaataatttaaagatataagtggacaaaaaaaattctatgatctaagttctatgatttagatattataacttaattgtttaacacaatttttatttttcgtaactaataaaaactaataaagcaagaaaaaataagagaaggaataggtagaaaataggaggaaaaaattgagggaagagcagagagctgacaaatgtgagtaatgtacgtacgtaaaagccctggtgggcctgggtttgagagagaatttattgtttcgaagataaatctaatggtcataaatagtgggtcaccaaatttaataaacattaatagttggatgttttattttttttctcagaattttttatgaatttgtctaactaggaaggtagcccgtcacatgtgtggacatcttatttaatttgtttggatttttattatgaatgtttatcttactttattaaattttttctagataatttatttgggatttatttgaatgctactaatattttttttcctaatggagttgctacctatgaaactatagatcatttgtactaatatcttgtttttcgagcttctaaactgtaactaacatttttttcttgtatactatatattaattgaagatattttctaaattactacatcatataattaaatgagatagatatgttgaactattgatttagttgtaaggacgtagtattgcattagtaaatatttttgctgaatcagagcatcttagaaaaggagacttttactgctctctgtagtttagggctatacactttgaattgaaattatgttagactttatttccaaaataatgccggaaaaatcaattttctgttagattttatttgaaattttaaatattttactcttaaaatgtttgaactttgctatttagaatgggtcaaatccaaaaacaatgttacacttagaaaaaaatgttcagttttaaattattttttccatgttattttttattttgatctttgcaacttggaacgaaaatataagtgggttaaggccatataatttggcataaggttctaaatttctctctctaattaagtcagaaatgttaaaataatagtcatcggtggcgctacgaagcgctcctcaccatttcccccaccaccgaggcaaccaaccttcgtgtggagttaaaatttaacttagatacaattgggtgtgggttgagatgacatcgttgtggagttaaaatttaactttacaacgtgagttatctatcttggagctacgtaaactcaaaaaatggatgagttaactattaactttgaatcgatgtgataataactgacgttaaaaacatttgttttattactaaaaattcataatgttgtacaaaaacttgtacggggactacatatgtagttaaaatttaacttgtagatgtaagattttctaattgtagttaaaaactaaattaagaaatttatgttatgttattattgttggatttaatagttaaaaataacttattgttttaaaaacacctatatgatgtctgaaatacgtagttaaaaaaataacttttagtttaagaaaaaatatgcgtgatcatagggattagtgattcggcgttaatagaaaaaacagttagatgaggtgccgaaaacaggggattttttcgtgcgataattccacttaataaaaccagtgctacgtattcatttgaaaccctttttcatatacatcgtatgcttggtatccttactgagtaaaaaattaacttgatatgacaacaaaatttttactcaacaaaatttaagcataagttaaatttttgttggcgcttgctccggacatcgacggcggcgcatcgtggaggtggccgccgctgctcctccatatccattcgagtccaagcttgccgcggcggaggtcgcgctgtgcgcgtgggggtggagcggcggccggatccgctgccgcctcgcctcctgcccgcagtcagcaatcacagccacgccctccgtcacccgtgcaggatccgcatcggatccaacgtcgcaccgcccgtatcacgccggatacgccccaccttagtggctaagatccgcgcgcgtggggcgttgagcggtgtccggatgcgcagcctcctcaccttccgtcagcagtcgccagtcaccaccacccccgcagccatgccaagccggatccgccgatatcgcacccgccgccagtcggcggtagaggtggagctgccacgcctcctgcccacagtcgcccatcgtcgccccgccagcaaccgtgccatgccagatccgctgaagcggcgcccgacgccgctcggcggtagaggcggcgcagaaaacctgagtggagcatgcaggtgaaggtcgccgtcatccgatcccaagcccgccgctctcgtctaggccccgtcatcgtcaaccctagctcgacaatgtcaccggacagacattactagaaatataactcccagcaatggcgcagaaatactcctggtatattatggttacagagttcattcgcaagcgcacggatataccattgtatcatttcacccgagagtattcgaaggacatcgtatttatttaatcccgtgggaagatcatagtagagacaacctgactaataatttatatgttactggtaataatcatagtctaagcaggggttaagataatccaagggtagaatgacacacaagcagggagctactcattatcatattaaattatctaagctaagtggaaagagaagataaatgaaatctattcctatacttctagtatatatagtatacatacattctagttatctgacatattacctaataccctctatccgaagccctcctggtacttcgagaagccagccctgattgccaagttccttacaacaacccgtcatgaccatacaactggggctaaatacggatgagtaccctccccaggaaattaacttaggactgtatacacgagcggaggaatacccgtactgagttgtcaccatcagcggcccacctctcatccatatcatataaccccaaataatgatatcccgtaatctagacaccacgcctaaactaccagatactactcaaatatcatcgtcatgacatagattagttgcataaacaaacactaaatccgtaccgatgcatctcccagataagctagcagtataatcagtataacatgaacataatgtaaagttggcattcatatacttggaaagtatttcaataccataaatgtataaagaagagtattcgaaataaagtacaaagcttacaaaagagaagagaagagctactagagctatacccgaactcttccgaaagcttccggactccgatttatattctattcctattccactagcttaaaagcactaaactaaacttgagagaatatgagagagctttgcttgaggtgtgtgagtgaagtgagaatggcaactccttttatagtgtggaccctcgtttttataacaggaatcaatcgtgtaaacagtaccatttccctggatcaagtagtttggtacacacgaattcatagctgaaatatcaagtgcacatacacgagtgtctgatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattcttttta

SEQ ID NO: 59665 - DNA, 2462 bp, Oryza sativa
acgatttcaattgaaaaagtcgtcaataacaaaattatataaatcatcaatatgtacaacttttgttttgctcattttgctatatgactgtttcaataatttgcatttgaatttcaaattatgacaagttcaaacaacattttcaaatactaaatgatttcaaatgaaaaagtcatcaacaacaaagttatataaatcatcaatatctacaacttttattttggtcattttgctatatgactctgtttcaataattggaatttgaatttcaaattctaacaacttcaaacaatattttcaaatactaaatgatttcaactgaaaaagtcatcaacaacaaagttatataaatcatcaatatctacaacttttgttttggtcattttggtatatgagtctgtttcaataatttgaatttgaatttgaaattatgacaatttcaaacaacattttcaaatactaaatgatttcaactgaaaaggtcatcaacaacaaagttgcataaatcatcaatatctacaacttttgttttggtcgttttggtatataactctgtttcaataatttgaatttgaatttcaaattatgacaactgcaaacaatattttcaaatactaaatgatttcaactgaaaaagtcatcaacatcaaagttgtataactcatcaatatctataacttttattttggtcatttcttcatccgataaagtgatagtaatattgttcataaaatttacatatgtcttatatggttttgaagtatttaaatcgcgacgaaattgctataacgtcacaggttttgggccggtttatgacgaaatcgataaattgtcatggtattatgggccttgtatccatagttgcatatccgtgacgatctctgaaaacatcacgaaaatttcatcaaatttcgtcacatattaaatagattcttgtagtgccctttgcctcacgatatcgattaagctcaaggctagatatgtgccatcctctaatagctcaatcattcacttgaacttgtgatagattatataacttgtgattgactcctcaatcacctttggcatggccatgcactttcataatctataacatcgaggggcccagagatatctctccataagaggggtaaatctcatcttgattattcgtatcgcactacggagtagcgtttagtagtccctaagtaagctactacacatgttgggaaccatgataatctcaggtctaagaattcaataccaacacatatggctcttgcagtgtctcatgttgggtctatccaacaacatgttctcccaacatgtgtccacattattaatttggtatctctataccatgatccatgagacatgatcatcaattaatacatgtgctgatcatttaaacatatttgttgcacatatgatatttgatcagggatcctttagaaatagcaacatacaacataaagagtctcatgaaagaatcacatattcattaaccaataatgagttatctatttcaaggaacaatgtcggataaatatgtaaacatagtatgtgatacaatcatctctatgattacctctagggcataccactaacacatagaagacaaaagataaagttctacacgtttaggatttggattcgggcctcctgacagcaccaacttcaaacggacctagctgctgatatagaaggaatttcggggcccatgagtactgtcagatggttttgaaaaacttatggagtctactttcagatggttttggtcccacatcaaaattcctaccgagctgtcgggaatctgcaaaacaagccacataccttatccagtccgaatctgatttgggttttgggccttgtaattgtgtcgtgggcttaacccaagcgggtgtgcaccctaaggcaaccctacgatgtccctaatcatatttattcagtagccaccatcgtttagagggggttttgcttagattaatctgtcaagaacagtttcgccgctagatcggtttgtggaaccccaaattcgagtgcttaatcattcatatgcaattgtgttgcaatctatcttgttcttgcttgtgttcttgaattcgcatatagggattagccttctcgacaaggtcaaccgggtttcggcatggttgataaccagagaaaatatggtgctgcgattatggggcttaagagcgtgtttgttcagaagccggatcgagttgtgtcgctactccaccaaatcgattgttaatcaatacctatcaaaagatcgggacctatttcctcattatttggggtggaagtgtaacatacccgaaattttaggacttaaaaatttcttgtcaaaatagttagaggttaacttctccaatttttagagccaaaaatttccgttttaatttaggtgatgaccaatttaaaccattgcatgattataatttgagaacaaaataaaatcttttcattcccaacattag

SEQ ID NO: 59666 - DNA, 9129 bp, Oryza sativa
aatcaaattctacagattcatcattcatcatcatacagtctctgattaagtgaaataaaagtaattacttactttgcatcaaaagcctctaaaactattatctttaaaatgactagttttagataagctaaactttagaaattcatgtagaacccaatttagcttcaatttgaataaaattaagttatgtaggatcactaacacatgtatttccatgttatgaaataatattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaaacttgattgaccagtgaagccatagttccatttccatccactaaaattagaagaacttagctcatataacaatttctaggttaatataatatattgctagtttagattaaagcatctctactttataaaatatgaaccatagtagtaaagaccataaacatgtgagataaaaatgttttagttaaccaaattattccttttattcaacttaaacaggaagtagcatgttctgaacctataactcaagagtcatgcacatataaaacactatatgcctaaaacacgttgtaacttgtaaaatctataagaaaatcattataattccaaaaattgtgaaaccaaatgtgttagtcttagaaaaacacatctccacaccccctgtgaagtctaatctaataaaaatcactttacaaaagtatttcataacactacctaagactatactattgtaaaccgataaaacttctaaaattcataactcccaaatggaataaaataaaataggaattatttcacctaaattcattttagatcatttccaacccactgtgcataaatcatgcattttagagcattttggattttcagctctttcggtgtttaattgcatgtcgtgtcctttatctagataattgcataatcggtgaagaagtggattaggtgctaacaattctctgatcaaggcaagttttctcctcccatcctttgaacacattgaatcccatgatttgaggaatgaaaatatttgtttgcaaagttgcatgtgaacttagactatatcggtatttgaaattgggttaaggtagttatgacctatttgctgcatattccaccttgaataattgatcctcttgctgtttgaacccctagaaatggttagagtacactctttgtgctcaaatgggtttatatatgctctatgtgcaattacttgcttagccatgcttagaaatatgcaaatgctcattccatctataattaaaatgtggttttgatacttgaacctttgctggaataaaatgaatatgatgggtatttgcgaattaaaatgtgtaaaatgtgattttatacttgggcggcaagtggtgtgcatatggtgttagttgcataccgataggggaagtgtttgcccaagtccataaggaccgaacttgtgtcacccatttaaagttatccgtacatccacatgtgctagtatgggatggcctaagctgattaatctatttaggactagccttgcattctggtaggccggtgtgtatgagttagtcgataattctgaggaattagtcgatgattcagaggaacttcctatttgccccgacgtggtagtttaggtgactaagtctgtccaatacaacggtattgtgccacgtgggtggattcccgttgtgtccgccaccacggcgttaagtttaaggcgtgggcccgccacttaacggttctagacatatttccaagtatgcctaggatggaggaacacgtatcgtgctggtgcaaggctagattctaagtagtgtaaaggcttcgttatgacctctagatcacattcaacatgaagagtgtgatggagtcttgcaaactcaaaacaaactagagagttcatatcatgtgggtaaagctgtacaaactctgcagggttctttaaactaatcaattagccgtgctcacggtcatgagcgctttggtgatgtgtcatgagtatagactatgttttaaaaatgtgatcatgtgatattggtttgaaattgataaatgtgttgagttgtgtgtgtgtgaggtgatatattatgacttgttgtcaaaggatgacaacaggagattgattataatggaattatgatgaattaaatattgaaacttaaaatttgttttgttaattgaagcatcaactcttttacaaaagaattgcgaaacaaaacttgctttatgctgaaaatgaactacatattgccttcctttgaatatatgccttacatgtagtatggtaggattgacttgtgcttgccagtacattaacttgtttaatgtactgactcttgctgttgatataaccttttgtttgcaggtttagtcttagtctttgagtgatgcgggttccgattgcttcttctaggatgagaacttaatggggtatacccctagtcggtgtgcttgtgtttgggtagtcaagcttccgctgttctctaataagtctatttggccggtcggcctatgtaattattaagttgttgtaagtcttaagtttctttcatcttagttgtgtttgctatgtgtaatcatgcttaagatgaaagtgtgaatctagtgcacatcctgggaactagattcacatgagtatgagttaggaatatttgagaggttgtagatctttagccatttttgtcaagtctcctgaatgtgtaacacatctggtcgccgccttcgagtggtttgacgggcacatctcaggctgaagttgactggcaggctaagggcccagcaatgtctccaatattcctctctcgaggtgtcggatgtttcattatgcttgtttgatgacttgaattattcacttcatctctcaaatataatggaaggtccggagagcctacgacagcatggtatcagagcaaataccgactataggagccccttaagttggttgcttagaattgtttcttaaaaattattttgagtgctatgctctcagttacaaattatttgcaaaaatcatgttcaatcttatatctcatccctctttagagattattttactttatgtctcatgttttgatttttaaaactcttatcttgctctataggaccgaaacattttagaaatactactcttgttgaattttatttgaaatcacttaataatcacagcaaaacagtaacatagtgttttgaaaagttttgaaatccatttgcaaactactcctatgtattagcacggatttctaaaatatcgggttaaacatagcccctagaaaatgggttttgagaatgagtcgataaaacttaaaacttgctagaaaatattggaattccatctccctatgttatctctgaaccaaaaatgaatttggtgggattttgtactttcctctcccgatatttcaaaattttatcggtatgacctaaagcgtgcagttgggtatagaatagaatttgctgtgcttaaccctctagattgtttgcttagatggaccacccaaaattcatctagcctctggaccaccctaacataatatgactaaaatggtgataaaatttatacaacctaaaacttgattaaagtttctttttgtgccggttgttctttttctggaatcttgagtcagtctgcttgttaattttgtctagactaaaccgtaggtgataaacatgagaatttttacatgcatcatgtagactaacccagtaagcttcatgaattttggcataatttttagacccctgcatcatagtgaaacaatctagatagttagcataatcatattctggaaattggtagtagctgcattcatcttttcatgtagcccaaaccataattgattaaatatgcatctttttacagtagttttcatacataacctgtaggctccacgaattttggttgaattttttttgagtcattgcatcatggcataaaaattcatataatactgtatagttctgtccggaaatctgtaggttgtcagtttcacaaatttgtgtagcctaaactacaaatgataaagtcatgattccttcagggtagctcctaatctaacccatctatctctctgatttttgtcaaaatttttgtatctttagagctagacctaaaaatttgattaagacagtaaagtgatgaatcccagcacctagcactcatgtcagattaacccctatcctttgaagattattagaaaaccctagtgcaaaaaaaaaattattttaatttaagggggatagtaagccatattcgtatcaaaactaaagataaaatttttaaccttgtataattcttcttagacctaaaatgcaaatcccattctagtaagccctgtaccgttaatatgaccagaattaatgattagaggtctatataaccataggttgttaaaaaaatgtgtgtcgaccttaataataacagtaaggaaaacctttaatttgtaagtgttaattttagaggtttttggctaatccgtgttctaaattttattcttatagatgcctaccatgtacacaccgtactgctattgccgtgggttcacctggaactcaactcagcatgtgctatggcttatgcttcagtacgcccgattcacctatccacctgagtatcatatcctcaagaaacctattggaacatcccaaaccgcagtcatggttcgtgtaagcattcggggtagaactccattagagaaagaccttcaatatactggttatgggtgggatattaagtccgctttgcaaaactgtgcttatgttgctatcatccgccttcgctatgagctacctgagatagaagaattttactgctacgttccatccttaactgagggagctcaacacactacctacccagggttagctgaaataggtgtaggactacataccccatacctccaacttgcaaactttgtgcgctcactagatatgctttatcgctcaacctttgctgagctgcaacgcgtccgcaccggggtagccactttagaaagaagcattatgccaaggtatcgccaaggacattatacaccggagttcatgtttggtgaggatgccatgcttgcaccagcagaagatataccaccacctgttggaatgtatattgaaagaaacccaccttcgcgcgtcgatgtcaggactgcttatcctccacttggaactactggaccgtatggaccgccagagtatgttcaatggtatggtcgagtcttcaagctaaggatgagagattaatcaatagtcctatctaacctctactgccacggtagtatgacttaaggacaagcttaaggaatagtctaggtatgtggtggcccattttggaagaaaatcatggtatgtaatatatgtaatatggctgccatgtactccatttatgtaagaacttgttggatggatgtaatagtaactaagaactcgtttgtccttaatttagaaacctctgtgcttgctgtccagaactttggaaaatctgtaaacataagttcatctaagttagaaatctggttataagctcctgttaatatgaaccaacatttatcttgttggaactaacttctctagtgtcaatttaactaactatctaagcttccataaacccacaactgagtagaacttgccactcacccgcgaaataaaagtttccaaatgttttatggtagcaagtctgtcatacaacttaaaagaaattattatctgctgtcaatgtcaatcctctggagatagtcataacttaagccaaccctacccaaatctcggggacgagatttattttaagggggatagactgtaacatacccgaaattttaggacttaaaaatttcttgtcaaaatagttagaggttaacttctccaatttttagagccaaaaatttccgttttaatttaggtgatgaccaacttaaaccattgcatgattataatttgagaacaaaataaaatcttttcattcccaacattagactagaaatgtcatcaagcatacatgtacataatgcatgcctaggctcgagttctttgtgcatttggagttttggtcttgcattccataataggtcccatgagcataatctaaaagaattatttcactaaacaaacctatagttaatcttgggtgataacatgtggacttaatattaaactcaaatatcatcttctcagtctaaaagaagtttaatgtaatccctataataatattagatgcaattatgaagtgggaacacatatacaaacaaaggtcatcctaattctctaaaatattttgtgcaagataaaatcatggaaaaatttatgtggacagtgattagcacaaacatatcctctgtaattttggtaacatgttaacactcaagttgaaatctcaaattaatcggtcgaagcagacaactaaaagaaatcaaattaaatttaatcggctaaaaccatatttcatccaaaagtacatttaactgcacataagtgagcatgggaaataatttattcaaatactagattagttatcatgaataaatgtaatttttctagatttttcctcctctgtttaagcctcctaaaaattcaatctagctttctaatagcccatctttgtttaatttctgtgagcagtccacccattatttttgagtgcaaccaaagaaaatggaatctaggtgtaatcatctaccaccagtaaaatctacactaattcttctgatctacacattaagttatgaagctacaaagttagaggagaaaataattccgaaaaaaaaatgatctaaaaatcaagtttacccagaatcttacccaaccctctcaccctagcctagtttgccacgacctggacccacctgacagcctcttaagcttgccttgactcagtccatcacttcctccactgttccagccgagagaggaagagattgagcgagccgacgcgtggccgcaacgtgtcgtcgatctcggtttcccttttctcgctctctactcctcccagacgcgtcgccattctccattcatcactctggagctgaagaagccgagggaggaggttctctgcctctccatcgccccaaaccttgccgccggtcgtagtgacgacgaccttcgccatctccgtttgagtcaaggtcacctccatctctttcgcgttcccatctctccacacaatgccgagcatttcctcttttgacctaaacccctctcgtgcagtgcatcgccgggaacgcgaccacgccgacaacgtcctggagcacgcaccggagcgccgccgcttcaaccatcgtcgtcgtccggccattctcatccacctcagagaaagccgctgcgccattgtcatcgcctcaacctcctcttcaaaacacctcaagaaccccagccggaaacatcaagaacacggagaacacatccttttcttcaccggcgccaatctaggatcgcctccgccgtcatcgtcgattaccgctgcctcggtgagccattgttcgattccttgcgcatacaccatctccttgacctcacaaccctcgtgcatgcttgcttgaagcagctcattgtcccgttcgagccgtcgtcgttcacccgaggaggagcgccgtcgccgagccgttccacaagtcaccgctgccgccaagacctcgacaaccctagctcgacccacggtgagcatcctgaagtctagaagaccacatgcatgcatccttttcgttcgtaatcgacttccatgcgcacatgcactttcaccccaaaaccaccgccgctcacactcgccatcggcgctactccgatgtcctctaaccaagaaaactagaggaatggaatcgcgagagctttgtcttcattttatcttttgacctcaacctcaaatgagccaccgtttgccgccggcgagctccagatcgagctcagccatggctagctctgctctgcctagagcagagggatgacttctgtgaattagattaagtgcagggatccgtttacaattgtagaaacacactgacatatgggcctaggactgcgggttgattcctagaaaactcaagggcctttgtgcatattggtccctcacagccatgtggacccatcctttaaaatctgaagaaaaattaggaaaatgcccaaacaattatatgtttagcagaaagatgcacaaagttgtaaaatctatataaaatcaaatatagctcattttgaagtgattccagtttctgtagattcttgaagttatgaactttattccaggaatataaaacttgacactcactgtacaaataatgtctctaagatttatctaagataagtcatgcataaaacatgtacaaacttataaaatacatagaaaattcatttcaactcattttgaaacaaaatcaaattctacagattcatcattcatcatcatacagtctctgattaagtgaaataaaagtaattacttactttgcatcaaaagcctctaaaactattatctttaaaatgactagttttagataagctaaactttagaaattcatgtagaacccaatttagcttcaatttgaataaaattaagttatgtaggatcactaacacatgtatttccatgttatgaaataatattatatacttactgtgtagtaaaagtctctaaatattcatataaggatttactaacatagagcagcctttaatttgtaaaacttgtagaaaatttatttttagtccaaatgaaatgaacaaagtttctatagaaccagcaaatagttatcttcaacatagtaaaataaaatttgtcaccttttgtagagaacattgatcaaaaccttaacttagtgaaataagaatttaaacacatagtgttgtttaagtaatacataaacatgtataagtatatatatacactttaggtctaattaaacctaaataaaa

SEQ ID NO: 59667 - DNA, 11985 bp, Oryza sativa
aatggctttgggcaactaagtgacttttaaatgctgtttactgcaaaacctaacccctactattatccccttgtacccccttgcattaatcatgcatctgccggtgtggcttgctgaatactgtggttgtactcattcttgctcaatcttttcccccttcagtaagagaagctttggagaagatgtcttaggtggagtcctggcttataccccagttgagcgcctgtgaagatggagccgtaggcccgctagtccgctgccgtttatttttgattgtcaggccttaagtgcctttgtaataatgtaaatattatcgatataataaagatgtgtctttatatcatgtttgtgtggtgtaccccggcttttcctgggacggggattaatacactagcgttcgggaaaaggcaattttcccggtcgcgacattgcccgggggtcgtgtgctcttgcgagcagtgctgagggtgcgaggtcctccaaggaaggtgatgcggggagcaggagcctcatcctctgaaggatcagtgatgtctggctcgatctccggctcggtgtcggtcccctccgtctcggagtcgatctggatcggagtctccaaaccggaacccagctgcggagaaggtgtagggatcagtggagtgtgcaccaactccggaacaggtggctgtgctgctgtagggtccactaggtagggcgctgactcggtagctagcatactagcctctcccagaagagcgtggaacgccggtgggtacggcggggtgaggaagaagtagcggtcacggcctactgctgtggaagtagaggcccctgtggtgctgatcttggctgctcgaagctgctcctccagctggctgacgtgctcctgactctctctcagctgctcctcaagagtatccatcatcccgcggcgatcgttgtactggtcagataactgctggaactggtcgccgtggacctggagctgtgccttcagtgagtctatctcactgccccaagcctggtgctcctcctccaactgaagctgctgtgctgtgaggtcggtcacctcagtctctaactcctccatacgtctctggtggtcgtcaatctccaacagagcctcctcgtagaagtcatctactgcctcagcccatcgtgacaaccgagtcaccatcgggttgtagcagcagggcgtgtcctgaactgtgcaaactgagttgccctcctcccggaacgggtgatgagcaaactcggtactcactaactcagctcggtggatagagctgagtcggaggaaggcctcccgggcggcatcctgcatcgctgtctctggcaggtctcggtggtgacgtgtctggaagctgtagtctaactcggaagggactcgggggtgaatctcgacccgagcctcccaaactgggccacactgcctcactcggtatgacggaaaaccagggtatcgcagacgcctcaacatccgatgcagctcaataacataaccctccgattggggtaagctcaactcccaggtagcgggtgaatccgaatctgccatctaattttaaggaaaacccaaagtcagttgagagtaaaacttgttttgtaaagaaaatagttaagagtaagataaaaattgtgccgagttttgtaaacatagcgtttttatttttgaaagtattactaaatgggaatttctcccttggccaacttagaaaaggggtggggcgccttttggtcttttcctacagtcgtatggctctgataccagctctgtggacccccgtttttataacaggaatcaatcgtgtaaacagtaccatttccctggatcaagtagtttggtacacacgaattcatagctgaaatatcaagtgcacatacacgagtgtctgatacgaattattacatcataggcccgcaggcatagtcttaaatcatcggaccgagaggtccggaatacatccaaaagcagaaatagataaggcagcggaattcaggcagcggcatgccattgccacaggcaacgaccgtactaagacctactggacgccatcgtcttcatctccctcctgatagtaggcatagggatcctccgaggcttcatctcccgcttctgataaattttatatttgcaaggatgagtaccaaccgtactcagcaagccaccacagcaacaatgcatatgaaagggggagttcaaaggatggccatagttcttttgcgcaaagcaagttttgtaattctttttacgagcctaagacctagcattgactgatcaaattttagtaccagagtttgtatttaaacaacgacggttctgtccaccatccattgtgatcccaaggatagcttcccgccattgattcgtcatggttttctgaggacgtccaccttcccgcttctcaggaagtggctccatcagcataaaaaaaaatcatcatgcaatatcccatcccacacaagttaagaatttagagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctaggcgtacacggtttttagcagtgagaggagttctggcgctcccgagggggaaaactcacgcacgcctaacatcgcattctgtagttgaacccaatccatgctgtccccttttgggtatctccttgtagtcttgtagtcttgccaagtcagtctctagccatccgtatcgggtatccgccatttggccatccgtatcgggtatccgccagtagactgcttgttcgtccacacacctaagtgaaaccactatgcagggatactgcctccgctcggctatctactccgctaggtctatacccattcgagaagtacggctgtactgaggtcgtttcatgtttaactttatggctcggtccttaactgaccagggacggcactagcctttaccggacaccacccaagtcctccagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattgggatcaacatgttcaaggaatagtgatgacttgccttgctcaaagtcttgcgggtcttggccttcgcttggatccgcaactccctcgggctctatagttacgtgcaagaattgatttgaattcggttagaattcaaataaaaatccaaacaaatccaaataaaagtcgcatgcgaaagtcgattcccttttattaatcttcactatccgcgaactacggcaaacccaatttcgatttaaactgttttgcgggtataatattttgttgtcataagtttttaatttaatttacccgagcattatatccatatattagattagaaatttcttctcgcgagctaaatgtcggacggaatcctaaaaatattataccatttaatttagtctatgactaaacgattaaacataatatacgtctaaaattcctatcgattgaatccgaatttctaccgtgaatcgattacttatagggtttacccaaaaatactctataataatctataggaattcgtctatttgtttagttattaatttcatctaaaatactaccgcgaatcgattaccaagaataatccgtaatttatattacatttttgcaattctacgactataattaatctataattaaattctaattattttaaatttcctaaacttccccaaactccctctaatttctatttatttcctttttcctttttctccctttccttttttcttttcttttctcttttcccttttccttttcactttcttctcttctttttctttttctctctcctctcttcttcttttctctgccggcctctcttttcctctccctttctctctcggctctctctctctctcacccgagcggcggcggtggacgcaaggggaaaagagggcggctcaccggcggcggcagcggcgacgacggcggcggcgacggtggcgcacgacggcgtgggagcggcgacacggcggcacgggaacggcggcgcgggaacgacggcgcggcgtcacgggaatgacagcgcggcggcacgggaacggcggcgcggcgacttcgaaggtggcggcgcaacggcacgagaacggcggcgcgtggagaaggggaagagggagaggatggggagatggagtggggagaaatggggaggggtggagttttataggggagaggagggggaaagaaagggaaggggaggggcgacgcgacagcggcgcggcggcgcggggcgcgaggtggcgatgggacgcgcggcgacgggacgttgacggcggcggcgacagcggtggcgcgcggctcggggcgggacgcgacggtagcgcggcgcgacggcgacagggcgagacgacgggcgagcggcgatgggacgggcggctcggggcgcgaggtagcgcggggcttggcgcacggtggtggcgacgggcgacgcgcgggctcgaggcgcgggcgacgatgcgcggcggcaggcgacgatggtgacggcgcggcggctcggggcgcgaggcggcgatgggacgtcgacggcgacggcgacagcggcgacgcgacgggcggcgacagagaggaggcggagcggcgcgcggcgcgcggtgcgcgaggcggcgtggcagaggaggggctagcgctaggggaaccacgtcgaacacttggcggccgatgaacagtgacttttcccatttatcccggttttagtgtattttccatataaatttgattccacgattcctaattttacatatatgcattttactcaatattcatgtaatcttaactaatgaattctccctagattaatattactcatattttatttttatataatttattttaattagggttattccatcgtactaaaatttaattattgctaatatggttgcgatattattttatttatttcaatcccacctaacctttattttaatttatattttaattatttatttagtcaactagattttattttatggtttgttcctagctagttattcattattcgcgattaattagactccgacatcaaaatccaatgaaacaggcgaataaagtcggcatgatgcaattggtttaaaaagtttttgaaagtccgcatttttagagttttgatttcgttggtcgaattttcagggtgttacatatagcctcccaatgatggttgtgacggacggaatggtcggaaataccctccaaccgtcattggagactaatccacactgtccaggcgaagccctggatcggatggtgctgaccctggttgtcacgtcctgataaattcatcccgaaataaaaatcattctctaaatggaataatagaattaattaaaattcgaaaagaaattggcaaacactaaaatacgtacaagaaaaattcaaatgtggcccgaagaatttttattgaattcttcttggtaaaaaaggagccctcaaattttacttgaattttcagaacaacggaaataattattaagcaacaacaacaattatcaaagtttactaaaaagaaaacctaaaataaatcctcctcctcagattgggccctttttggccattcccttccatcctctctctctcccgacgtcgcaacccgagctgcagcagcccctccctctcggccgaagctgtttcccgttcctccttttctttccttttgggccggtcattttccaaagtctactttgcctcccccatgctacagtgcatcttcaacctccagccgccagcctcctcttctctctcccgttaacccttgcaccaattcctccctcaaatccgctcgattcaaatgactaattccaaaattgattagggggaattaatcccctttcccacctctctctttcccccttaattcccccttgattcgtgcttttaatcacctggaacgcccgcaccaatcccggccgctttccatggccgccgggcgacttatccgccgccgttcccacctctcccgtgcccggctccctcccccatcctataaaatggaaccccctcgatccgttctccagtttttgccccctcccgcgctctcccgtggcctcaccacccctccccgccgtcccccttctctttcccccgcgccggccgcctccagccgcctgtgccgccgcgcctgagcatcggtcggccgtgccgtcgcgtcccttggctccgcgacgccgtcctcgtctccggcctcacctcctcctcgctcgaagctcgccggagtggtctcctcgtcggcgtccagtacctcccctcctccgggcggctactgttcctcgccggtgagcagccgacgtcgccgtctcctcctccggcatcgcagaggcaacgacgaagatatcacagtcgcccctgacataagctcgggggctacagaggcagaacgcgccgttgccgacatcgagaccacagacgactggcggaccccacccatcaagttcctgaatagtgacgagttgcccgaggacgacgcagaagccgagaaaataactcgacaagccaagatctactgtatgatcggcaacgatctatacaaaaaggcgccaaacgaagtacttctcaaatgcatttcgttcgacgacggcaactatctcttcctagacatacatgaagggatctgcgggtcacacgccgccggccgcacattagtcggaaaagcttttcgacaaggtttttctggccgaccgcgctcaaagacgcttgtgacatggttcagcggtgtgaagcctgcgaattccacagcaaacacacaagtctaccagcgcaggcgctctagactatccctcttacctggccgttctcgtgctgggggctcgacatactcggaccattcccacgaggacagggcggctacaggttcctattcgtggcgatcgacaagttcaccaagtggattgaagcaacgcccacgggggaaattaaggccgacaacgccatcaaatttatcaaagggatattcggcagatatggattgcctcaccgcatcataatagacaacggctcctagttcatcagtgccgacttccaggattactgcatcggattgggagtcaagatttgctttgcctcggtttctcaccctcagagcaatggacaggtcgagagggcaaacggcatagtactacaagggatcaagacccgtgtctacgacagactcatgtcacacgacaagaagtgggtcgaagaactcccctctgtcctatgggccgtgcgtaccacgctgacaacaaccaacaaggagacacccttcttcctcgtgtatggctcagaagccatgctccccacggagctacgacatcagagcacacgagtttagaagtactccgacgaggatcaggaggagcagcgaagtgatgacgtgaatctactcgaagaacatcgagaaagagttgccgtcagagcagccagctaccagcaggtccttcgccgatgtcacgcccagaaatttagcccaaatttccagactattttgtgtattaaatccctgtccaggaccagccaaggtacacaaaacgacaagtaatatacagttccaaacgtaaataaagcgtcaaatacttacagaaatacttacagaagaggcacttagtcctcacaccgaaacgaaagcagcagcagcggaaaaaggcgatcctagcggggcttcagctccactccacaggcaaaactcaactggggtctgagccttggtcttctaacatcgtcttcaactcagaagcactgcacttctgaaaagggggaataatagcaggctgagtacaaccaccgtactcagcaagccacaccaacgatgcagacgtgcaaggggaacacaaggacagtttgtggctatttgcataaaggcggctgtaaaacattttattgagcaaacagtaaaacaattgagtaattaaagtaacattaaatctccactgatcaacgctacaccacgttgaacaggcccaaccaacccacctgaactacagtgcattgggtcgatttattaagtgtgagactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacatcacacctcaggtttcacccccgtccccagcgggcgacgggcagtcccctctcgtgcctaggtgaatccggaagccgtataggccgtcgcagggcccatccaaactccatcacgcccacccttgtctggatgcgtcagctagagaaaagctatactacaagcccagccgttgcccacgctggcttgtggtaagtacgataagttcttctagggcatcccgcgaaccggtccttaattgccatgggtgcgactagcaaaaccatgcacccacagcccaccattcagtcgcattttagttgaataattacgaccatgaagcatggccagatgtctcgagcacgcagctcattctgatactaaaaatgtctaatactgtaattatcccatcaactaagctagtggtaattaagcatggctaagcatatagttctagctaggtcacataagtaacatgagctagtcgatttattacccccggttgacaaaggacagatatcaagtaaacatggcacaagcgagcagataggtaatacccggatcccatgtaattaacaaaacatgcatacttatttgcaaacggtaaaacatttataaaataggctcaatatgctcaaggggaatgtgtgacttgccttgcttcttcactttgatcttccgaactcttttcctcgcgaccgcggacttccgaaacgacggattctacacgccggcacgcaaaacgaggaaaaactctaataaaaaccaagggaacagtacataaaaactaaacaaacatgtagagttcaattttagatgaattttgcaagttgaacggctcaattcggaattcgaatgaattagatatggattttagaaggttttgagccattaaatgaatttctataattattaatgatttattgcgcaattattaatggtttatgacgtcaccgggggggaataggtggcgccgacgagcgggccccacctgtcggtggctcaaaggaggtcggcgcacagtggactcggtccacgcacgtgctacccgcgggcgcaccacgtggcagccacgtggtggccacggcggacggggaggacaaggtggcgccgacgtggcgccacaggggcagcaacgccgggcggcacggggagggtcacgtggacggcccaaatcgacccggggtgaatcgggcggtcgcgggcgagcgggaaccggcccaccggccggccggggagcggtggcgtgtggcccgatggtcaccgatggcgaccactagcgcggcggcacagccgggaggcagcggaggaaggtgaggggttgaaggggagatgctcaccgagcgcccgacggcaaaacgacgaaggaaggcggccggcggagctcaggcggagagggggtggcggcgctccggcgacgccaaggggcgccgtgacctcgcgcggggcagatggcgttccgatgggttttagagccgagggagtggtggccgaggtgctgctccaccccaaaacctggatgtctgagcggcgcggcacgggatggtccccgtcgacggcaatcggtggctggaggtggtagaaatggcggtagctcgggtttgcggcgggaatggtgcttcgggggtggattggaggagtgggccggtggccgggatgcggcgcggagcggcggcgctgtgggaggcagccgcacgaccgggcgaggtcagtatcgccggcggcgagcggctggagacggagggaagagcggcggctcggttttcacggtggggtggtatttcggtggtggtttgggggaaaaggagtggaggccggggccggacggcgaggcgaagccgacggcatacacggcgcggcgcggtggtggctggggcggcgggaaaaagtggccggtgaactccggcgagcggcggctgctcggcttggcgaggggagagcgggcgagggcgccgggagctcgggaaagttggggaaatgggaaggagaccacggggatcgtttttattggctcggggcggagggctcatggccgcggagggcggaatcgaccggcaacggtcttcggagtgggctccggcgacgtgggcgaagtggggtggttcggcgccggttttggagggggaaagtgggggaggagagtggaggaggtggggcgacgcggtcccgcggtcggggcgagcgcgcgggtggaggaggacgcggaatcggcgtcgacgtggggaggccgtggcggcggtttcggctgagggagtcggaggttagggatggccctgacaggtgggacccacctgtcggcggctcggggggaaggagagaggaggagacggttgggggacgccaagtagacttcgagagagagagccgagcgggccgagggagggaaggccggcctgggggggaagggaacttgggccggaagtggcccaaagcaaagaaggaggactttaattcgttttctttttttatttaattggtttaatgaactttgtattattaaaattatttattgagctccgaaaattcacgggaaattttcggagagtatattagggcacagagaatattacaaaatattctcggccaatgatttttaaaggaaaatttcaaattctcccattatttcacttgattaaattgctttaacttttatttaatttccagaaaatgcattattaaatgatttttaattccgaacgaaaatcggggcgttacagccgataccacgagaagcgcatcagagcacgcacactttcgatcggcgattacgtccttcgacgggttcaaagtcaagcagggcgcaacaatctcttacccaagtgggagggaccatacacgatcacgcaagtcttgcgaccaggtgcattcaagattgcagacggcgatggccgcgagttagcaaattcctggaatattgatcaattacgtaaattctatgtataaatcaatagcattcatatttgtaagacatctcatgatttccataaagttgattttaggtaaaaatttcgggcaaaatgttccttcccgacaatcccttaccacgacgacacctagcgttgaaacctatcctcatgtccctttacgccgtcttgacaaggcctctgaggaacctaagggaacttcggctagggacgcccagagcggataaggccttgtcagatcatgtagagacaaacgatcatgtaagatctggtcatgtaagagttctcgctgtgcatattaaccaggccgtgtaatcggaaattgagttttccaacttcacggctgggggctagggtcagtgcttttttcaaccgaggcaggtcaagggtccaagagccttatcctccgagaacaattctccgacgacaaggctgggggctagggagagtgtatgactcaagtgattgattgaagttgcgaaatgagaa

SEQ ID NO: 59668 - DNA, 1261 bp, Oryza sativa
catcgccttccgatggccgacattgttctatcgcccttagttgtttttcatagtgtcatcggttgtggcttgccgatgtataattgccgatattggtatatcgcccttagttgtttttcatggtgtaatcggttgtggtttgccgatgtacaatgaccgatattgttatatcgcccttagttgttttataattttatcaatgctcttgacattgtaaaactaggggggcacatatatatcaaaatgcagtgcaaaatttttgagcaaattttgaagtcatattaattggcacaaaggattgttaagacaataaagtatcagaatgtcttagccgattacaaaaattctaagtcctattacacaaagattattaagattagtatcgctggatggccgatatagccttctgtctaatctgttctacttcttctatggcttgggcatcctgagcatcggttccagggacaactttcagagacttggtcagttcaccaacatgcttgatagcggatttgagtcttgctttctgttcttcaatagactttgggagatcggctagttttttgtgttccatgtccagctcagcgttgcattcttcaagttgtgctaagagttcaatcttgcgagcctcgagccgatcaatattagacttgaatgggccttcagatagttgatcgagcttggatttttcttcatacacaagttgtcggttggcttggatagtggcctcaatgtccttacgctctcgccattccgccagtcttaacttggctttctccaatttgaattggtgttgctcaaggtaaacggctggggtaaggatatcggctagctcatgtgggattagagcctgaatctcatgtagccgagccctgattgagccacaatcaaccaccaagctatctagcgatgatgcttctagccgacccaagatacttcctagagttttcttcacatcatcagataaaggggctaaggctttgcttgtggtatcttcttctccttcatcaagatagtctctgatgtcaaaagagaaaagatcggctaatacctgcagtgacaatttagaagcagttagaaacagtcatagccgatctgaatgcttgttgagacaaaaagaaacttactgggatagcaggagcagctggttgttcttctttctcgacgtgatgacaccccacaatcggctaagacattctggtcacttgacgattgttgtacaggaggagggtaaggctgaaaggaaactagtgtcagacag

SEQ ID NO: 59669 - DNA, 35881 bp, Oryza sativa
ggtggacgagatcggctagtggcaaggtggtgaccggtcatggcaggagagatagctagagctcgaggtgcttggttgtgtgtggggaaggaagaggaaaccttgccggctatttataggcgacaagaggcggttgccgatggcagttcgcagaggagaagggcgacttggccatggtggcagcgacttggaaaaggggagcacggtgctggcctcgtccattcattggctggccagggcggcgtgcacacacggcggctacagtggagttgggcggcggaaaaggagattcacggcacgacgacgacttgccgtggtcggcaagatggcggcggcggcaggaggaccacgggcgatggcgccatgccgtgggcagcggcgcgcccataggagagagagaaggaaggaggcggcttcggctgggccggctcagctaggctatgcgccaactgggccgtggcccgagaagaaaaaaagtggagggagggagagaaaaggaatgggctgaatagagggaaatttggcctggatgaatagtaactcttgagaattttgcatagataaatttgaattgaattcaaaggagatgaaatccaaaggaaacaaaaatatttgtggacttttggattttgacaaataatataaaatatagtttttaaagtactaaagaggtttgaaatatttttaaaataaaactaaagatatttatttgagatataaatttgaaaaggatgcaaaataaaaatgctccaattttaatagaattcaataagaatcaaatgtaaaacttgtcacgaaaaattttctctaataatttgaaatttaaattgaagtactcaaataggaaggaaagaaactacaaatggcaaggtttctaattttggataaattttgggaaggtggcagaaatagatggagggaaataaataggactgtagccccaaaatatgtggtatggatttttggtaaaatatttgtgggctaaagaaaatttggatttttgtaagaaagggattaaaataattttcttagcacaagagcaatcactctaatattgtgctaatattattcttgtgccaagaaggatattaagccaccgcaattaaacaggcggctggattaagataggagcatgaccaaagaataaatgatataatatttttggatggagtggaagtaaagatttttggagataggtctagatagaggtttgatctagaataaattccaataaaattagaattatgctggttttgcctcaaggttaaaaatggataatgagatgtaacagagagacgggccgattggggaaatattggtccaagctaaatagtaggctttgaaattttgaatggataatttcgatatacgagattccaaaggaaaagtatttgttggaggataaaactggatttggaaataaatgtagatggggaatcgtaagaatttctataggaacagaattggtgatagtatgataagcttctaaaggaaaagtgttaactctagggatattgaaaaatggtgtttcatgtactctggaaatgtttgggaaaggatccaaaggaaatatgctccagaacaaaagttagaggctagggaaaaataaatggaggggtttttataaagttcgaaagaaataaaaagagaataaaagaaggattttataaaattaaaagagagcatttaactttgcaaataaaatttaggttcaagataaaagaaaagattaaaagcaagattgctccaatggaaaagtcgagaagagcacaactaaaacttttcgcaaatttttttcttcaaaatttcagtatgttacactggattacccatagggccaagaaagtgttgggtgtcgacatgaagtacatgaatcaagatttggcttctaaggtgttgaaacaacaaaagccgaaagagcgggaaaccctaaggcctaagaaagaactgtacacgaaagatactggcagaaaaggaatttacctcaggaatgtcagaggtggtcgccattgttaagagtttgagctgacgaagcaaaggggctcgccgccgggagtttgggtcgctagaggaatcactggagataatagagcttgtgcagcaggggaggttgtgaaggacttagccggagaaagaaaatttgaaacagtgggcatgtgcttataagcttaacagtcaaagcagaaaccctagattttcacgggttcgacgaaagaaaattctgcctcattatataatacagcggaattggggggcatgtgttaacaacataattttgcatcagactcggagaggaaggagcaaggttgaagcagatttggtacgagattggagctggacttggagtcgggctgcgcattggctagataccgtatcggctgaaaacaaagtgtgagctgatcaagcttgatggagccgattgccgatacaactgatatggtatgacttgggctcggtgtgggcctatattggaataaccatcattactaattagagatagagctcggataaggcaattgtatctattaattaggatatttgagtcggtttgttagagatttggcaagagacgtcgtatatggtcttgtttgtatcttgtttttagaaaggttcgagtcgtgtccataatggaatagtttgtactcggggtataaatatgaaccccatagcattgtaatacgggagacaatccaatacaacttcgcgcatcgccaccctttttactcttcttcgttttcgacgagttcttcgcaagaggtaacccgtctcaatggcatgcgctatcggggctaacatgtcgctttagacgtgttaggctcgatatcgcgagtcattgctatcatatgtcttagttaatatattcttagcttctcaattttgctctatcggttattgctcgctttagggtttatgctggtttcggctaaattgtcttgctagatttagctaaggcatctaccatccttaaaagtgtttaattgcttgattgtctagactgcatgcttcttttcatactttcaaatgcatcatccctagtcgtgcttagaacaatgcaaactagcctgcaattagacataagaaggatagtattggggtttcagccgatcttacctaatatgcatgcttctttattcgtttcatgtatattcgccacttatacatacaggtcattttatataagcatatcaagctttagtcactatcaaccagatccttacactatcatgcttgatcattgtttgacatgtttatatagatcaatttatttatataggtttgtactagagtattagctagtacattatctttcatgctcgaaatactgtcacatcggctacttttatgatattgtcttaaaccaatttatcaaacttgatagacagtattacaactgattaggcatatttaggatttaatattctttgatatactcagcccatagccgatttggtctaactccattggctgagaccaccaacgatacgctattggccgactaattctgcttttgtctttctcactgattgcaggatcaaatcaattggcgcgtccttgacacactcgaggctagccttggacctgcactggagttaagtagatctcccaggccgccgtgttttcacatcaacaccaagtgaagcctagtagcttagctccagttggcatgttgctggcgagcgagagagagagagagagattgttaggcgtatagttggtttccagttaatacaagatcacgcctcaattcctaccaaactcttggctcgactgtgaaattccaaatcggggattggaatccacttcgttgaagaggaattccgtgaaaaggaaacttgcctcaatcggttagctgagttcggagcaggatttgaggggtgtgagagcgagatccagttcttagtaaatgggcggaatggatttggaggggaaatttgactcgctcctaaagacgatcgcagagaatgagaaaaagagggaagcgtcggagggtcgcacgcgagctgatcttgtcgagctcaagtcagcggtggaggggcgtcttccccaagtcgattagtaggtggaggatctgaattcggcactcgggattctgagttctaaggtcgagcagctggtaaacaactttccacgtgcggtacaaggtgagaaggaactcaattgggccatcaaggtaggcctgacaagaatgaaattgaaaaataggtgactgaaatgttgaacattggggtaattcaacatagccaaagccctttctcttctcctgcattgctagataagaaaaaagatgggacctggagacagtgcattgactacaggcagctgaattcaatcactgttaaaaataaatatccagttcccataattgaatagttgttggatgagttatctggttcacattggttctccaaattggacttaagagctggttatcacgaaattaggatggctaaaggggaagaacacaaaacagctttccaaacacattctgggcattatgagtacaaggtgatgtcctttggactaacaggtgtcacgcccagaaattcgctaactcgaatttcaagcggaatgtgtattaaaatctctgtcaaggactagccagagtacacaaacgacacatcgatacacagatccacgccttacaaaaataataaataagtcttacaaacgtagcggaataaaattaataattgaaactctgaacgaagatcttctcgagaaaaacatagcttcttccaaatccacaggcatcctcaacatccggatcaagcctaatcctcgaaataatcatcatccgaataattctatgtctctggggcaccgtactcaacaagtcataccaatgggaaggtatgatgcaaggtaataacaaaggattggcaataggatatttgcataaaacaacatttataaatcataatttgaatgtagtaaaacaataaatattactaagcaatattaagcatcactgcccaacgctaaacaacgttgcaacaggcccaaccaaaccacctgaactacaccagttcataaaatcatactattaagaatgagattaatcacggcgagctggttgaccgcccaataaccgcgggcacggctattcgaatatttttattctgatcagaggtgtacaactttacccacaagacacagcctcacaacacgttaccatgcgccgacatgccaccacaacataccgaaaagagactgatagaacccttcgcataaccctccctaaccaagaatacccacctcaggttttgcccctactcctcaataggcagcaggcagccccttctcgtgcctaggtaaatccggaagcagcagagaccgaagctcggtccgtcctgcaccatctcttctacccttgccatggtatgttgactaggttaagctatactctagattcagcctggagcccatgatggcatgtggtaagtacgtttatatcttccaatagttcccgagaactggtacttaattgtcacgggaacgatttgcaaaaccatgcacccacaacccaccattatagcatattttaatttaattaaatccacaccatggcagtacattatcatcataaaattaaggactaagttatagtgaatcccattgtgagctaattaatctaagcatggctaagcattcctaaaccaatcaactaatcacttatgtcccaagttatcaatagcacaaggtaacaataggttgagtacgataggcatccatcccacatgacattataaaataatgcaattttaatagaaaagcagggatttgtaaaataggttcaatatgatcaatgctgtatgtatgacttgccttgctcttgagctgtaggaacctcagcgaccacttcgtaataaacgggagcatcggaactaccagattctatacgacaaacaaagaacacaacaatacatgcaataagtctactgaaacagcaaaagaaaccaattttaatgaattctagacattacaacgaattcacaacaacttgaatgggttaaaacggagctcggatgaattacatatgaattttagaatatgagttgtgtaattactattaaccaaaaatccttagtcaattattaaacattaatgcccgaaggcgaaatagatcaatggaaaatgaactccggtaagcaagcctcacgggtcaacgactcaacgagtcaacctaccatggcacgggaccactcaaacggtcaaccgaaccggcaaacagaaccagcggctcagaacgattgcagggtttcgaacgactcggtacgaccaaacgaacgaggttttaggttatacttcgtacgaacgaacggttagcagctagctagcgaaaacggcacagccggtaaacccggctgacaggacatggcttgcggctgtggctaggtacgacgatcggtaagcccgtaacgacttaggtggacggttgtgactcggcaaggtggcggcgcacaacctacggcttggcaaagcggctaccaagtggtggcagcgtctcggctgagctagcaccgcagcacagctgcgacggcagcgcggtagcagcggcagcggcgcggcgacaaaccaaccataaccaagggacaggaaggagtcctcaccgggagacaacgacaaccggcggggagagacggcggcgcggcgaaccggcgacgctggaacaacgacgacgatcgagattagatgggtaaacggaggagataggatggttatgatgacaaccataccggcggggaaaaggagggctcaccggcaacgcgacgacgacgacggcggcgacgggcgatggcgggaaggcggcgctagcggctagggttagggtttggcggcatcctggggagacgagaggtggtggctgagttttgacggggaaaaggaaaaccaaggaggggtgccaagtattaagtaggtggaggtggtactggattagggtagggctggtggcggtacacggcaaaggaggggaggggaggggcgcacgcagaaggggaggggggcggcgcgcacggcaagagggggggttcggaaaagaaaagaaaaactagggaaaggcggtgccatttaaagaaaggaaaggaaacggcagccagaaaaggaatgcgacaaggactcggcctgcgggaacaaaacgaagccggaacgacaaaggagtcagcagatacaacgaaccgtggacggagagtgaaccaggaacggttcgcgaccaaaggagggacaggaaagaattattactttaaatcctaacattttaaattaacagggttatttactctgctctgaaaattccgctgataggcttgttaatggtttaaagcaaagagaattcaaaaacaaattctccctgacaaatccgattattagacccgttgttaattagggttttctcctggttaaacatagcattttctattgataatttattaatggattaaaactatggaaaggggaaactccgggtgtgacaacacgggccccagcaacattcctgagtgccatgaatgcaacattagctccagttctaagaaaaattgctgtggtcttctttgatgatatattaatttaaagtccagatctgataacacacctggaacatttgaggagaattctgcaattactggctgacaacaattggaatgttaagctgagcaaatgctcttttgcacagcaagaggtttcctatttggggcacataattggaccaaaaggagtatccgcagattccaaaaaatacaagatgtggctaattgggcaattcctaccactgtcaagaaactaaggaaacctttggactgatcagtaaacctctcactcaacttttaaggaagggcatcccatataaatggattgcagaaaccaatcaggcttttcagtgctagctctgcctgatttctctaaacagttcattctggaaactgatacaagtgagttaggcattggggttgtcctctcacaagataaacaccctatagcttttctcagtaaggcattgggacccaggactcaagggctgtcgacatatgagaaagaatacatggctattatgttggcagtagaacaatggagacaatatttacagcatggagagtttatcattttaactgaccatcacagtctcaaacatttgactgaacagaggttacatactcagtggcaacagaaagcttatactaaactgatggggctgcagtatcatatatgttacagaaagggagtaactaactctgcagcagatgctttgtccaggaaggaccatgccaattctgcagaactgtgtactgtctcataatgtgtaccttcttggatgcaagagattgttcacagctatgatcaagatccctatgcaacaaagctgatagcagaactagccatcacaccaacagctaggcaacatttctcttcagtacaaggcattctcagatacaaggggagaatttgggtgggacaatactgaattgcaagagaaattaatcgatgcattgcatgctacccccattggtggacattcaggatttcctgtcacttataggagagccaaaagcatgtttgcttggactgctatgaagaaaatgattcaggccaagctgcagacctgccaaacctgtttgcaagccaagccagacagagctaaatatccaggcctcttgcagccactaccagttccaacaggtgcttggcaaaccatctctttagacttcattgaagggttgcccaagtccagtcactataattgcatccttgtagtggttgattagttccctaaacatgcccacttcataccattatcacatatttttactgctagcagtgttgcactggagtttttgaagcatgtttacaaattacatgggttacccaggataataatttcagatcgagataaaatcttcaccagccaattctgggagcaacttttcatcaggtttggcacaaaattgcatatgagcacagcatatcacccccagtctgatggccacatagagagagtcaaccagtttcttgagatctatttaaagtgttctgttcatgccacccctgcaaaatggtcctcctggctgtatttggcaaaattttgatataacagttcttatcattctactttgggcaaaaccccctttgaagtaatctatggctacagcccgagtcattttggcatcagcttgaatgattgtcccatcccatatgtcagtcaatggcttcagcaaaggaaattgatgcaacaacttctgcagcagcacttgaatcgtgcccagcagcagatgaaacacttggcagataagaaaagaagttacagccatatgtgcagtcattagtggtcgtcagagctaatcacaagttatcctttcgacattttggcccctttcaagttcttgcaaaaattggcactgtggcctatggcttgcaattaccagcttctgctcggatccatcctatatttcatgtttcccaactgaagggcgccaagggtttttctcatccggttcagactgagttgccgactgacttcactcggtttcagattccccagcaattccttaattacagagtgactaaaaaacataattctgctactattcaattactaacccattggtcagggggtgcagtggaggacgcaacctgggaggacatgcaggatatacactacaggtttccacaggcacaggcttgggggcaagccggttttcaagattgagggcttgtcaggcctacctcgatgctgccaagggactccaagagcaagaagcctgacgtccgtgtacaagatggagaaatccacaaggaagcggaggtagctgatcgggagcgcgacgccaagatgatggaaggagatgctgatgaagcagagaagaatggtggcgctgagaagagggtgccggattccttggcccaaaaaccagaaggcccaactcacgtttcgtcggcgagcaatggaccaagtgaagcccagtagcttagctccagctggcatgttgctagcgagagagagagagagagagaaactgcgtgatcttgctataatatactccgtataacagagtagcgagaaacacggcggtgatgaactaatacgcggaggcgtagccggcgcagcttgatcctgttggatcgagagattgcaaggcgtatcgttggttcccagttaatacaagagaaaaatcgttagtgttcctaacatagcagtaacctgacgatttaccactcgatatgtgccaccaagctcgcctccctggcacagagtttccctcacgcagtcacgcatgcatcttcgataatcgagacggctcatatacctgagaaattggtgacgctggctcgtagacgccgccggtcgccggagttcgtctcagattcacggggaggaagtctgcagcaaatgtggagaggggagcatcttgatttactgaggcagttggtgggaaaaataatactccctccgtttcaaaatgtttgacaccgttgactttttaacatatgtttgaccgttcgtcttattaaaaaaaattatgaaatatgtaaaactatatgtgtacataaaagtatatttaataatgaatcaagttatatgaaaagaataaataattacttaaattttatgaataagatgaatggtcaaacattttgaccatggcccatacattttgaccatggcccatatacttaaattttatgaataaaaagtcaacggtgtcaaacattttgaaacggagggagtatatgctaggggagcatccgtggcccatgggttaacgggtctggtgaagcagcccgtaaccaaatgtgcctctaccaggcccgattgcgcgcacagatcttgaagcagaatctactgccaacaaaatcgactgatgcaggtgaccgtaaaatagcaaagctgaaacaaatttgcgtccaattgaaggatgtttgtgtctttgtatagcactgtatggaaaataaaatggttgaattaagtagcattcacggcaaattatctgttgtacacctaccacttgcatcagagtgtgttctactacaaactgaagctacagctggtgttgtggtcagaataacataaactaaaataaaacactggctaatgtgctagtgtattcagattttggttttctgaatatccaaccaacccctgtaacaaagcaaacaccttcctaataccctacacccaaaaaaatccagaaaacaatagatcaagagtttatcagattgcaggaatctgaacaggacatgtaaatatctattccagatccaccttccttcatattctgcacaagaaattcagataaaaatttttagaacattgatgttcagatctttctagttccagatttcatatcagtataggtaatggccctttcccaaatcaccaagaaagacttctccagaaaattatatcacttttctggactcgatttagtcaaatttacttatcactataaaacagaattgttatctattactagttaccatctaccaaaattaggacaccccgtagctagaattttccttcaacctgacacatatagcatttttagaacacaagatacatataaatcttttccggaataggaacaagttagtatagcaaatccaaatcaacatgatccatcaaatactatacatacactaggtcaataagtgaagcatggtaatttctgacattgcttaaaaaatatgtggattggaatttaaacaaaactaatatttattttcatgagaacatgcatgttttcatatttcagatttctaaacatgctcagtgctaacaaataaattatcatctttaacaaatgtaaaaaaactatagtataagactaaaataagaacttcaaatgccagcctgaccaaataatatagatgaaatatgtctgaattaagactttgtagtacctaaccaaaggaagatcagccagacaaaaactaattcatattttagaaggttacaaaactaatagaactattttaggaggttacaaaactaattaagttgaacatattagtgaacattttagaatatatgagctaacagtgtggtgacaaaactaagtacttttagcttacaaaacaaaacaaagcaaaataaacaaaaggataaaataatgcagctcctaaatattacacacaaaacgaacaaaagtgtgcttttagtactcaaaagacaagaagtttgcagctagactatgactaggccagcaagcaaccgtcgagctaacctacaaagcaaccatcgggcaaaataccaaaactacaaatgggacacacaaccttctcgttgcaactttaaaaaaaacacaaaaatgttgcataactacatcaattaaatttggtgaccaaaacaaagagaatagtgaaaggagaaaattacaaacaatgcattctaataaaacagggtactattagtaggcttgctaacaaattacacaaaactaagtataattagtaggttaatcagtaggaggtactgtccatttacacaaaacaaagtacaattggtagcaaacaaaactgtcttattagtatcttcattgctaacaaaattgacaaaactaggtacacttcaccaactacctaaaaagccataaattagaattgacgaccattctttagaacttcgtttctatattatgattagtacaaaaggaaaaatataagataaaaattcagagaagatgtcaggacctataaaatttagagaagctgaaatgtggggtatatattctgcaaaccatgagatgcaagccgtgcaagcaattgcagattgcaagaaggcaaatcataaaaaaaatatataatcatataaagatacaaagacaaaactagttaagtagtgtttgtaggagagacaaatatatccatgtaaatttacaaaattaaatgctattaatctccattgaacaaaactgaactgaagtgaattcaagtgaaatgctattatgctaaacaaccaaaactgaagattatttattattatgttaaaaattgaacaaaagtaagccatcttcagaagtaaacaaaacatacagaactagctttatctgtatgatctagcatacatatgcatgaaaaatcatcaagagagccaaggactacggagaagcagagggactatgtattcttgccgcgctacatgctgtgtggaatcaaacaacaataatacaatcttttttctgacagttacccaaaaataaacaaatcagtgaacaaattttatacactatcgagtagtggttgccccatggatcattccctcaatttgatcctctaaacctagagagactaatcctttctcctctatcttaataacattgggtgacctccttcggtcatcccggcaaaaagagagactaatccccatggctaatcctctaaaaccaaccaggctaatctccaaaggtaaaattgcaaaacaaattaggtagtgcttttgctctaacaaaagaaatgtgagatcaagctctaatcacacaacctccctatttgcaaaacaaaatggatataaaccactttcgtgcagtggctagctgaatctaaggtagacattcctcccccattcgaataatatttgctcaaatcaataagaagcagaatcatatataattattttaaacttgtaaaatggaattatatgattttttttaaaacaactttcatacatgattttttttgcaaaaaagcacgcagctgctgcctaaaagcgtgctgatgctgctgaacagcgagcagtagcgatgtttgaaacagccaaacgatcctttgtcccctgcttacctacggagaaatatattttgcaacacagttgctcgatgatttaaccatttttcatattaggtgtaaatggatccacaaaatgcctctagttggtactgcactacaaggagttctgaagtgtgacattcaagttcatagcgacgcaagaaataaatacatgaaagtaaacatttagcactttgtaaaccactaattcagaacactcatccctggttcttcctcttcctgctagctcctacaaatgctcattcctggttattcctcttcctgcaatatattgcggattctcatacaaattagaaatgatcagagcagtaccacagatggttatggtatcaatgataaaatggatttgtacaaaacatgagttggatacgctatgcaaatctacaaaatcaattcacccatatcttgagttattttgataatgttggtgcttaccaagcactacaggaaacagatattacgattatgatgcagtatgaatatgtatcaattatgcggatacatagattgaaatagctacataattaaaacatgtgaaccaatgatcacttcagtatttccaaatacttgtactggtagtgatatggtagtgatcacttttaactaggaattgtgccgtctatagggcttctgatttattctccatttagattgaagccaatttgaatattgaatatccattagcaagaaagggggtagcatgtgaatcagggattgagcttggctgcagtaccatatatagctatgtgtatgcttgtaagagccactataattagcccacgcactgatgctataagaataactgacatacttcaattctacatgcttaactccagtagacaatgcaaagacaccaaacaaggctggaattctcttgtggagcatcaaagtggcgtcctagtcctaacactgacaccaccaatgtagaaacaacctaaattgcttagagtaatcatttcaataatcatcatttcaacaggacataatcgcttttaccatcaaaaccaacagcatttctagaccaccgtcgccctacctagcatcaaaagcgaggcactagcttaattaaattgcagatgcacccggtaggtggacttactaccaaactaagaaaatgaatatgcagcagcaggcggaaatccgtagaaagtagtaacgcaggtaattaagatgcatgtgtataccatgttagattgaattgaagtacttggaaaactcagaggggaggaaggactggggatagcttgactttgccctgaccatgtcggcatcctcaccggaaaggtcctcctgcccattaacatatggaataactgacaacacggtcttgctggctaggtcaatggtcacaaccgacatcttcctgatcacgtgctcatagtcgcaggtgaggaagtgcatgacattcggcatctccatgctcacggtaagaaacaggagaacttcatgaggcacgagctcagggcccttgaaggaccaaatctccttggacgtgatcgcaaagtctttgctccactcaatggccccaacatccagccctaacgtcctcaaagtgtggcaggtgatggtatagccccgtcctggttctagggagcctaacaacttgctatcgagccggttgacatcagcaaacttgagggcgccagagccgtcgcactcggtgtgacagacacaccacggtacacctgggagaaatggcggcgagatctaccgttagggaagctgtccagaggaaaccggatgaaggcgattccaggccttttctgcagtacgtcgcagaagagcatgcctcggtcgtagtccacccagcagaggtagttttggaaggcgatcacagtgtcagtggtccagtagaagatgtcccagtactcttcgccgctgccgtacacgattggcagctccatgatatcccaccggccgcctccatctccatcttcacctttggaggatatggccgagcggagcacgcacagtctggctttgacattagcattgatgtttctgaggacctgcagctcggcgacggcaaactcttcgccttggcacaagatgccgacggatcgaaactccaatggataccgcaggttgccgtcgccctcaacatcagatggggggaagccgccttctggctggtaggtacatgggaggggttcccccccttttggctggtaggtacatggggggagggctttgagtagcggcgaggaaactgggtcgtcgccggacgcggtgaagatgaagtagtcctgcgggcaagccggaacagggcactcgacgatgtagcagaagcatacgagaacgaggttgcggtgggtggccacgaggtggcatgccaccatctcctccggattcgggccctgtggccactgcacgtacaggcgggagatcgccggagggtcggcgatacggaaggcgatggtaaagggggtcttgtgggatccggaaccggatgccctcagtgtagccttggtgtcgtcggggaatgacttgtcgtcgtctctgcggaagacaaatcgctccagcatcacccagttggggaaggaggcggtggcggtggcggtggcggtggggaaggaggaggaggacatcgccatggatcggtagagatcctgagatggattggggaattaggacaagaaaaacgagacctacgctgcgggctgcggggacggatcgtgggagagttaatgtacagggggctcagactttgcagggccggttggcctgctttgatatttcggcctcgaggccgctagtcttctgcttcggcctatgacggcctccttaatttttaccggaggtccctgaacttgtcaccggggaaaaagtgtaccggaggtccctgaacttgtcaccgagatacgaaaacgtcctccaaccgcaatacgagatatggggtcccctaactatacaataccggtcacccgaggtcccacggcatgatttctccccgatttgtccgatgtggcgacggttttgtccgccgtggcgctttgacctcagtcgtcgtcgctgactcaggagcccggtagttaggatataatgaaggaaatgtttggcgcggcttgcttctcccccaaacaccgaaaccctagcaggtagcgagcgggcggcggcggcgacgacttggcgagtggcggtgtggagatgtcgagctcgatgagcgacggctcgtcgtcttcccgtcagtggaagtcttctcccgtgccttaccgggttggtcctctggattaccaacccgcggtgatgtgccaatgccggtgcccggcgaaggcggcgaggtggctctcgtggagcacggacaaccctaggtgctgatactacaagtgtcaacatgctagggtaagtgagggcttttggttgatatgttgttgaggttggatttggatagtttggggtttgaatgtagggttgtggtttcaggttggggggtgtgatttctaggcatggtgtgacggcccgacgtccagtttcattagggagctattgaatgacttgcgggacatggtgaattcgttgaggaggtggaaggaattgttgcagaaggaagttgaagacagtcgggctaagggggagcgacagaggatagaaatagattatgtgagggctatggttgctgtgaagaaggaagaaattagaagcttgaaggctaggaatcaaaaattagagaaggagaaaaaaatccttgtaatttgtatgatgtcatgtatttttatgctgtttgtggtgttagttgggaaggaatgagacatgttgatgtgtctacattcctgagtcagccttttgccatgctatctccaatggagatgacaagtatgaggttaagcattacacacataggttcactgtgaacttggacaagaaggagtgctcctgtagatactggcatctttcagggttaccttgccctcatgcaatagcttgcatatatttcaagaccaattcactggatgcatacatagctgaatgctattcagtagatgcattctagaagacatatgagcattgcctactgccagttgagggcatgaacagctgccctgaagatgacagagaggctttgaaagctcctggctatgtcaaaatgcctggaagaccaaggacagagacaagaagagaggccaatgaacctgcaaaaccaacaaaggcatctaggatgggcactgtaatgagatgcaagaaatgcaaacaagttggtcacaacaaaacctcttgtaataggcaccatgcagttgcaagaggtagtaccaacacagccccacagcaagataacaacttggtgctatctgtggagattatggataccccatacccacatggcgtggatattcgattaggtatgggggtaccatatacagatagaatatatctagtaaaggactcgattgttatgttaacttgtgtatcaaggaaatacccgatagtcctgatcggttacgattataatttatctttacatgcctagtccgttaggaacatgggttgtatcttgtaattccggctcctccccctatataaggaggggtccgggagcctctagaggcataacttttctctctgatcatacgatcaataatacactcggcgaatcaatccccggacaggagtagggtattacttttcatctagaaggtatgaacctgtataaatcttgtgtcttctaacccatccacttttctagcttgattgccacccccttttaatattgccaaaatattgtttcgacactatcaaacactccatagagttttgtgtagagcaaaaaaaaggaaggcaccagccactgctacaacaagttctgttcatagttattaagaccagactggtgattgaaccgttaaggcactcggttcactggtttattagttggaccggtcaaaccgccggttaaaaacggttcaaatagatgtgagttacatgtgtttcacagcttgtggcatagcctggtggttgaggctctcgcggaaaccaggaggttttgagttcgactcacagattctgcacctttttccctattttctgtgactccacgtgacgcgtcatattactagaaatataattcccagcaatggcgcagaaatacaagcgcacggatatatgggaagatcatgtagagagaactggactaataatttatacattgcttgtgataatcatattctaagtaggggttaagataatccaagggtagagtggcacacaacctttttccctattttctatcacattactagaaatataattcccagcaatggatataccattgtagcatttcacctgagagtagaaccccctattttctatcacattactagaaatataattcccagcaatggatataccattgtagcatttcacctgagagtagaacccagggaattaccagggaaccggggctaaatatgaattaccaaggaaccggggctaaatatggaggcttacatcttcccggtcggtcacccatctcaaaattgctctaggccaagcatgcttaacctcagagttctttcgagatcggtttccggaaaagaagttgtaacttgttgatatgagtattctattaatcctattaagccctaggctggaatgtcacatcctcaccccctcaagagagatcgacgcccccatcgatcaaccctaggccaagaacgtcccctcgcccccgtcgatcaaccccaggccaggaacgtcccctcttagccacgtccatgtgtctagtgccagcgcatgtgccatgctgtgtaaccactcccgatctacaccagccatacacatgcgcccgtgaaaccgcgagagtcagctctgataccacgtcctgcctctccaaggccaggcccgcttacatctggcagcttttataggtcatagactgccctcaggcccgcttacatctggcagcttttataggtcacagactgccctcacagaccaacacaagtctttcctgcacactttgtcctcactcgtgcgcacccaggaaatggtcacccatcctgaaattgctccaggacaagcacgcttaacctcagtgttctttcgagatcgatttccggaaaagaagttgcaacttgttgatatgagtattctattaatcctattaagccctaggccgggatgtcacatcctcaccccgggatgtcacatggtgccccacgaatacgtaactgcccaggatgttgatgttcagttacgcatcaaatgatataaaagcataaacttcgattatacaatacttaagtcacttagttcataacacaacataaatacaaaccattatatatatggcttataaagccttatttctacaaacagataaactgctagactccaccacaggaactgcctgagcgtaggatgacctagaaaccatagctgtcccactctaacggatcaacaggttctccacaagcatcttcctcctcatgatctgaacccatttatgagtacaaaaggtactcagcaagacatgcttatgataataaatacaataattgcaatataaaacatgcagtatcgagagctggaaggtttaaaccctaaccttaacagttatttcatatagcctaacataataaacatttgatctaaacaacactattgaacatttaatttaaacaataataacgagcataacaatataaatgttacttataaataacttgaatagaacattaaacaataaataagttaaccatattaattaatagccatttagtttaacttgtgcccataatctggaatcacccatagacacatctccattaaccgggagcacggtgtattcgaatactcaacgactctgcagcgtctgcccagctttacccacacgatacccacaactggccgggctgaaaagtaacgaggtgtaatattgctccatatatctctcccttctgcctagtaagttaaaggatgctcgggatgttgctcggagtgatccggtccgaggtgtgtgccaacctacctccgcatccacttaccattgttcgttactcgatgggcagcccagaacttcatgggccaatagggcagttctgaactctcggggcccatcgagcccacatatataaatcatataaacatgaaccatgtcattttgcttcacacacttgaaagctaatggccagtacaccgaaaggcctgcagaagttcaatcaattggagcaatatatggggccaggttcgacaaatcgattgtgtggatgggcgaaactatgtcattcttattgacacaagggggttaattattataccaattttaaataagaaataaccataaatatatccatatatccatcacgaccataaacaggtccataaaaccaaacacatgaactctatcatgtgtaccacccgctcacatgcggtgtcaacaattcttagcatatagccataaatagttccataagcatgttttcataagcaataataatatccatattaaatcaatagcatgttaaataattaacagtttgtttaagtgtttctcaaatcttgtcctaagcttatttgactctaaggctcattaaggtatttataacaacaacagaaaatataatgcaataatagcaatataattaacttaaaagaattcgtgcagtctatcgtactccaaagggcaagtacgctactaaaataactctctatctactgggattaaattgttcaagtgagggtgcatgtcttgcaaccttcgagctcgatgtagtcgtacaaatcgtctcctcctagcgcgaagatttcacttgctccaacgtcagcgttttctatttacgcaacaatcatcaccacaataaataatagaaaaacaaagataaccaaaagaaaatattatcacaaagtgcaacaatgggtgaaaaggatttaaagaaataattttagggatttttggaattttggtgaacggcgaaccctagggctaaaattagggtcgcgacaacgggtgctcggattgcaacgaaactaacacggatggattcggaataattctaggagtttggaataggtctcggatttcgatttcgaggtcaaacggatggtcaacttgataggaaaataaaaatgatttttctgatttatttttcaatagaaaaatccggtttttcttcttcttctctcgctctgtacaggaacggccggaatcccacgacgccggcgttggagatggccggttttgggcaagggagcgccggttttgcgatctacagggtgcagcaactcagttaccgtggttggcggcggcgcaggcggcggcggtgaggctggcgacggcggccatgacagcggtggttccggcgaactccggtgagcgcggcggccatggtgagcatcagtggagcaaggggagcatggtggtggtggcggctcggccttgggcggcctggagcggcggcgcgccgtgcagccggcggcggccgaacagagcggcgatgccgggaggcgacgccggcgacactccggcgtcggattggattgggaaagaaagaggaaagggagtactcagcatggagaatccatttttacattcaatttcataggatttgcgatgtatgcgacgaatttgggagctctatcaatggcccaaatttagggttttggggatttttcctccggtaatggcgatttgattcagcgggggtaggggcgaatttgaggaggtgaaagaggtttaaattgtgcttcttttgcctccggtattgtgccttctagttaaggagcgaaggagatacggaggcgggaagctgaaggtgtcgcggcggcattcgttcgtcgttcgtcctcgtgcaagcgtgtgcgtgcgtgtggcgcgcgcggggcggcacgagctcagcgcgagcgtgcacgggattggcgcgaggcagcaggagcttgctcggcttggctcagcctggcttggcctagccgtgtagaggaagaagaaagaaaagaaaaacagagaaagggaaggagagggagaagaacagagaagaaagaaaagaaaaaaaaacagaaaaggaaaacatggggaaaattaaaatagataggattggaattgatgtggaattagatgatccgatattcggaatagatttaaatcggattcaagggaattatttgagggatgatatgcactttgcgacaaaattaaacgagaaaagaacatcgaaaataaacatggaaaataatattttaaatgaactattaactcgacggttatatttttagagaatcaaagcaaactaaatcgattttaaatagttgtcaaattttagggcttttacatgtacccgcaccaaagcatctcccagataagctagccgtatattcagtataacaagaacataatgtaaagtaggtaatcatatacttagaaaatatttcaataccataaatgtatttagaagagtattctaataaaagtacaaagcttacaaaatagaagagaaaagttgctagagccatacccaaactcttccgaaggctttcggactccgatttctactctactcctattccaccagctagatactactaaactaagcttgagagaaatgagagagctattgcttgaggtggtgtgaagtgaagagagtgagctccttatatagaggtagttatgatggttgtggaaggggaattgtccaaagtgccctccaaccgtcattgggatgcaatcctggacgtccacgccaaaacctggatccaacggcgccaggattggtttggccgaacctggtggttcggcgaacctgggctggcccaatccagcccaatttcggctggtggcctcctctattgctctactccacggaattgtgaattttggcccaattcatcatgctagttctgagttcttggcccatctattcataagtctggttctcgacatcgtccgattgatttatcatctaagttgatgccgattctcctccactttattgtcattctctgcaaaagtttagtaaacctaataatagtagaaaattattactctaacatacttatgcattgcaagcataattattactctaacatacttatgcattgcaagcatcactagttctctcctattttggtaatattgatgttcgaaactgatcgataacgaccgtcaacagcgtcccagcagtcgaactaccccggtttttccccggttcttcattaaaccgtccggttcaactagtttactgccggtttgattgctcgccgatcttttagctgaaccggaccagccggcgccctggttccgatttttcccggtcgaaccgccggtctggtccggttctaataactatggttctattagcctaacacacaacaacagttcaactaaacagaaggttagatgttttccaattgttcttactttaatttgcatttcccaattctgaacctatatgcttattcacactgtctacataatttttcaggggctacatgatcatattgttaggatgaatgctaaggcggttgcaacacagtcaggtggttccgcaacagtcaacctgtaggcaattgtgccatattcccagggttctacatcagcttcaattcagatcatatctgggaaggcatctgtttcagtctcagctcaagaaccagcaaagaagaaaacatctactgggcctgctccatccaagaaggccaagactccaggatcaattctcatgctgccaccatgggaatctgacaaactttgaatcaatctgtgtgtattgctaagtattgacatgccttagctatttatcctatctgtgatgtaatgccattcatgccatatgtcatgtaatggttagaatgctgctatgccagacttgtaaggctgatgtgtgttgtgctgctatgcctgattatttgttcttttgctgaaatatctatgaaatgcctgaactgatttggcctatgtcatattgagctgaaatttgctgagttttgttgatttggcctatgtcattgagctgaaatttgctgagtttttttcaacaaaattggcacctgctatgttggtctgaaaatattgccttacaatgatgtcagattaattggttcattctacaattttatcatatgtggcctattgcacaattgatttgctcaaatttgtatcaaactaatcatttctttattacctacccattttcataatctaccatttcagagttcaaataacacacaaaatttgattcagaccatttcatcattcagctgcacaaatcctactcaaaattgcatcaccctattccatccattataccatttgttttcaacatccaactttccacaattcatccaacaaaaaccacaaacttagcacaattccattctagattccattacacaataccaaccaagttccattccataactgacaacattacattccactgcgactaaaaagatgccagattcatttcctacccatcaacatagcaaacacaacaacaaccagtcctaaatctaccaacaacatcacacatatctcaaactttaacctactattcctatccttcaacacccctaccacagcttccttctcaccaacaaccttcctcgatgtggccaactcattcctagctaaaaccagctctgattgcacacatcttccttcttcaacagcagccgaaaaatctcccttctccctcctcagcttccacacttcgtcgcgcaaatcgttcaacacttctctaacgaaactgttcgacggaccatcaacccaagcaaaataatcgcaacatccactctgcaacagtgaaccaatttaaccctagaactcagctcaacaaaatcatggaccccttgaaccctagaacttagctcaaaaaactcacccttgcattcacacatttgaagtaccggcacccgggattgtctgggatccacgaaatccacctcgccgccttgttgctgtacctgcataccaccgctggctcatactccaaagggccaacccgatacgggatgggggaggcagatgtgcgcctagaagacgccgacgagccctcactcctcgagctcgccattcaccgccactcatcgcgctagaaacttcgccgccgtcaaccgcgccgccactgtaaccccccgcgtcgtacccctctccgccgccgccacaacctactcgtagcaacaatggggaacgaacgagcgacagagataactctagaagagcccccgctatttattcccaactaccgtcgctgagtcagcgatgttgaccaagtcaagcagccacgtcagcgaaaactgcacgcaaaacagccatgggagtcagtttgctcgggatttcaaagtttaggggtcaagatatctggttttgcggtttagggtcacgatttagattcggatcacttttgagggtcacgaattgaacttattcctactagaaaatctgtgcgcctattatcacacccactatatagcctgtttatttgtttatccatgtgcctattagtttattgcatatactttcccaccatttagtacataggattccatatttaaaatatatttttgaccttcatgaggccaaacaaaaatgatcatccccttattttctctcaacttgggtgattgtatgattttgcagatattttctctgtagtaagtcgtgccatactccttgctcaatgatcaatttaagaagacatttgcttaacattctggatttctatattatgcaccccaagtccatcatggtcattttcaataaatctatgcatagtagtttgacacaacttcagatctacatcatgctagtcttgatgactgaatgttaaattataggggtttgaaattttatatttaatttaacacagaaaaatgattcatataaatgttattaacatatccatatatttgtgagcctaaaagtacctacctttgatcgagttgtgtcaaacaagacctaagtaaactctgtcgacgggggatacccgtagaccggatatagagggtattggggtccgttggtacgaggatctacgtagtacgacatcaagcaaacagaagacaaggattatactggttcaggccccttagtacttaggtagggaaaattgaaaccatgccattataattttgcaaaatttgagatatgccatcctgacccacatgtcattgactcatgtgggtcctacatgtcattgagataccgatggcatattcaaactttgcaaaattataatggcatggttccaattcaccctagtaggtaatagccctaatccagttggtatgggattatatgatggacaccacagattacaaaggaaataacagaactcgatgataccgacgagaccgtagttgagttggtccgactagatctcccgacgacttgactcctgtaggctccggctccgtaggctgtgatgggtgtgttggtggtgagattcgatgccttaggtcctgcctagggggtcccttatataccgcgggtcagttgatctccaagtaggactcggaaatatcggacccctcacgatatggtaaaaacccagcctcatccgagtaggactcgttccaaacgtagattctgcttctatcgcgggatagatttccttaatgtattcggaaactattcgtacacgcgcgggtataccgtatcggtacccattgtatatctgaggatagagggtataccttatccataaccctgacagtagcccccgacttctgcttaaatgaactcatgtagtcgatcatgactcccaatgtcggaattgttgtcgttctcatctggttgatctcggtgtaaaaaaccatagagacaaagagccatcgacaacatcgcatgaagtccaacggtcatgagtgaatttaaattgaagtctgaaaactaccgagcgcaacgaacccaaaaatttccgacggcaatctctctcctttccttggaatacgcactgtcggcagagcgcttattgaaaggaattttgggaatccatttgaagtccgtttgccataaaactcttctgccttctagcgcccttcgtcttctctgttccccgcaaagaaaaccctagcttgcttcttccctcttgtttctcggcgatcctccggcgacgatggaccttgagaagtctacctcaaccacagggagacaggaggtatagaacctgaacccatcatgtgccacatggttgtggtcgaagattacatttcttgcgattttcttcctccgccttcggaatttcttcttctcgtcttgaatttctatggcctttctttgcttcacttgaaccctaactccatcgcattccttagcatcttttctcatctttgcgatgcctacattggggtagagcccttccttgatctattccgcttttactatgagctgcgatggatggaacccaacagggtatctggatgcgttggattccgacttcaggatcgcctgaagtcgcgttacatccccttccaatgcccctcttctcgcagcaagtggcgggcgagatggttctatcttcagatcgaaaactccgatcccgtccttgttgtccctgaagaacagccagaccaaatcccagagtggactgccaaacccgccctgactccctccctccaatcttttatcgagatcgtcgatgatctccgaaatcgggggttgtcggggtatgaagtcgctgtcgacttcgtaggtaggcggattcaaccgctgtaggcccgcgcccatccggcctttgattactctgggccagaggacacgacccgggtctctcctcgggatattttttttcttgcatgtcacatcctgatttttgtttcaggatttataaatcatttaataaattattattagaatttatattaaatgttctttaatttacaagtgaagttaaatgtgggaaataaaatttcccaaatataaagcatggatggatttaatttttattaaattctccatgattaagtcaactctctgaaatattctcggatttttcagagctcaattcctaaatgatacaaagaacagttcagtaattatttgatcattaatgatctaattataattgttaagagcttttcttgtttaaaaatccttaaattataaattgttggttaaaaggaattattagaaatgatcttaaaagcctaaaagagaagatctaattttaatttgctaaatctcaatataaaattgggctagataaaattttgttaaatacttctcttgaatctttagttcctagatttttctgggatttatttgagccaaggaagtatttttaataaatggaattgcatttcatgaataatttaaatagaaaaaggttttaaaatcctccttttggctttgggccgaaagtcagcccaagtctctctttccttctccctctctcctccccggcccagtcggcccagtccgccgctctcctctctctctctgtcgctgacaggtgggtcccgcctgtcggagtcgtcgtcttcctccggccgccgccgcccgaaccctagcgccgcgccgccgtcgtctccttccaaattcggccgcgcctttccttctccggtgaaatctttagaggggaaatgatctccgggatctcctctaccttttctcttttggaatcgtcggctaatttcctttggaaataggcggattcgagtttgattcggattcgtgtttccccaatctttccttccgacgccggccgccgtgggccttcgccgccgcctccttgcccctataaaaggacccccggtgtctcctctacccgccgccaccctcgccttcgtctctcggccgtctgttttggataggatcgatctcggccgttcgttctcgtgaaccgccgccgtgcacccggtccaccgcaaaccctaggcgatgacgcaataattcccttttccttctcaaaaataattcattattgcgtcataattcaattaaaatccatataagtgttttaatcctatttaatctttaaaaattcataactaattctttgtaactcagtttaatgtggttcaagttgcaaaagttgtataaaataaagatctacatattaaaattatccataaattgaattaaatttatttaattctttttaaatgggctttaattagatttaatcttgtaaaattcataataaattcatatgaagtcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcccacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctatatatattggttcagctagatattagatatgattgcttagccatgcttagaaacattagcacactattgggattacttatgactcattattatttaatgatggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaatcgtgccaaccacaagccagcgtgggcaacggctttaccttttgtatagcatggttcattgcggagcaccagactgagaagtggtggagataagcccacgggggtcgctggggagtccatgccttgtttataagggggtgactatgatccgggaacggtgcactgtggtgggttgtgttatgcaaggggtaatgtcacagctcctttccgaggtaccgtggtggtaccgaggcacatggtgacatgttgtggggctgtgtcttgtgggtacagtggtacacctctggccagagtaaaactattcgaatagccgtgcccgcggttatgggcaggttgagcaatgtttttcgtgattagtcccacacctctcacaataattatggatgttatatctggtaataatttgcttagctcctggtttggagttagatctgtacagccgggtatggttgttcaggatggttgggcctgtgcagcatgggtgtgttgttcagtgttgattaaaatttctgattaattactccactgttttacttctcttaaatgttttgctaaaagctgcttttgcaaatgagcctatattatgccatcctttggtatccttgtgcacttgcatatttgctgtgtggcttgctgagtatgtcatatgctcaccttgcaataatcaatcaacctcagttaaagaaaaaggatccagaaggagaagacatttggcttataccccagttgagctgcctgtgggagtggagccggagcttcgctagattttattttccgctgcagttttcttcttggtgaggacttagtgcctcttaagtaagtatttattgttttagttaatttgatgaatctgtatattaaattgtcagtttgtgtacctcggctgattcctggacgaggattttatgcacaaataagttcggaaattactagtgaattttcgggcgtgacattgcatttctaatcttgttccgagtgcatctgtttctcctgacttatcgagttctcattttcgattcacaggtctagacagtgacaccgtggggtgccgcgtcagtcaggtgatgatcagcgccccctcagcagggagcgacatcccgatccccctttgcgaaaagggcccagccgaacgcgccgctgcgatcaatgtgagtgtactcgatgattcctttacatctttctccttgagatcacgtcgtgacttcacattgtgcaggctctccctttacggacgtcatcgggccactagtggaccaccaggcggcggtgtcattgaagaagggcgtcgccaaggaggcgtccgacgctgctgctgctaccacgagtggcagcaatgttccgaagaaggggaggaaattctcctccgtacttgggacccgtcggaagatgccaaactctgctgtaagcttctctatcgttccctagtgcgtagtcggaacaatttgatctcataccatttcatcttactcaggactcggacgcgtctcctccgcctcaccgaaggcaaaggttggtgactatcggcgagaagtaagtaaacgttcttgagatcttgttattttccaaattccgatcacctcgcctcatggggaagagaaaaaactttgcagggcggcatgggcaaaggcggcgcaaggcgggactgatgccgcttccagcgcgtcccctacggcgacctcgacaggagtcgtggtcgctactatggaccaggaggtggcaccgagcggccctgccgtcagcctcgtgcctacccggggtccgtccaccgatgccctcacctgggggggagctccaagcagagatggagcgcatcctctaggccggtactcgcggcgtaggtcgcgagatcgaggaggctagggcggcggcggcgtcggcaaaccagcgtgccgaccagctagtgcgcgacctggcggaggcccgtgaggacctcctaaagatgagggagctggtggccggcaacgagatgcagcggcgcggactcgagcaccggatattggagctcgagggccatatgattgacatccgcggttcgctgcgaacatcgttcaccagcctgcaccaactcgccggggagtgtggtgtcacgactaccatcccggcgcaccccgatgagttctcgctgacgtcatcgcttgtggaactggctacggtgatggaggagatcccctccaagcatgcggctaggatcggcgaggagacgtccaacggcatctacaccggggcatgccatgtccttgcgtgcatgaggctggcacatcccgatctggaccttaacaaggctttggatcagggggccaccgatgacgcgcgcaaggctacgatggaagaagtcagtgacttgggggagtttgtcctccccctttttgaagagtaggatatttgttttcccttgtactccttaaccttcatgctataaaacttattgtggatccaaactgctctcctccgaacagttgtttcccttgtttccttagcatgtgattccgagtactttgttgttgttgtagagatgttgatatcgaggatgtccagcagcgcgggcagcccgacataccggtgattgttcaggcgcttacgctcaagccgttcgtgcagtgggaggaaactagtcaaagcccatccgcggaagtgaacatggcgatgacgtcgctaggtttgtatcttgcacttcttcactccttgtgttcggattgacttgattagctgtgttctcggaggagaagaatagcttgacttagtcttttcccatagtcttttccctgtcgggcagatttcgagaacatgttggctgaccgagatcgtcgaatccaatattggaggacgaaactcgaggtggccgaactcaaaaaaaccatggtggaggtgaagaaggaccaggccgtggaagctcttcgaggtcgcaaggtgtggttcaactcgtacctcaagagctgctgcgcggtgatggtgagggtttgcaaggagctatgatcccgaggagatcccaagaagtcggcggccagttatatctcgtggttgaatggagccagtgcacaacttgaagggattggccagcacatcgacgatgccttgaaggaggagtgtcgtcgggcgagccgctacgccggaggtcatgtgctggcctgcatccgagatcaccgtccgcagctgcaactcgagttccttcgtgaggggttctcgcgttcccggaggacacccgcggagatcgacggtcttgcacagtcaatggcgctgcttgccgagaaggttttccgctccatggattggtgttggccgtcctggtagtttttgtatcctgtagaaaaatatctcaaggaagcatgtaatatactttgaagtatttatgacttgtaagaaatacttgtaaaatagaaaagggatctatctaactaagttttcttactctgggtatgttgcgtatgagtgttttctcactttgcgacttcgatcagtcacttgagctatacactctccctagccccagccttgtcatcggagaatcgttctcggaggataaggctcttagatccttgacctgccttggttgaaaaaagcattgaccctagctcccagccgtgaagttggaaaactcaatttccgattacacggcttggttaatacgcacggcctgaactcttacatgaccagatcttacatggtcatttgtctctacatgatctgacaaggccttatccgctctgggcgtccccagccgaagttcccttagattcctcagaggctttgccaggacggcgtaaagggacatgaggataggttttaactctaggtgtcgtcgtggtaacggatcgtcgggaaggaacactctgacaatattctttacctgaaatcaactttattgaaatcgtgagatgccttacaaatttggagactattgatttatacataaaatttacgtaattgatcaatgttccaggaatttgctaactcgcgaccatcgtcgtctgcaatcttgaatgcacatggccacaagacttgcgtgatcgtgtatggtccttcccacttgggtgagagcttattacgccctgcttgactttgaacccatcggaggacgtaatcgccgatcgaaagtgtgagtgctctgatgcgcttctcgtggtatcggcgaagggcctgctggtagctggctgctctgacggtaactctttctcgatgttcctcgagtagattcacatcgtcacttcgctgctcctcctgttccttgtcggagtacttctgtactcgtgtgctttgatgttgtagctccgtggggagcatagcctctgagccatacacgaggaagaagggtgtctccttattggatgttgtcggtgtggtacgcacggcccatagaacagaggggagttcttcgacccacttcttatcgtgtgacatgagtctgtcgtagacgcgggtcttgatcccttgtagtactatgccgtttgccctttcgacctgtccattgctctgagggtaagaaaccgaggcaaagcaaatcttgactcccaatccaatgcagtaatccaggaagtcggcactgataaactgggagtcgttgtctgttatgatgcggtgaggcaatccatatctgcagaatatccctttgataaacttgatggcattgtcggccttgatttcccccgtgggtgtcgcttcaatccacttggtgaacttgtcgaccatgatgaataggaacttgtagccgttgtcctcatgggaatggaccgagtatgtcgagcccccagcacgagaacgaccaagcaagagggatagtctggagtgcttgcgctggtagttgtcacgcccggaatttctatccaaaattccagacgcttacatgtgtgtgaaccctcgtccaggaatcagccgaggcacacaataacaaattgataatagagtacaattattactctaattaataagcgaataaaatgtcattacagaggtagatagttcctcttaatcaataaagatctaagtagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgttatacaacataccctgttgtataggcccaaccattctgaacaaccatcctggctgcacagttctatctccaaaccaggaatataccattccaaaccaggagctaat

SEQ ID NO: 59670 - DNA, 1005 bp, Oryza sativa
  unsure (1)..(1005): unsure at all n locations
cctggtacctgggttgctactaggcaccagacactggtaccaatatttgtgagggctgatactggtgcctgggtttagacatgatacctaggacaagtctggtacctagtaccagttactgccaggtactagacttggtacctggtacctggtacttggggttacaggcctggtacctgggttgctgccaaacactgataggcatcagacactgtatcagggtggcatatctatgtggagtaaaaaaaaatgtgtcacagaacattgcatccacacaaaccaagtatctttgaaatgaacacataaaagtgcatgattttataactgcgacagctgctgtcattacatcatgaagatttttcacattactgttaaaaaacaaaaacacaaaaaaagctatcaccacatggtcgcccccctaggtgcagtgaacaaaagcgtcaaatacgtgcttttgacaacgctggtactacatagttaactatagtggactntacatagttaaaaagcaaccatcgctcattttgcacgatgtggatgtaggtcattgaagcgatgctatatcaacctgtgacatagctgcttgcgataggttggaatgcctttctgaggaaaaaaggaaacaatatgagaatccaatgaggtttatctctgtatgaataaaaaaacccaaaaacagaaaaaaaaatggatttaggtaccaagaccacttacagaagtgtatccaacaagacttcggccattgtgacactcgagcattctcagaacgcagaacccgcaatcatgactaggtagagaaaataaaaaaaatgtaaaacttataaatgtgtacaggaaaaactatggtgtaagttagttaaatagaacaaaattgttgatacttacagttctacttggtaaggggtttcagggtactcgactgtggataagtcaccaaatccaaatgggctactattcgttcccgtgtcaagagcaacttggaggttgctacactgtaagaaaaaa

SEQ ID NO: 59671 - DNA, 611 bp, Oryza sativa
atcagggggctgctaactacgcgcgtaagggcgtgatggaagaagacggtgacttggggagtctgtctccccctttttgaagagtaggatttcagcctccttgtactccttaatcaattgcgcttgtaaaactttcgtaggttcaaactgcttttgtgtatgcagtcatcaccttcgttttctttagcatgttgattttgagtactttgttgtcgtcgtagagatgtcgacgtcgaggatgtccagcagcgcgggcagcctgagtcgccggtagtcgtttcggcacttgcgctcgagccatatgtgctgcaggactacgtagatcagaacttgtccatggaagcgagcatggcgacgacttccttaggtttgttctttggtcttcatctcctttgctctttttgttcggatcgacttaatttgccgtgttctcggaagaggggcacgacttgacttagtcatttccctgttgagcagacctcgagagtgcgttggccgaccgagatcgtcggatccaatattggaggacaaagttcgaggtggctgaactcgagaggactatggtagaagttaagaaggaccgagccgtagaagcactccgaggtcgcgag

SEQ ID NO: 59672 - DNA, 2860 bp, Oryza sativa
ggactaaagatcatctttagccccggtttttattgcatccgggactattgtggaaatcggccgaccgacgaaagatggtttctccaccagtgttacttcctctaattaacgtgtcagcggtctaggtcacgtaagagatttctaatataatgtatgcgtttgttcggagaacaaagggagtttgtttgtttcgttttccacacgcacgtttcccaaactactaaacgatgcgtttttttaaaaaaaatatatatgaaagttgctttaaaaaatcatattaatctatttttaaagtctaaaataattaatactcaattaataatacgctaatagcccacctcgttttgcgtatctttccaatcttctctatctccttctcctcaaagtctcaaacacagctacacaagatttctctggtatactgtactctaacatacgtgtgtacaaacatgtcagcttcacaaaatcggagagagagagagagatcgacgtcgacgtcgctgcgaggctagtgcgtgctgtgccccgcaagctccggtacgtacttcggtacttactctatatctacacacgtacgtgtgctatagctagcagctgagcttgcgcgagctgcagggaattggttaatggcgtcgccgccgcgggaggaggccatggatcagaaggcgaaggaggcggcgccggcggcgagggggcacccggcgctgcggggcccggcgaggcgggagcggtacacgcacgggctcggggcggcgcagatgggggcgctcagggccatgtgcggcgcgctcatcccggcgctgccggcggaggaggacgacggcgcccgcggcggcggcgacatggacgtcgagcggttctacctcgccaccgccgccgagtgcaccgtccccgacgaggtgagcgcatgcgtcgtcatcgatcaggggcgacgacgcatatggtattgatttgatcgagatgattgcgtcgcgactgatcagcgctgtcagagaccataatcaactaatcaacctgatgactcaatgcttgtccctccatgagtacattgtaaaacttttgaaagcttcaatatatggccacttattattttgttaaaaaatactttttgccagtggcgagttgattagtgtttttagaactagggggccaagccccccattgtcattactaaaaatgaaaataaactacagcaagtcttaaaaaaaaaagagagatagctatcgatagaaagaccaggtcctagccgataccacaaaagaaacatccaccctgcccattaagactaacaggaaactaacacagctcgacccaagccctgataagctgtagcaatctaacagaaattccatctgtcttcacccaagctactccaattcttcgagttgattagttggcatttgatcagtcagttaactgaaacattagatgcagtgcatttttatcatgatctaatcttcgtagacgtagttttctcgtgctaattatgatagctacactaaccaactaaccacttttgcccccttctttcgaaaaaagaaacttcggacaataggcccgaaattattattattattattattattattattttttgcacatttcagtcccaactattcaagtcaactctcgaacaattgtcttttaataactactgaaaaatctctgattcttctaactatttcagataactttgataaacaccaagttgtgtttaatttaacatttttttttctctttgtctctaatctcttgcaagaaaaggttgctgagctgaccatgacacggtgcatctgggaggcaggggtgctggtgaggatcatcctgtggatctggccacgaggggtcggcacgctggcgctgtgcggcccgctgtgcgtcttcggtgaattcccctacgtgcgccggttcgccgacaagccggtggagcggcgggagggtgcccttgaacgctcaagaacatttttgcgcttataatgtcctttgccacttcgtcttctacaccgtggtaatgttaattctaacgaaaatggttttttttattacgcgtaagacatataaaacatgaacgggtgatatatccctaccttaactagtaattttttattgacagctcactcacgtatattcatcgattaccctaacgggtggagtcgagtcatacaccaacgaggccacaactccaccaccttacaactagtcgtactttccgaatttgtttcgatttgaactttgcatagtaaaaaaaaaggatattgctaaaaaaagtttgggtaaaaaaaactttcaaatataagcatgtagtgcaactatatgtaatcactctttaacttaaatagtaatctctatgattcaagctacatatatttttttaatacttatacagaaattacataaaattacaatgtaattaaaatatacttacggtataattatattacaatacagttacatttgaaagtttttacataataaacttgtggagtttttcttagatagcccctaaaaaatctactcctggtttggtaggttccaagtgttaatatatcatatagtaagtttagactgtgaagtacttccatcccataataattgcattattaagaatccgtcttaggcacgtacatcggtgttattagtggtctctctctattgccatgcaagtaaatttgatgacatggaagaaagagaaatgtgtatggttgttatgcatgacaacagctcagagtcgactcttagtatttattagagcaaattttgttgcatggtggtgaaagaaaggaaagaaaagtaagaaaaagtattttgatacattaatgattagagaccatattgtctctaactgttataggatgctagt

SEQ ID NO: 59673 - DNA, 1734 bp, Oryza sativa
tacggtatctacggatactgtcaggagagacatagcgctgtctttgatctcgccggatgcagattcgaggagaaagactaccttgttgtcgactacgagtcacacttcagaccgccaaatcaacaacagttagataggctaccccaaatattgtactggtgtgattatggtgaataagagcaacgaccggcttcggccaacaggagtagggttattacctgacaattcagggggcccaaacctgtataaaaatcctcgtccacatctcttttattataatctcgcatatatcctagtaccaacgatccctatactatgtaaatgaaattgcgacatcaaacgtcggcaatatgaatcgaaaaaaaaaaggagggtttggcttacttatctggactgtttaattagctcttgcgttgagatatatgatatcatgatcgaacaagagaggcggggctagctgtaggcatgtatggatgcacgttatctatggtactgttacttgatatgtaagtctcacttgcactctctctctttcgactgcatgtaccaagatgcatgcattccccttcatgagttgatcatatcaaaatttggtcctgccaaatgattgttactgttcagtagttagctgttgatttagctggaattggagcttatgtacgtcgaattgaatgtgaagaggcggccggcgtcgcgtgtgtatatatgctcactgctcaacaccgtctcttttaatttcgttctgctgtactagagttatgagagactgtacaccgtactcatacataggctgtgtttagttcacgtcaaaattagaagtttagttataattgaaatgatgtgacggaaaagttagaagtttgtgggtaggaaagttttgatgtgacaaaaaagttataagtttaaaaaaaagtttgaaactaaacacagtcatattcccgtaatgggcagcaatgatgggcgtggccgtatttggttatgaggttgatcagtaatcaggcttaagacaaaattgtcattaaaattttttttgtcagcattcgaatattttggagtaatcacgagacagagcatcaccgggttcgatcttcacgtacctaaattgcaacaaggaaactttgaaaaagacgtgccatcaacaatcccatagccccatactctcgattcatagcccccacaacccactccatcttcttcctctcgtcgctgccccatgccgtcttctcccggtttgtgatagctcatgccgtgtttttttcattgagttgaaacttatcttccgcgcacttaaaatagagcgactcactgacacatatgattgattaagtattatctggagtaacttttttaaaaaataaaataaattaatgtgatttttagagcaactttcttatataaaaatttcttataaaaaacaccatgcttaatagtttagaaagcatgtatgaagtttagacaagtgagaaaaaaaaccacatccgtcaccatctaaccagttctttcttttattacttatttctgccatcaccaaggccgtgtttagtttcctccatattctcaatttttcatcacatcatatcatatcaaaaacttttctacacacataaacttttaactttttttccaaacttccaactttctttcaaactttcaacttttttcaggatctaaacacggacttttaggtacattctactgctagtatatactactagtatatttgatctaatggtg

SEQ ID NO: 59674 - DNA, 756 bp, Oryza sativa
actttattatattggttacaatagatattagaaataattggttagccctgcttagaaccattagcacactattgggataactcatgattcactattatttcgtgatggcttattgatagttcacgatggtcaatcgtgattagttaattaataaatgtgccaactataacctgataatggtgggttgtgagcacatggttttgatggtcgtgctcatgacaattaaggaccggttcacgagtttcggttgtgaaacattaatcgtgccaaccacaagccagcatgggcaacggctttatcttttgtatagcatagttcattgcggggccccagactgagaagtggcggagataagcccacgggggtcgctggggagtccatgccttgtttataaggggtgattatgatctaggaaggtgcactgcagtggattgtgttgtatgcggggtattgtcacaactcctttccgaggtatcgtggtggtattgaggcacatggtgacatgatgtggggttgtgtcttgtgggtacagtggtacacctctgatcagagtaaaactattcgaatagccgtgcccgcggttatgggcgggtctaacaatgtctttcatgattagtttcacacttctcaccatagtaaatgatgctttaactggtaataattagattagctcctggtttggaatggtatattcctggtttggagatagaaccgagccgccgggatggttgttcagaatggttgggcctatcaagg

SEQ ID NO: 59675 - DNA, 773 bp, Oryza sativa
gcagccctttgggccgaaagtcggcccaaaaccgctctctctctctccctcggcccaagccggcccagtccgggcgcgggcgcgccctcgctgccgctgacaggtggggcccacctgtcaggcccgtcgtcttcctccggccgaaaccctagcgcgccgccgccgccgccgctttccaatccggccgttcctttccttctccggtcgaattgattgaggggaaacaatctccgggatctcctctaccttttctcctttggaatctttggctaaatcgttttggaaagcgttggattcgagtttgtctcggattcattcttcccgatctttccttcctcgtcgtcggccgccgtgggcctttgccgccgcctccgagcccctttaaaagcctccccggtgtctcctctacccgccgccacccttgccttcgcctctcgtcgtctgaatcgttctagcgccgtgtgccctagctttgccgtcgccgccgccgctccagccgtgcgccgccgttgtttcagccatcgccgtcgctcgggaagaccgccgtcgtggtcgccaagtcgtcgccgtcctcgtccgccccttcgctgtcgccggagatcgccggagcttcatcgccgccgtcgacccgaaagtttcctccgtttcctcctagtcgccgtcgccgtccgttgatcttccgccgccgttttggtcaccggtgagttcgcccggtcgtcctctacgtgctggtgggcttcgtttgcgtcctaatgccgccgttcgccggcgag

SEQ ID NO: 59676 - DNA, 736 bp, Oryza sativa
tgttatcccatcctcagtcatgcctacctgacatacatgcaagtcactgaggagcaggaagcaacgaggagtcggggtgacgtcatcatgcatgcatgttaactttttaagcgaactttaaaccgatttttctcttaaattacttatccaaatcatgattcaattgcaccattaaattcgttgcaatcaaatcttcaaaacaagaccacacatggatatattccgacgaaaaaaattaatttattattgaatttttttaaaatgttgtacgatgttccaccagatatatcggaatggtttcactaagtagatcgaaaatatttcactcgtttaaattggatgttgtttcaacttatataaaaacaatgtttcagcaaatagcgaaagaatgtttcagttcactgcaacattagatctatacatagtgaaacattgtgagtacactaggttaaacatttttcggtggaacaaaaaaaaataaaccaaattcccttaataggagatgtccaaaatatgtgggctttttgttgcaatggaatgtttcgttcagtgcaacattagatctatacatagtgaaacattatgagtacactatgtgaaacatttttggtggaacaaaatataaaacggatttccttaatagaagatttccataatatgcgcgtgatttgttgcaagggcgtcttctataatatcaaaatctattgcaacatttgatccgtacacagtgaaacat

SEQ ID NO: 59677 - DNA, 620 bp, Oryza sativa
ctctccgtgggatgtccaacaattatagcttggcatgaaccccgactcaaacaagtggaaatgaatagtccgggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgcacacaaataattattcttacaataatgacagtcatacaataattataagatatctttattcatacaaaaatcataaaatattacaccaaataattcttaaaaactatttgtaaagttttaaactaattttaatgtgttttacttcttttatttttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaaagtgtgcaaaacataggtgcaaatgtagtatgacaaaaaaaaacattgg

SEQ ID NO: 59678 - DNA, 680 bp, Oryza sativa
  unsure (1)..(680): unsure at all n locations
tgtactgacagcatcggtgttattaggcaaacggagaaacaacaaaaatcagaacagaatgctgctaggaaaccttagatctcaagaactaattttttggaaaaagggccaagaatttttttaaaggggggaaaaaaaattttnttttttnttncnancatagttntaatttttggaaatacgttgtcgcggcaacaaacaatttcagcgattccaacattcttggaaaaggaggtttcggtaaggtttataaggtaaacaattcaggctgacaatcacaaacactggagaatcctacaatattttataaatttaaaatgattgtattacacaggggaaattggaaggcgggagagaagttgctgtcaaaaggctcaacacaggttgcacacaagggatagagcattttacaaatgaagttgttcttattgacaaattntngnncnaaggcaccanaaaaattctaaagttaggcttcttggctgctgtattcatggagatgaaaagcttcttatttttgaatatttacgcaacaaaagcttggattactttctttttggtacgcctaatcatatattcattttccctttatcacttttggtgggagaggtgcctgaacaactttaagtcttgtttcacactgttcatggtagatgattcaaaaaagcctatactgaggg

SEQ ID NO: 59679 - DNA, 7114 bp, Oryza sativa
tgctgcccaatgtgttccttgttaaatggccagtgatgaattgctcaataagaacaaattatctacacttgttttttttttatgcacaagaacagattttctgcacttgctcttttttctggattgataagagagactatatacacttgttttctgtcattctttgatgatttatatacccttgctgctgctgcccaatgtgttccttattaaatggccagtgatgaattgctcaataagaacagattatctacacttgttcatttttttgcccctacacttgttcatttatataccactgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctctttttttatgcataagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatacctctacacttgttctttttttatgcataagaacagattttctgcacttgctcttttgatgttatgattttctctttttatcccttcatgcaaatgattgtaattgatgcatatttctcagcaaaactgaggccatatctttcatagtataccccgtattacattggatctaatgctatttagtctaatggtaggaaatttataatctttttcgtgaaagttaaaccatgtcaacgcccggcgcaaacccgccctccccaacacctgcgaggatccaggaagaagcaaacccagccacagaggcagttgccgaaggtcatcccgcgacaacggcggtccaacaacccgaaattcatggtaatttataggataaattttcaccacataaccacataaattttagctagcaccccttagcaaatattgccttctgtttgtgctgcagaattgccgcaggaacaacatacgtcgatgtcgggcgagacaagtgcaagtaggtctagtagaaatccgcggtcacaaaatatatggccgaccacagtgcaagttataagagaggttgacgctagtggtaggcccacggcgcccaggaatgtcattggaagatggtctaactgctgcgggatagcggcacgtgagaacttcgggatcctccataaagatatcgggaaggtcacagaagccgagaaagagcgagcttggacggcaatggagaaatggttcacatttccagccgaagcaaaggataggctcaagcggaaggcattccaaaagatgggcaaagcttggaagaattggaagtcgaagctcttcaccgagtatgtcaacccgcccggcaatcatacgccgttcgatgaataccctcaaataactgaagcggtgtgggaggaattctgctctctcaagaccacccaagagtttagggaatccagcgaggcacatcgcgtactgcaacagcggaatgagcacccgcatcggctgggcaccgcagggtacatcggcaaggaggcaatatgggcccaagaagatgcagccgctgcagcagcgaatgtacctgccccgttttcagacatccctgaacaaagagctcgcaactgggcgcgggcaaggggtaaggtcaacccggacggctctgtcacatttgagaacaaaagtgatgccgtcgtctatcaggaactggtgagttcactacttaacctaactaatttccgttcgtataaagtacaagttcgtataaacgactatcttcttttctagttgggcttggttgctgaacaagcttcacaaagcgaggttgagtccgcgccgaagaggcgcgaagatgacatcctcacaaaggcgctcggaaccaaagaacatcctggccgaactcggggaattggtagcgatgtgccctggaagcatggactccctcagtacagctcccaatacaggaaacggaaagtctccaaggaagagagggacgctcgtttgaaggccgaacttaaggttgaggtcattcaagaactagaagctagcatgaatgcaagggtggaagaaagggttaacaaggtgctcgccgacatgaatataccccgagtcacaacacctgctgtgcaaccaactcctcgtgtacaacacgacgcgagtccgtcacagcataggagtagttgtgcatccacagaggtgccggcccctggtctcccgatcgcaccactagctgcagtggaccacatcgaggtaattattgttatccgatccatatctaataaaagacatttacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacattcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagagccagaagcgtgaacgaggcaaggggaaggtcggggagttggcgccggagccaaaaaggggcaagctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagttggacatcacgaccaccagccgttcctatcgtcgcctgcctatataactataggctttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacaacagagctccactgaggtggttgactatgtcaaccggtgtttatgggcccatcaagacaaggagtacatcatgtgcgcacacaaccaagagtaagaggacaatacccttcgtgtatattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattgctattcaaaacgtgctaattaacctcttatttattaaacagaaaggtagagctggcttcaagatctcacccatcaaccccccgctatcagagacgaattgtgtgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtacgtctcatctgttttctccttttttttttccttattgacaggttgtgcaggtcgatgacatcatggctttaatccatttggtaagtatatatgcggttctatgagcaacgaccgaaattgtggctttcaaggggtgtgaatttgctgtgcaaaattgtggcatttgaactgcatatatgtgttgttggggatctgtgatgttatattgggggggtgatgtatctgtgatggatctgtgactggaatatatctgtgatgtttctatttttcagagggcatggctagcaaatcctgaggctagccaatatttagcatttattttttttctggaattaactcatcagtgacgggtcagaacaaaaatccgtcaaaggtaacataacctgtgacggactagcaaataaaggcccgtcagaggtgacctacctgtgacgggcctttacttttggggccgtcacaggtagatcacctgtgacagcttctaactacggagacctcaacctctgacggcctttatttaaagggccgtcagagatgagtcacctgtgacgggtcctaactcgctcaaggctagcggagaccaacacctctgacggccttctagtaacttgcccgtcagaggtgggtgtcacctgtgacggccggccacccgtcaaaggtgactggactcaccagtgaccactgatcactgaccatgcgcgaagccgtcaaagatgagggtttgggcccgtcacaggtgaccttggccagtgtagtgtgacaatgaaagacatttggcgtgaacaaacaaacagaagggcccaataaataatcactctgtctgtaaatgagagaagaacaaccaaagaaacacagtacagggttgcggcatagttaccttaagacggcggcatattcagaaatcactgtaatagacttctagagcatatattgtctgtcccgagaacaatgtccctcggttgataaaaacaactgacaattcaaaaacatacacagctagcaagggatctattaatctccgttaacaaaagtatttgttcattaagcagaactcaaataaggcatcgctggtacactgcacactagcttggcatgcaagagaactgaactaattgcaaaatcaagagatagcacataagatcaaaataccggagagaagataaatattatttgcatgcttgtattcctaggtcatcaaatatactgctgaagcaaatgcaaatgaagtcatacattactagatatatgaaaggaataattattacagggcttttggatgtttcatacctttgattcttcaaccgcttgttgcggtacaaatctcttttcatctaatacaactctagggatgtgagaaaacaagtgtgaaaacagggcataaataagtgtaagactacatatagcaaacaaattacaaattaatagatctttgaccatacgtggttcagccaataaccatgcacaaatcacacatgtccagaccatagaatgcagatcaaacatggaaagcctgaagaagaggattggttttcaaaaagaaaaaaaaaagaaagcctgaaagaggggatttactgacaggaatagaaaaattactccgtggtgatgggcattttgcccgctgctcagcgacggaggtgctgctttagtgccggccatagagggttaacgctgctatgggatcgggggacggtggctgccagccttagcccctaagcccgacggcggaggggctgcgacacggcccggtaaaggcagtgctgcacctgccggcagaggaggcgttgtgcaatgcggaggcgagcggcggcggcggcagcgggagaagcgtcggaggctgcgacctgcgagggtggtggaggcggcaaatgtgaagaggaaggaggacgggcggtggaggcggcgatggaggggcacgagcgtcggagacgtgggaagcgattggaggtaacggcagaatacaatcgaccgtctgctagggctagcaaacaaaaaattacgattatacccctccgcacattattttatatggacaataatgcccctacacatttctactcccatcaagtatggtggtagtagaaataaatctcaatccttcgatcaaatatgatccgcggttcagattaatttatactgcaagtagagtgtgccggagtggagctcatatatatatatatatacacacacacagagacacgatgatgagaaaacaagtaacaaaagaatgatgtttgcatattttttaaaaaatataataaatggtcaaacgttacaacactatatatacacatttgaaaatggaggttgtattttacaacgacttcacaaaaaattgacaagcgcagcagtatcatcacagaagcggccagcagcttcgagcgttagctggtcttcttcttcggtggcacgcggcagctgtggaatttcctccagggccgccatctccgcgagctccgacgcctcggcggcgtcgcgctgctgcagcagacgctcatagtctgcctccatcgcctccatggccgcctccagagccgcctccgccccctgcccatggccgaggagctcgaccaggcgcgccacggaagcggcgtgctccatggcgccgccgccaccggcgacgacggcgagccgccgcagcgttcgccggacgccggcgcgcgcctactcgaacctgccgctcgccgcgccgaggtccatgccgaggtcgcggatgcggcgcgcgacggacagccgcctggacgtggcgtcgcgcagccgctccacgtgcgccgcccgccgctcccggatcgcgtggcgcgcc

SEQ ID NO: 59680 - DNA, 2250 bp, Oryza sativa
agtggaaccgattgttgaaatacctttgtcacaaaacaatttgcttgatgtttcttgtgataaagaaaagttgtgcgatgcttcacttatatccatgcaacaactagtgaatgaacatgttagttctatagtagagccactatgtgttgagtttaaacatgttattcacattgctagcgagaatgaagagcctaaattgcaatcttctttaaatacttggggttatattcaatttgatgatctttgtccactcaactgcttagagaagaaattatttgatagagttgaattgccatgcccttctgatgtgatttttcatattattggtaattatgatagtaaaggagaatataatgtgcatcgagtatatatttgttcgaatttgactatacctcattttcatgataaaatgtattgtcgagaggaccgcgtgcatacaagtaattctctatctagttcctctagttgtttaaatgagttaagggttggtttgcaaaaaggggagtgttgtggtttttcgactacaaagattttaggatccaatcatatggccatcaagaaatgttccgcacaggatgttatgatagacaaagataagtacaatacactccatgacaaggtgaaaccgaggacggtttccaatcaagaagggaaggatgatgaggacataactagctctgatataaccatgactaccttatgtattaatcaaataaaggtgcatatgttctacattagatttacttgttatatatttgaacaaacgttgctacacaatgagtttcgtgtgttttcatttgcagaggtagttgcttgggcgaaagaaaagagaccgagcgtaactaataaatggatgattgaagaagttgattagggaccaaaccaagacctctccaagtctacttctacctcaccacgtcacttttggtccatagaagacaagagataaagttctacatattttggattcgaattcgggcctcctgatagcatcaacttcaaatggacctagccgctgatctagaaggaatttcgggacccatgagtacttgttggaaagcttatggagtctaccttcagatggttttggtcccacatcaaaattcctaccgagctgccgggaatctgcaaaacaagccacgtatctcatccagtccgaatctgactcgggttttgggccttttaattgtatcgtgggcttagcccaagggggtgtgcgccctagggaaaccctaggacgtccctaatcatattaattcagtagccgtcatcgtttagagttgggttttgcttagattattctgtcaagaacagtttcgctgctagatcggtttgtggaaccccaaattcgagtgcttaatcattcatatgcaatttggttgcaatctatcttgttcttgcttgtgttcttcgattcgcatgcagggattagccttctcggcgaggtcaaccgggtttcggcacgattgataaccagaggagacgtggtgctgcgattgcggggctcagtagcgtgtttgttcagaagccggatcgagttgtgtcgcgactccgcccaaatcgttgtttatcaatacctatcggaagatcgggacctaatatccctcatcagttggtatcagagcgtggttgcccgttaggtaatttatcttcccataaccagaaaattgccacacaaaaatatttattctttacctagacaatttgagccgttgcattgttctattagattttactttgttgaattctaggttgcatcgtcgtgtcgagtgctggtttagttttagatttaatttttagttttgagtattgcatctgttcatcacttaggtctagggtacatcactcaagtgtgtgagttgtacgtcagttttgggtccagtttttcatctcgtcagttgttgccgggaccttgaaaaattgaatcatctcgtcgtcgggtttccgtttttgtattttggagaaatttttatccaacggtttgggagttactcgatttctagagctcctatgttgcattgtgcgcgcgcgtgaggggagtactctgtgcgtctaaggagagactccggatcagatcagatctatctgtgactatccgtattttcctttatagaattgttaagtagcggatttgagatatttgtataaaaatggaacctacatgatatgagcaatccatttttgagatgatccaattttagttttgcactttgcgtttgagtccctatatattcatatttacatttgagt

SEQ ID NO: 59681 - DNA, 22679 bp, Oryza sativa
  unsure (1)..(22679): unsure at all n locations
taagttatcccaataatgtgctaatgtttctaagcatggctaagcaatcacatctaatatctagctgaaccaatatgtaaagctcaactagtcaagttataataacccaaggtatcaaggaataaagtaaccaaaaacaaaagggctataacatataataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgtgaaaacggactctccggaaacgacggaatctaaacagaaaagagcaaaatcaccaaaacagcacataaacaagcatgaacagttttattaaacggaatctcgtcctcgagattcggaagaactggcgaacagatgcggatgagctgacttcaattcatcttctcgttcccaagttgactcttcttccgagtgattactccattggactttgcaaaaacggataacccgattcctggttcttctctcatctatttccaagatacggattggtctctcaacataggtcagatcctcttggtcttttatctgttcaagattagcttcttcggtaggtacccttaaacactttttcaattgcgaaacatggaacacattatggactcctgccaaagattgaggtaactccaactgataagcaacctctcctcttctactgacgatcttataaggtcccacaaaacgcggtgccaattttcctttggtgtgaaaacgatgaactcctcgaagaggcgtgacacgaagatacacataatctccttcttcaaaactcaaatctctacggcgattatcggcataactcttatgtcgagactgagccactcgcaatctttcttgaatgatctttaccttttcttctgcttcccttaggatatccgtcccgaaaacctgacgttctcccgtttgatcccacaaaagcggagtgcggcacttccgaccatacagtgcttcgtaaggagccatctgaagactagcttgataactgttgttgtacgaaaattctgcataaggtagattcttatcccaacttccaccgaagtctaaagcacaagctctcaacatatcttccaaaatctgattcaccctttctgtttgtccgtctgtctgcggatgataagcagtactaaagttcagtttagaacccatctcttcctgaagcttcttccaaaaatttgaagtaaactgactgcctcgatcagacactatcttcttagggacgccatgcaaacacacaatccttgccatatacaattccgctaagcgactttcggaataagttgtctttaccggaatgaaatgtgccactttggtaagtctgtcgactattacccaaatagagtcatggcctgatgacgttctgggtaaaccagtgataaaatccataccgatttcttcccacttccattcaggaatcttcaaaggctgcagcaaaccggcaggtttctgatgttctgccttgactcgctgacaaacatcacatactgctacgtattctgcgatttcacgcttcatacttgcccaccaaaatctttccttgagatcctggtacatcttagtactaccagggtgaatagagtataaagtgtcgtgagcttctttcagaattgcatcttttaaatctttgttgtcggggacgcagattctctcacccaaccatacagttccgtgctcatcctccaagaaaccgatagcttttcctcttctcatattcttcttgatctcttgaatatcgggatcattaatttgggcttctctaacttgatcaattagagtgggcttcgcttctaaggctgcaacaaaacctctactgacaattcccaaatttaatctttcanattccttgcataattccaatgacaactgtcgtccttccgtagcattgcaatagcctttcctgctaagagcgtctactacaacattagcctttcccaggtgataatgaattcccatgtcataatcctttaattaattccaaccatctcctttgtctcatgttcagatccggctgagtaaagatatactttaaactcttgtgatcggtatatacctctgtacgagtaccgaaaagataatgacgccaaattttcaacgcatgaactactgcagctaactcaagatcatgagtagggtagttcttttcatgcggacgtaactgacgagatgcataggcaaccaccttcccatcttgcatcagaacacaacctaacccaaacttagatgcatcgcaatacacttgaaaacccttctttggatcaggcaaaatcaaaatgggtgctgatattaagcgacttttcaactcttgaaaactctgctcacattcttctgaccacttgtacttcacatctttctgaaacaatcgtgtcatgggcttagcaatcttggaaaaattctctataaacctccgataatatcctgcaagacctaggaaactgcgaatctctgaaactgtctttggttgtttccagttggttacggattccacattactaggatcaacggcaactcctctagctgagatgacgtgaccaaggaacttcacttcagacaaccaaaattcacacttgctaaacttagcatacagttgatgttctcgtagcttctctagtgcaaggcgaagatgttcttcatgctcttctttggttcgagagtagataagaatatcatcaataaagaccaccacgaacttgtctaggtattccataaacaccttattcatcaagttcatgaagaaagcgggggcattggtaagtccaaaagacataacagtacattcgaacaatccatacctagtggtaaaagctgtcttaggtatatcttcctctttgattctcaactggtgataccctgatcgaagatctatcttggagaaaacagtggcacctttaagctgatcaaacaaatcatcaattctgggtagcggatacttattcttgatagtcacatcgtttagggcacgatagtccacacacatcctctgggtatgatctttcttttccacaaaaataaccggagctccccatggagatgaacttggtctgatgtatcctttctgaagcaaatcatctacttgccgcttgacttctgccaactcattggctgccattctataaggtctcttatggatcggagttgttcctggtaccaaatctattctgaactctatatcccttttaggcggcataccaggcaaatcatcggggaacacatcgggatactcccggactataggaatcttttccagaattatttggttcagtcttgaccttaaaaactcagaagacaatgcatgaacagtcacaactcgaccatcattgctggtgagagttacttttctgttagcacagtctatcacacctttatgtctggctaaccagtccatccctaggatgacatcaaggtctttggattctaacaagataagattggccagaaatggtactcctttaatttctattctgacagaggggctacgttgcaaagagagtgcttgactacttggggtactaaccatcaaaggacgtctaagatcttctacttccatcccatgatttcctgcaaaactcatagataagaatgaatgtgtagcaccagaatcgtaaagcactgttgcaggaactgagttaacaaggaacgtacccaaaatcacatctggagcatcttgtgcttctgcagcagcgacatgattgacacgagcctttgatgctggtgcggtagagttgctctgggtagggacaaccttcacgcgtctgggcttcggacacttgtcagcataatgtcctgggtctccatagttgaaacacaccacgggcttgctgctttgctccctcttggcaggttgttgctgtgctggagctgcaacaggacgtggagcttgattgcggatgttgttgccagcattgttgttgaagaactaacgcttcggacgaacaacagacgaagaacctccctgtggcatggactggggtcctaaagtaagacgcggcttctgattattcccctgttgtgtcttgaattgagcaatccggcgtttcttctgctccatgcgattgtacttgtcctcctgacgaatagccttatccactaacttctggaaatcatgataatctccagtcatgagtgggtaagaaagctcatcattaagtccttccaagaacttctcctggcgctcttcatcattgcgcacatcttccggagcataacgagccaaacgattgaactcgtgcaaatactccgtaacagagcgagatccctgggtgagcgacctgaattccttcttcttgagagacaccactcccgatggtatatgcgtcttccggaaagcagcggtgaattcaagccaagtgataggttccgcagtagtcctattcaggcggaaatgatcccaccattcagaggcagggccatgcaactgatgggatgcaaatgagaccttctcctgatcagtgcattgaagcaaatccaacttcttctctatggcatgcaaccaatcaccagcttcaacaggattagcggtgctagagaaagtaggcggccttacacgaagaaattctgctaacttgttctggggaggtgcatggttatttccttggttttgctggttctggagttgctgcatcatcatgttcattagctgtgtctgttgagcaagaacttgggcaagtgtgggattctctccattgttgttgttattggggttgttggggccattcccattgctgcgagtattcaccatctggtatgggcagggcacaagaagagaaaccgggggaaactacttaggacagagaattactttaacttttattgatcttaagtgagtttcattattacaaactgaagactctcacaccactaaactcaccaacttcctaacactcaaaagcaaacaaacgcatgcacttacatcccaccactgatgtaaatcacatgcaagacacacaaccaaacttaaaacaagcaaactaacacaacgatctaagacaacggttcgacaaggctttctaggtcttccgagcatcggagttgattgaaggctcgttcggctcgtcttcatcagcttgagttgctccccactcaatcttggaatgagtgcgcttcgattcttctccttcatcatcacttacattgacgactggaggatgatagcgatactccgtgtcggccaactgatcactgtagcgatcgcggagctctcctatggcgatccttgccacctcctgacatgcatggatgtagtttcttcctccagcttcgaacatcactgaggggatatcttcactattactgttcaaagtgactttgactcggcacttctcttcgtgacgatcatgagtaatctgggcataaaaaggggcagtcccaaatcctatggcaaaggacattgtacgcaactcctggacaaaaccctcaacaccaaacaggtactcaggcttgtagcgcggcatctaaagacaagtgaaaggagggagttaagacatttatccaattaatagcacaagtttttggattaatttgaataaagttagaaaatcaaagtaaaaggtaagtaaataaagtagaccaagcttgcaagataagttgaaatagttggaaacaaggttacaatttttgtacttttgaacaataggtttcaaaagaaataaaagaaagttataaaatcgacatactaaatttattttattgcagcaagattaaataaaacaacattgtaaaacttttgctggtaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttagagggcttctatggataaccatttggcataacctagggtcaaggggctctgataccaacttgtcaggcccggaatttctatccaaaattccaaacgcttacatgtgtgtgaaccctcgtccaggaatcagccgaggcacacaataacaaattgatattagagtacaattattactctaattaataagcgaataaaatgtcattacagaggtagatagttcctctcaatcaataaagatctaagcagcggaaaataaaataaacggcgcggacggctccactccacaagcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttcagaatttaataaaacagttaagtaataattaaacaatattaatccaacgctatacaacataccctgttgtataggcccaaccattctgaacaaccatcctggctgcacagttctatctccaaaccaggaatataccattccaaaccaggagctaatcaaattattaccaattatagcatcatttactatgatgagaagtgtgagactaatcacgaaagacattgttagacctgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccactgcagcgcaccttcctggatcataatcacccccttaaaaacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgactctcaaaaccatgtgctcacaacccaccattatcaagttttagttggcaagtaattaattaaccaatcacgattgaccatcgtgaactatcattaagccatcattaaagaatagtgagtcataagttatcccaataatgtgctaatgtttctaagcatggctaagcaatcacatctaatatctagctgaaccaatatgtaaagctcaactagtcaagttataataacccaaggtatcaaggaataaagtaaccaaaaacaaaagggctataacaaagaataggttaattccacccaatgacattcgaaaataaatgcaatagttgaatagaaacaatagctttaaacgggatcaacatgctcaaagggttgtttgggatctgtgtgacttgccttgctggccttggaactcttcaaactcttctcctgtgaaaacggactctccggaaacgacggaatctaaacagaaaagagcaaaatcaccaaaacagcacataaacaagcatgaacagtacatgtggattttttaacatgtagatctcaattttagaaaaaattagagacttgaaccaactaaaacggagctaagatgaattagttatgaatttttgaagattaaatcggattaaaacacttaaattgattttaattgaattatgacgcaataatgaattatttttgaaaaggaaaaggaggattattgcgtcagcgggctagggtttcggtggaccgggcgcacgggcgacggttcacgcgaacggacggccgagatcgatccatccaaaacggacggccgagatcgatcgttctacgaccggctcacggaagagggcgacgatgacgtcagcgatgacgtcaccaccggcggcggcggctcggcggctcgggcttgcatgctcgccggcgaacggcggcgcttcggcacgaacggagagcaccaaagggtagagcgcgacgcggcgaactcaccgatgaccaaaggagcggcggaagaccaagggacggcgacggcgacgacgaagaaacggcggcggtcttcgggtcgacggcggcgatggtgctccggcgatcttcggcggcggcgaaggagcggacgagaacggcggcgacttggcgatcacgacggtggccttcccgagcgatgacgacgaccgagacggcggcggcgcacagctggagcgacggcggcgacggcggcgctaggttgcacagcgctagagctcttccggcgacaagaggcgaaggcgagagtggcggcaggtagagaagagctcgggggtccttttaaaggggctaggaggcgacggcgaaggcccatggcggctggcgacgagaaggaaggtttagggttcggaggagagagacgaatccgattcgaactcgaatcaaacacattccaaaccgatttagccgatgtttccaaaggagaaaaggtagaggagatcccaaagattgtttcccctcaatcaatttcaccggaaacgaaaaggaatggccggattttggaaaggaacggcggcggcgcgaaactagggtgggccccacctgtcagcgggcggacgcgcgcgcgcgcgacggcggactgggccgacttgggccgaggagagagagagcggttttgggccgactttcggcccaaagccaaaagaagactttttaaaacctttttcaatttaaattattcatgaaatgcaattccatttattaaaaatacttccttagctcaaataaatcccagaaaaatctaggaattatagaattaagcaaagtatttaatgaaattttatctggccccattttatattggaatttattaattaaaattagatcttctcttcaagacttttaaaattatttctaaaaattccaattaaacaacaatttatatattttgaattttcagggtgtgacagtagtcttgtgtgtttgctgtgaaattgacaggcttcacaccgctgaaccatgtcgcaggcgtctttgagcgcggttggccagaaaaacccttgtcgaaaggcttttccgaccaatgtctgaccgccggcgtgtgacccgcagatcccttcatgtatatccaggaggagatgtttgccatcgtcgaacgatatgcatttgagaagtactccgtttggcgcctttttgtatagatcgttgctgatcatacagtaaatcttggcttgtcgggttatcctctcagcttctgcgtcgtcctcgggcagctcatcactactcaggaacttgatgagcggggtccaccattcttatgtggtctcgatgtcggcaatgacgtgttccgcctctgtagcccccgagatgatgtctggggaacagccgtgctatctgcgtcatttgcttctttcaccgatggttttgtcaagacgtccagaaaagtgccaagttccagtggctctcgtctggatgcgtgccgtgctaggtcgtctagttcgatgttgtgcttacggtatacgtgtcggacctcaatcccatcaaaccttttctccagcttcctgacttccgcgaggtacttggataactcggggctagagcacttgtagtctttgtgcacctggttcgcgactagttctgaatcccctttcacgattagttgcttgactcctagtgcagctgctgctcttatcccggcaagtagtccttcatactcggctgtgttgttggtcgccctgaagttgaggtggattgcatgcttgaactgatctcacaaaggtgatgtcaagatgaaccctgcccctgctccttggctgttgagtgcgccgtcgaatgccattgtccatgtttcgctgtccgtttgactgtccgacctgttctcaagcatagtccagtcagctaaaaaatcagcgaggacctgggacttaatagctgttcgtggcacaaagtggacatcaaactggcttagctcgactacccatttcgcaatgcggccaacaacgtctttgtttctcacgactctccaagagggaaggaggaaacaactgtgactctgtgggcttgaaagtagtggcgtagctttcttgatgtcatgattaccgcataaagcagcttttggatctgtgggtatcttgttttcgcgtcgtggagagctgcgctgacgtagtaaaccagtctttgcaccttcgctctctcgacaatgatgatagtactctcagaatatggcgtggcagcgatatagaggaataactcttcattaggttggggggcaacaagtacagggggatctgacaggtagcgcttgagtgcaatgaacgcatcttcggcttcctgtgtccacacaaatttgtcttgtttcttcagcagggtgaagaaaggttgtcctcgctcccccatcctagcgacgaatctgctcagtgccgccatgcatccagttagcttctggacttccttgagtcttgtgggtgacttcatgttctcgattgccttgatcttctcgggattttcttcgatccctcttccagagacgaggaatccgaggagcttgcccgatggtactccgaacgttcacttctccgggttgagcatgaggcgataccgtcggaggttgtcgaacgtttcccggaggtcatcgatcaatgagtcgcttgtttttgtcttgaaaacaatgtcatcgacgtaggcctcaacattgtgtccaagtaggtcattgagtgccccttgaaccgtgcgctggaaagtgtttcctgcggttatcagtccgaatggcatcttgacgtagcagaatacgccgaacggcgtgattaatgttgtcttctcctcgtcctcttttgccatgctgatctggtggtagccagagtaagcgtcaagaaaacttaacaactcacaaccagctgttgagtccaccaattggtctatccgaggaagaggaaagtgatccttgggacacgccttgttgaggtcggtgaaatcgacacacatcctccatttcccgttggccttgcgcaccatgactgggttggctagccactctggatgaagaacttctctgatgaaactagctttgagaagcttgtcgagctcttctcgtatggcttgtttctagtctggtgcaaatctccgcagtttttgttttactggcttggcatcgggtcgcaccatgagtttgtgctcaatcacctcgctggggactcccggcatgtcggacggctgccaagcgaacacgtctgcattgtcgcagaggaaggtgatgagcgcgagttcctatttcttatccagtgacggcccgatcttgacattcttgtcggggttggcactggagagcggaacgatcttgattgcgccgtctggcttcggcgttttgttggtttttcttactttcttgggcggctcagttgtggcgggcgggttgggagtgtgctcgaccatgtcgaggctccgcttgtcgcactgcactaccagcttcgtgtttccctgaatagtaattgttcccttcggcccaggcatcttgagcacttgatgcgcgtagtgagatgcagccatgaacttcgcgagtgcattcctcccgatgatggcgttatatgttgtgtcaaactcagcaacatcaaaggtgatctgctctgttcggaagttatttgcttggccgaaagtcacaggtagcgtgatcttgcccaacggcttggacgatgactgaggagtaattccatggaaggtttgatcagtgggcgtcaactcgcttcgtgggatccccatcgcgtccaaggtgctggcgaagagtaggtcgatggagctgccgccgtcgatgagaacccatgcgaccttgatgttccgaatagtgggctcgaccacgatcggatatcgtcctggagtgacaggagtcttggggtggtctgcctctaagaattcgatcttctgctacgccgtggaacctccgaagatgttcgaaacatgaaggtcggagtctaggttggctgagtctgagtcctgagtagccgcttctgcggcgttctcgactacacgtactcgcttgcctttctccaacgctagttgctttgtgagtgcatttttgaagacgaaacaagtctccagagagtgcttgtctgacttgtgtatgggacaccatattttcttcgtgtcatcgccttgtgggtccgggtgtttgggtgggtcagcatattctgctgtgaggacctccgtttgagccttccgtttcccactcctgcgactctttttcttgcttgactcaggcgtgtccttggctggtttattctctctccctgtcttcagtttgtcattcttgcgcctcaaggcgtcatccacgtgagcgcatcgatcgacaatctcgaataacttgcgagcagttgtgatccgtcttgtcgccagttcctgggttgtgtagcgatctcggacaccagacttaaaagcgcggattatagaagcatcggtgatcttggggatcgtatttctgcactcattaaagcgccgaataaagtccctcaatgattcacccgaattctgcgtcaacgcgtgttagtcgtcctcgatcgcgtggcgcttgtatgttccttggaagttagtgacgaactgctgccacagatctgcccatgaagaaatcgagtaggacgggaggtgaactagccatgaacgtgcagatcccttcaatgccgccgacaaataatttaccaatgcgttgtcgtctactccggcaacgtagagtactgtggaatagacctgtagaaactcctcagggtcggtgcttccgtcgtatttctctatcgctcccggtcgaaatttctcaggccatcgaacatctcgtagagaacgagtgaaagctctgcacccgccgccaggggcggtgggttgtcgacgatcatgtgctcgtcgtggatgtctgtccgatgatgaagatgacgaagatgacgaggatgatgacgagccacttggttccggggcagggttctgaggacgacgctcgggttcttgcgagcctcgtcgtcgtccatcgttgttttctcggcgtcgatctccatcgtcgtcgtcgtcgcggcgtcgacctcgacttgtatcgcccggcagccgctgctcgtgattagcatgttctcgacggttgtggcgatcatcacggtctcggtcctcgctcggacgtcctccttgctcttcgttctcgcgatgtcgcgaagagacgcgatgtcgggaacggttttcattatcttgagtgcgtcgtgcttctcggcagccattcagatggtcacggaaatcactgttgccgtgaggtggagggtagcttgacgaggcggagtccgctattcaggtaattctccgttagcatcgccgatcggcggttgttttggcggtaccctggtagcggcctcctcgaacgcgttattgagattaatcactgattcccatagtcgttccgccctgttaacgaccaaatttggtaatctgagtatcaaagataaagatcagatcgaagcggaatctaaatccaagattgtttcggaaacagagcaagaatcggctgaagtccgaatcggctgtgatcaggatcggcagagtccaagttggacagggttagccgattgagctggatccgacaatatgacgaagaatacgttgtcaggttgagttaataagcttcatgatgattgccacgcatggatagagtcctgagaaggcaattgtatctattaattaggatattttatgtaatttccttagagatatgtttgggcaaaagtctgccgcaaagacttatggtatcttagagtttgttagagataagtgtcgtgtccgatatggacatattttgtaatctcggatataaatagaccccgaaccccatgtaatcaacaacacacgttcaatacaacctcggcgcatcgccacccttttacttttgttttgtttcgacgagttcttgctttcgggttgagctgcatcagtttcgatcttcaacaagaggtaaaacttgttatggcggcttgcgttctcaggattagtgcttccatctttatgatactctaatcttgtttatgtaattcgtcgagttatcatatatcttatataatctctgacaatatcgctatctaatctccaatcggctaacgtttgttaccagaaggcagccgattaggttaaataccgacgttgacttagattatataagatatctaccactctatgaaacatccaacggcttgattgtctagatattgtccttcttttcatacttatagctgtatcagttgagtttgatcttataagtcgtgattagaatcctaatctctagcctgcttttggttgccgattagggtagcatcggggtttcagccgatcttaccttatttttatgcttgattgacatgttaaatatgccctttatgttaagatcttgtcgcatttaagtatattaggctgtttgtttggtatattctacttgccttaatatcttaatatagagtggtaccggagtattagccgatacatgctagatctatctgatcggctatgctatgaacatatatggtctcgttgttaatatatatttcgatctaagtgatttatactgtctcggcatggcgaccgatctatcccaatcacttgacttaagtatatatcgacataaggattatatattgttaatatctacagctgatcgagtagatttagttctttcttacatattaataactgccgatcgatgcacatatgacatcggctcaaagataaatgatatgtcatcggcaactagccgatcggctatcatttatagatttaaccgcggtttctttgtctttatttcttattgattgcaggatcaaatcaactggcatgctcatacatctaaagacaagcttttagacctgcactggagttaagcagatctcctaggcctcgtgtttttacatcaacacgcccactgatcgagatcagcgttcaggacaggatcaaaaggggtttccctcagtatcgcgttgagggttctgatgtgttgggctggtgtaatcaattgatcttccgtttctgcgccgcctctagatgtgctggtcccatcgatagcgtacacgtcgcgtggtgtacttgttgatgatgaggcttggtcttcgagcagatgtaggacatatggctcgaggggatcgatatcgattgccccgatgagtcgatctgaaatagtcgccgctccttgttccttgtccgcatctctagaagagattcgtgactgctggaccttaggaggtgacgtcctcatggcgctgagaaggaccttgcagcttgagaggtcgtgagtctttgccttgtgaatgggacaatagacatcacgagttggagaagtacattgaattccacgctctttgcaggcacggatttcagcttgtacgtcgaagaaaaccgaacaagcttgcaaggtgtgccttctggtcttgtggataggacaccaggtccttgtcgcctcggaagttatccttgttggctcatgcttcttatcaggaggacaagatttggccgcgttaggatccttctcaggcccagatgttgtcgatgttccgttctctgcttctgcgggaggatctttcgacatagagtcgaccggggtcgtaaccacgccgttctcgctcccggtaattgatgggccagtcgagatcggcatcgtggtgtagaccgggaagacaatttcgtcgacttgagtccacaccagcatcgttgaagttgaagctccttggttgatgccggggttgacgctatcgtcgagaaggcttgaagtcatagtagtagaaccttgagcaccaagtttccctacctggcgcgccactgtcgacgggggatacccgtagaccggatatagagggtattggggtccgttggtacgaggatctacgtaatacgacatcaagcaagtagaagacaaggattatactagttcaggccccttagtaggtaatagcccttgtcggtgacatggggctgggggtatcgtgactagaggcttgggtagccgcggtcacccacgtggcctgaccccctcgggggggtcgggcccgaggatgacatggccacccctccctctatctccccgatgggtcggaccgctcctgtttcggccccgagggatgggcgccccgaccccctgtggttttggcgccacgtgtgtgggttaggtgagcgcagcggggctcacctaaccgcatttatagtaggttggacgagtgcaccacgccgcatttaatgcggcgcagcgcacgcttatccggtccgtgaccggtcgcggtgtgtgaccggtcacagaccggtcagatcgcgggttaggtggcaacaggcggcctatcacacgcctcgccccgtcccgtcggaatgatgagagcttcctggctctcgtccctagccggagctggcgtgctaactcctggagttggtatgtcagtcccggtcagatccattccaggcttcagcgcaagtatggcaaggaagtcgctggccattaaatgaaggttgaaatggacgtccaccgggaaggcaggcgagcggggcaggaggcgtgtgctctgcttgtcagacgttacttccggctgtagactagccctcattgtaaaaagcatgtttcccttcttaggcagggaggggcccatgtggtgacccgggaccagagaaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctatctacgtcgcccgtgtcttgtgcatttcctctctcgctgacgttcttcagatcgagggcgaagaacctcacttagtgcccccggccgaaccggcaaaggggggcctgcgcggtctcccggtgaggagccccacgctccatcatctggcgcgccaggtagggggcgcgcgtgtctttctaagccctcgtcctctttcgtatgcgccaagcttctccggctcagcccaatggccgaacgggcagtggcgcacagcctctctccgaacgctagcggtgacgacgaggagcagaacccgtgccgtcgggctcgcaccccaccgtccccctctcgccgaaatcttgggcggggggaagcgctcggggaggtcgaaggatccgcgacttcgcctcccgcgggcgacgggggaggacggcgagacggggcgcgtcgccgcctcgtctacgacgatggcggcacgccccagggcgcgctccaggctgcgggcgcgctcctgcgtcacccgcccatcgtccccgatccagagactccagcccgacgttggctggatgacgtggccgacttggtcatgacggcgcagcagcgcctaagcgcctgcgggcggtcctccgccaccgaggcctctggcgcagccgccgccggctccatgtcgtcgaggcagagggcgcggcgagcggcggccgttacccgccgttcgtccgccattccctcgccaacgcctccgacccaagaagatgtgtgtggggggccggatgcccgcctcgatatcgagcgccggcgcgacgctcgtcgcgccgcccacgcaacggagggcgcttcctcgtccggagcgccacttcggtccgggcacgggggccggccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtctactcttgggaggatttgtgccagcagttcaccacgaacttccagggcatatatccgcacccaggcgaagaagcggacttgcatgcggtacagcgaagggacgatgagtctcttcgctcgtacattcagcggttctgtcaagtccgcaacaccataccctgcattcccgcacacgcggtgatctacgctttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagctccggccgcccctgggtccgccgctcggtcagggcggcgggacaggaggaggaagaaggggtcggcccgttccgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagtgccgtgagggcaagaccccggcggctcccgccggcaaccggcgaggtgaggccaagcagaaggccaccgccgaggacattgacgatggcgacgatgacctggggttccaggagcctgaggccaccgtcgccaccgtcgatgggggagcgtgcgctcacgcttctcgccggagcctcaaggccatgaagcgagagctcctggccgcggcccctacccatgaggcgacgcggcgggcgcggtagtcggaggttgccctcaccttcgaccacaccgaccacccgccgtgcgttgcccggggaggacagatcgcgatggtggtttcccccaccgtttgcaatgtgaagttggggcgtgtcctcatagatgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctggggaggcccacgttggtgaagttcatggcggcggtccactacgcctatctccagatgaagatgccgggccctggtggccccatcaccgtccatggcgacctcaaagtcgcgcttgcttgtatggagcagcgcgcggaccacctcgccgcggcgtccaagcccgcgggtggcgacgagaggctcgccacctccgtcccggccgccccaaggcagcggatggtcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcttggagaccggcggacatgcccggagtccccagggaggtgattgagcaccgtctcgccgtgcggtcgggcgcaaggccggtctggcagaaagtgcggcggcaggccccggaacgtcaagccttcatccgcgaggaggtagcgcgacttctggaggtcggtttcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcaggcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggatggaggaggctgagcgggccttcactcagttgaaggcgtacctcagttctcccccagtcctggtcgccccggagccagatgagccgttgctactctacctggcggcaaccccgcaggtggtcagcgcggcgttggtcgtggagcgcgacgaggaaaaccctcactccgcgcatccccaccctgcgtcgactcgacccgggagagagcagggaggagaggcccccgagccgaacggcggcccaaggcccccgacggccggagctggccctccgcctgcttgtccgatggtgccaggcgcccccgacccccaggatggccccggggccactgcgggaaggccgcgcctgtcgccctctgacctcgaggtcgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattatttccaggcgcatcgggtcacggtggttacgtcttaccccctcggccaaatcttgcataaccgagagggtattggacgggtggtgagatgggcaatcgaactctctgaattcgatttgcgctttgaaccacgccacgcgatcaagagccaggccctcgccgactttgtggcggagtggagcccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggactccttgcgggactcagagtggcagctggactggggatccgccgcctcctggtgttaggcgactcccagttggtcgttaaccaggtctgtaaggagtaccagtgctctgacccgcagatggacgcttacgtgcgccaggtgcggcgtatggagcgccatttcgacgggatagagcttcggcacgtgcccagacgggataacgcggtcgccgacgaactcttaaggctcgcttcctcgcgagcccagaccccaccgggcgcctttgaagaaaggcttgcccagccatcggcgcgacccgaccccctaggggagacggacgcgcctgaacggcccccgaggcccgtcggagtccaggcctcgggacccgaggggagcgctcccagctcccctagattgattgcttggatcactgagatccagggcgtacctcgcagataagactctacccgagccccccaaagggagtgaacgcgtccggcgcatctccaagcgttacgtgttggtgaaagggcccctctatcggcgcgtggctaaggaagtcctcttgaagtgcattcctcggaacaaaggggttgagcttctcgccgatgtccatgaaggcgagtggggagcccattccgcttcacgcaccttggttggcaaggcctttcgccagggtttctattggccgatggctctcaacgatgcggtcgacctggtccgacggtgcagggcgtgccagttccacgccaggcaaacccatcagccggcccaggccctgcagaccatacctctttcgtggccgtttgctgtcagggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcggtttggggtgcctaaccgtatcattacggataacggcacccagttcactagtgagctcttcgcctcccccgcccaccccagaagcaatggccaagtgaagcgcgccaacgcggaaatcctcaagggcctcaaaaccaagaccttcaacgtcctcaagaagcacggcgactcgtggatcgaggagctgccagcggtgctctgggcgaaccgaaccacgccaagcagagcaaccggggaaacgcatttcttcctcgtctacggcgcggaagcggtcctcccatctgagctcaccctgaggtcccctcgggtcaccatgtattgcgaggctgatagatcagcttcgccgagacaacctcgactatt

SEQ ID NO: 59682 - DNA, 40839 bp, Oryza sativa
ttatagtaaaaagtttacatatccgttttaagtttaaatttgattcaatttttttatatataatatttctatacataaatacttttcaactttgtgtttttatttttaaaaaatttatgatgtagtaggaagagaagaaggggaataggaaggaagaaaatagtgtataggggatgggggatcacccgcccattagctgcccccaaccattacgggaggcaagcaaaatagggcaaatctgccgaccgctgtgctgccgttagcctcaatttttctttgacccccatcgctctctctttactaatccaacaaactattttccctgagtttagatattgtttttttatgttggaaattagatctgcataggcagctgtgaccggtgagctccaaatataatccatctgcttagtgtaatatgttcatagtaagcaaaaaaaaatattaaacaacttcgattggctgaaaaaaaaaaagagacttactctccctctgtcccataaaaaaaccctagtaccgaatgtgacacatcctaatactatgaatctagatatatatttgtccagattcataataataagatatgtcacatctaatcttcgatcttagatttgtttttttataaaacggagggagtatgctactggggctgctagtagtgtacgttacggctagaaacaaggcagcagaaggccaaaaggcccattaattacatggacatttagttaaactaggaagatagcccgcgcgaatgcgcgggcatgtatcgtagactatgtttgagcatctacaatatatgatttctccaaaaattgttttcattagcattgctttataattttctaacctagctattagttatttttataacatgtcatatttaattaatccctacaagcaattatttataatattcttcatcatctaaaaagtaggtagacatattttgtgttagaaaacatgtattgcaaattaagtgtaaattcaaaagtaaggtgtttttttaattgaatgtaggttgtcattgtttgttgacggatgaattgggtgggatatgaggctccactaaatgcatgggtttatatagtctaatattattgtttagtttgagagagaatccatatgtgaacattctatgtagagtgtgggtgagactccatgcaacttagcatgaataatattggatgaagaaatatagttgtgcaatatattattttggaagatgatgtattatgaatacacacttgtcttttaatatgagataaatctaatggctggaaataatgggttcatcagtttaaaaacgcctaggaggatttatggggtaacatgtagagactttatataaaaaagaaaccatcatcaaaaatcgattagatgatatataaaataaaattataagtgtagcttaaaattatggtctttttaatatttgtttctctctttagtttagtagctgaaaatagggaggagactggagaaaaacgaatagcatagaactcgaatcaggtataagaaagggttcgcagtgtaatagtgttatgtgcatgtgattggagaggcaggtggagggtacattatttttttttcaatctttgtaaacaatctaagtgagaacctatgatgttgttttctcattgtaaggatctttaagacaagacatgtggtggcttaagtttttttataaagacaaaggtgatctaatagttaaaaataatgggtcatcaaattaagtggaaaccaatgtatagatatatactcccttcatccacacatattacttttatcaccaaaaccaagaaaatattaaatcatcttggatgttataaaatcaaggtgtaaatgcaagcatgcaagtatgcaactaatgagtatttagatgactcctccggttctaatcaaacattcagggaaaatttgaaccatgccacataaattttgcaaaatttatgatatgccaccctgacccacatgttattgacttatgtgggacctacatgtcattgagatacgggtggcatatatcaaattttgcaaaattagggtggcatggttccaacaaaccctttaatttatctcttcatttaagtcttaaatacataaagactataaataggaacaacttatttggaaaaactcaaatgtgaaatatgtctaacttttgtggatggagggagtactttatttttttctttgaatttcaatttttttcaaagttttaaaatatcatacgtggtgacttaagagtgctatagagcacgtttaattgatctttactatgtaaaacgattcaagaatatctaatatgcgctgtcatgttttttaatgttttgttgttatttggtaaggagattttttttattgaggtagatttaatgcgttcatctgtttgaattatttatgtctttaaatccaatttttaaaattataactccactgatttaaatgaaaattgatgaaattataagtccaacaatttaattgaaaattgatggttagatttgttttcttcataatattttttataattaatttttttatttataaaaaaggaaggtgagagaaagaattattgaagacggagaaagtgtatatatgtatacttacatgcgtggggtggtcggaagggtgggccagtggggagaggagagttatgccggtgggagacaggcgatggatgtggattgtggttttttttaagaaaaaaaagataaatctaatagtcgaaaatagatggtttaccgatttattataattccacgtggcggtttagttgtgtttataggcgtaccacgtggtagtataggagtgtttgtatacctttagtatataattttttttatttttaaatggtaattaggatgacatgccctagaaattattcttttccgtagaagtttaccacggttgaatcattaagtattttaaagacaccatggatctaaatttaaatatgttcgcaaatttgatgattaagataaatctagtagagcttagcaggatgaaaacatgtgcacaccctcatttgtagcagacctaatgctaattgcattgataatccctagcaagaataggttagtctatttggataaccacattaaagcaagcagcacgcacgttgaaaacatattcaacgttttgatttctctgcatctttatggtttattatactccctccatttcaaaatgtttgacgccgttgaccttttttaagtcatctttgaccattcgtcttattaaaaaaatttaagtaattattaattcttttcctatcatttgaattctatgtatatatatagttttacatatttcataaaattttttgaataagacgaacggccaaacatgtttaaaaaaatcaacgttgttaaatatttagggacagagtgagtataatttagtaacttaagattttatatggggttgctagcaataaagtaggaaattcacgtacttaccacagagagaggagtacgtatatatagagagaggagatttcttttttattgaaaacagatccttgagatatatctaattgttagaaataatagattcattgagatatatctaattgttcgaaataatagattcatcggtttataagttataacggatggtcagatttttttttcttttttctcataatttcaaagattttttctaatttattagagtgcgacatgacagcttaggagagtatataggatgtcacgtggtgactaaagtgcattcgtaggaagtttaatggacttgtgcgtagaatacaacttgaaataacattatatttttttacaactattagctgaaattattaatttggtttttatctctcatgagtgaaaaaaagaaaaaaaagaaaagaagggaaggggggacacgtacgtacgaattatatacgtacatgcacgtacacgtacggatggatcgatatagaacgtggcgctttctaaatataaatctatttggtattttttagttagatgtaatggttagaaaatatgggtcccccagattaaatgaaaatcaatggttagatattttattttttttcctagaatttctctaatttattagagcaccacttggcggcctaggaacatttgtagggatgacatgtggcggcttaagagcgtttgtaggaagtttaatggacttttagtatataataataataataatagatacatcctatttatttcgttgggcatcagctcaaccggatttgacatggtctaacaagcatgctgtttagaaatagaaattcaaacattacgtgctcacatctggaattttggagctgcatgtgtttagatgcaaaaaaaaattcggcataatacgttaactttcggcatttgaattttgtgtagcacttctccaattactcagtatctcaattaatcacggccatctctaatttaatttctacacatattctattatctttactaattacaattatttacggccatccgctactgcagctatcgtcggatccgcccatgggagaagcagccaccgccggatccgccaacaggagccgctgcaccacagtaaatatgcacccgcctccagtggagtggggatgccgccgagcacaaagatgtggtcctctcagtcccgcgcgacaaggaggaggaagaggtggggacggagttggtggcgtaggagaaaggggagaggtagctatcgcatcagtgggaacaccgccgagaacaacgatgcggtcctctccgctccgcacaactacgaggagggggaggaagtggtgggagtcaagttgcgatctgcagcaagccagcaagcatgtgggccaccagtagagatgtgaagcagtccacataccataaagtctatataactccctcatataagaatcaagttcaatttcccttgttcaattgaaataccatatataacacctcctacagctaccaataccggttcaatttgccttcccaaatggttttgatgatggtttcatcctgcatgaaataaaacatatagtcagacccacataaaagtagccacgtttattatttttttcctcacctctcaccaagggtggatccagcgtgggtgctaggggactcgagcccccctacaccgcgagatcaccattgatagaaggagagagaggagggagaaggagagaggggaggaaaagaagggggctgaaggagaaagaaggacatgagtcccccatatatctggatccatccttgcctctcgcctatctctccttggataatggctcggttgcgctgcgatcaacggtatagttttagatgggcgtcaacgaactccaacagacaaaagggcggtcacagatgacactttctattgcccccgtcctgagcatgtagctcaccaaccgcgtgtacgtagcaccaccaccaccagcagcactgccctcaccactgccagcattgcaatgaggcctagtatgtgagcatgcagaggtccaccattttcttcatccccgtcttctcatgcgttcgatgttgtctcggcactacggagcaagcactataaaaaagtctatattactgtttatgcgtttgatgttatctcgccactataggtaatatagaccatttctttctacacataaacctagtcgtcgaccaaaccaccatcgctggcaaactcttctttgcggaggctttgggcactggtcaccctgacgctcatgatgtgatgtctatggtctaacagttgggctcgtgtgtctgataggtggggtcagctggtgtgcttgcaaccatggctacagcttacgtgttgtttgcttgggaacttggcatgtatactcaagtttcgtaagttgttgggcgtaattttgttcctaaaaattaacaattattagtaactaagttagtcgttgctttcaagaaattggtaaattgtttttcaattaaaggcactagcagtccatcgtgctgaataatcgcatatatatattctgttttagcatcgtggtgatggccttttgcatggagtggtattatcactctcaagagtagtacaatgcacataagggaaatgcgcagataactaattcaattgacgtacaacataacttcagtgtgatttcctttttaagctggtgtcccccagccccttattgattttggactgaaaagttttgaaagtttgggctttcaatggctcctgtataatgtgctctgaaaatttggacttgtttagtttgacaaaaaaagtccaaatcctgtggaaattcgttaaagttgaaaaaaaagaattaagggatgtttggttgctagctatacactacaccacactttaccacagtctaccacgcctaaggttaggcaagtttagctaatttggcaactgtttagttgagttgccacagtcacggtaaaattccttatcatcatattaggtctcaaatgtcaatgacttaaaaaaaagtgtaacaaaattctcctaggtttgctaaggcgtgatcaagaatttgatcacctcatgttagacaagtgtgacaatttttatttgcacgtggtgccaaagtctggctaggaaccaaacaacccttagtatttcggtcccctgaaatgtttctatacgtgtgtttcaaaatagtgaatcctagccatctttgtattctcaatctttgtctaaaaactgtagaaccacaaagagtgataccgtttggaatatttgttgttcttgtatttatttctttcacatgtatggcttacataccggttgaaatatttactgttcttgtaatgtgattacagttcacaggaactacacaatactttttacaagacaatatcataaccttattattgtactctcttcgtcccataatataaggtattttgggtggatattatacatactaatactataaatatggacatggtgtcacatccacctaaaattctttatattatggaacagatggattaagtaattattctttatattatggaacagatggattaagtaattgttcgacgtgacatgacctctgtgatggcacattttgtcatttatagaacgacatttaaggtctccttttggtttgagaatcacttcctacaaagtacaaacagtttaatttattcaaattagaaaaaagaaacctttccaaaacccaattcctctccagttaggaggtgtttaaattcaggggtgtaaagttttggcgtgtcacatcgggtattatataaggtgtcgtatggggtgttcgggctctaacaaaaaaaaactaattacaatatccgtcagtaaaccgcgagacgaaattattaagcctaattaatctgttattagcacatgtttactgtagcaccgcattgtcaaattatagagcaattagacttaaaagattcgtccgcaaagtagtcgcaatcggtacaattagttatttttttagactatatttaatgtttcatatatgtgttcaaacattcgatgcgatgtaaaattttaggtgggatctaaacaggcctcatgggtaggatgtgtgtctctggtactggcaatttcacagcctgctataaggtgaaagcctaaaactgtgggcgagtttgctgaacacatcacgtattaacccaccgtttcccaacgcctgacgccctagatcctgcagcatacggaggattcatcctctggagatttgacagccacaacaacacacaagccactctgtcacaagggacaatgtcacggatctcccatacatgcttcagttaattgtttgctccataaaatctccacaaaaaaatatcctctccttgggcggtccagcctcttcttcttcctctgcccaattgcaactcacaagtcacaagcttcgaggtatatctgctactactagtacaacctatgtcaccatgaattccatgtcctttgtctccctttccaactgttcctatgcaagaactaagaagtcacggtacattccaaacgatgatgcttccagaacaccggatccaaatattctttttcaaaatttctcacgggtagagcccgtgacaaaagtttgtgtgtgtgtgagagagagagtgcttgaaaccctgaaaaagaattcaagagtttttgtaccctcctgttaattggtagctagagcaatggcacaaaaggtccagatgcccttcacatgttcttgtttcatgtgagttggattggagtgatgtgtcccacccccctcccaatccctttctctctggcctcaggagtcagcatgcatgagcaatgccctgctcaattacacattttcccttaatttgatcatctcccaaccactagtttaggttttcgctacgcgtacaaccgggttttcggtgtattcttccctcgacggtcactgacatgtggggtctctattgtgccggagtatacagggcccacctgtcagcgagagcgagcgggttttcaggacatttgtctttgtgtttgtggatgccactctcacaaactcagcctgaaatggacatgctactacactctatagaccttgggtataaagctggagtagaggcctatcagcttctccagctcttgcagaagctcaccactcgagctctgtctgaactctgaagatggaggagcactacaccatgaagaagccgaggttgcttcttctttccttggaggtgatactgattgctcttcttcttcctctccgtggtgcacattgtgagagctctactcaaggtgaaggcggcggtggcggcgccggcgccggcgcggcgaacctgacggtgaccggcacggtgttctgcgacgcctgctcctccagctccttctccaaccacagctacttcttgccaggtactactgtacttcagttatcatcaggcattcagcctgaagtcaatggtgatgtgtcccctaattaattttggaggattactttgttgtttagatttctgataatattttggtagaagactattgtcagaaatttcattcttctaaacctttgtggaatgtttgggtggacataatctgtttcttggaattcaaaattcccttttttttttctgattgatgtcatttcaaaccatttcatttttttataaatttgttcaaaatgtacatacatttatttttttaccaaattttggtaaatacacaagaaattttgataaaatttcttggtaactacacattagtggctatcctatcaaaacttaataatattatcaacttatcaaaatttcagtaggtttattttggatataatctgaacaatctatttttcctccattagttggaagaagcttggaacttgggagctctgttttttattagtttgtgtctgtcacgtatggaatttctcctgtacttttcgtaataattttagagaacgtagtatgataaacaacttgcaatctgcaggtgtgcactgacatgctacttgcacatcccaccaaaataaatattagccaagtagcccaaggtttacagtataacaatattaaactgtttagaatggtgctaagtttggaacctaggaaatgttatggtaccttttactaaaaataatagaaaatatttcacatatccgatttatccattttgtaatagatgcaggggccggattttatccattttgtaaaaaaacagactggctatatttatgacgtttcaaacaaatatagttaaatcatttttacagtatacactaaaattattgcatatgtaatttggtgacttgcaatgtacaaatatatactgattatttttctataaaaaatatggagtcatgaatatagctactcaaaaaaaataccattatcccaaaaacctcacaacaatcaaccatttaataatccggtcgaatacaaattgcagataattaatctgatgttgaattgcttggttgttcatcacaggtgtcaaagtgagaatcgactgcatgatcagcgtgaaatcggcgtccaaggaggagatcaagatcaccgccgagaaggtgaccaacaccttcggcgcgtaccagctcgacatcccggcgatcgacggcttcgagtgcgccacctccgccgccgccgccgccgactccttctgccgcgccgcgtcatcgacaacccctcgccgctctgcaacgtgccggcggtcaccaccaccgtcggccacatctcctcctcctcctccggccacgaccacgaccagcccaacgcctgcctctacaacctcaactccctctactaccgccccggcggcgccaagaacggcggccagtgcggcggcaccggcggcggaggcgacgtgccccccgccgcgctgaacacgtcgctgttctactgcccgccgtggccgtggccgccgatcccgttctgcacgccgcgcccgtggttcccgcccatcccgttcctcacgccgccgccgccgccgttcctcccgttcccgctcccgccgatcccgttcctcacgccgccgtcgccgccgccgccggcgttcccgttcccgctcccgccatggccgtgggcgccgccgccggcgttcccgttcccgcacctcccgccaatcttctcgccgccgtcaccgcccccgccgccgccaccggcgttcccgttcccgttcccgcagctgccgcctctcccgcacttcccaccgctgccatcattctacccatcgccacctccgcctccgccgccgccgccgccaccgccgccatcgttcccgtggccgttcccgccattggcgccgcttttcccgccatatccatctcctccaccgtcgatgtattctcgcaaagatccgagcacttggtcgtcgtcttccaaacagcagccatgagtaaaaaatacattttgcttgtgctggaaattgtattgtgtactatgtatatgagcttttttttatggattgtttagtgtaagagtgcatttggctatttgcactctgtatacaaatatttgtagattttaggtttaaaagaatgaagattaggttaatcctactttgtgactatgaaagggtaaaataatcgcggcttgtgctctctctgtcttcgactgtttggtagtgtggaaatttggcatacaggttaatatcaaacagtgagtctcaacttatgttttgaactttttgtggaaatatatattgtatatagaagttgttaatgatttccaacacaaaagatatccatggtttaccatgttttgaacttcagattgctcctgtggtatatttttgccattgtcaaagctgaatcttgggttgctgagtgcagagtacttggtgtgttctccccaattctggccttttttatttggcattgtgctctgattgaataaccaaggctgtaatattttttccaaacaattttacgacaacagtgacaatttaaacttcatgcatttgctttcacctatcgccagtcaccctacaggtaaagcagaggaaatggggaaaatataaagggaacggagattatctgtcctgaaattatttgttctttttcgtgtttcctgtcaaatttcctgttttaccctcgcaaaatacagaatttttatgtttattttttttagggggaggtcaattccgcagccaaactagacggttctttttctttataaaaaaatgtagaaatttcagctagtattttttttgcatttatatttgtaacctgacgaactgattttgaagtagaaaaataaaaaatttcatgtagaaaaccatatttcaacttgattgtgacttaaatttcaaatccaactgtttttccttgcaaaacaaaaaatctcagatatttgtaagagaaattttatggcccttgaaaaaaaaactaagaggtacaaaatcctacagtgtaaaatttggtacctgtgttactttctcattcattttgaaaatgccaacccaaaactttcgtagttgcaaattataatttggcagtggccttggtgtttatgatatattagagagaaataaggatccataatgcatctattattcatgagaaaaatacaaattcttaaacatttacttacactcatatattttagtatacagagtttcaacaaaaaaaatcatttgcaggaatggaaatcgtatagtataattatagagtaaatttcaaaaaactgcaactatagtaacaaaactatcagtttactacaatattagtgatctatttcagtttgctacaacaattgcgtgggaaattatcacaaaactacaacttttgtcatgtagcagcatatcacgtaaaacttacagttttatgataatttcccatgctattgttgcatcaaactgaaataggttactaatgttatagcaaactatcatagttatagttttctggaatttactcataattatatgctctcaagcttgcaatattaagtatgccataaagctgggttcccttaccggcatgtaagggttttaccgccaccaagacagcaaccatgcagttaccgtgcaagaccacacaagattcatcttcaaatctcttagggcttatttgtaacaaaggaaaagatgatttttgtaggattgaaattctatggaaatttttcctaagtgctcatttgaaacaaaggaatgggcacttgaaattcccacaaaatccctatggaatgacttgattcatagcaaatttggaggttttttaacatgagattggacctcatgagaaacttttcttggtctatctctccaaaaatcttgtacttttcttatggagcgtccaagcaacaagttttgcacaattcctgcattttagaattcctaaggatcaactagatatgccacctctatttctacatttttcatgttcctgtttttaaatttctttgttctaaagagccattggtcatggtaactgcactaacccaaagttacctcttggtaagccacggtaatcataatactattttttaaaagagttatttgcaaaaaaaggaaaccatataaaaaaccttagaaaaagttttaaacatttcagaaaaatattttgttgagtgagagagtgaatgagtgaaagagaagatatctctctgttgggtctaaatgggctttatgaatagtactcatgttggcctactcgagttccttttttttttctattttcatttccactttggtttggctcgaaaaaaaataaagttaacttagtatttttcacacaagtttttcaccatatatcactagaattgatgttccacttatagattttttcggtctttttcaaatttgcattcaatcaaattttaacaaatcataccggcggtttaccctaccaagcccccacagtaattatctttttgaggggaacccccgcagtaactgaataacctccagtattgtcaaccctcgtctaaagggctgtgtaatgctgctcttatatgttcggaaactctaaattgaagagtgactattactctttcatcaaggaagagtgactaagttctggtcttcaactgtattgagtattgcaatcccaagtgattacctgcaaagaaataactctttaattttactcgcaaaagggaactctttaatttatttgaaaatgataatttgtaccaacttattactgcattttttttctcggttccctttatattttccccatttcctctgctttacctgtagggtgactggtgataggtgaaagcaaatgcatgaagtttacattgtcactgttgtcgtaaaattgtttggaaaaaatattacagccttggttgttcaatcagagcacaatgccaaaccaaaaaggaactgagaaaacggggaaaagtctctgcactctgcaaccaagcgctttgagcctttgacagtggcaaccatacattactggagtatattctgaagttccaaacaagataaactatggatcttttttggtgttggaaaccatttaacaacttctatgtactatattttcacaaaaagttcaaaacacaagttgagcctcactgtttgatattaaactggatgccaaatttccacactgccaatgagtcaaaagacagagagcacaagctgcgataattttaccctttcatagttacaaagtaggattaacctaaatgggcttcatgagtagtgctcaggttggcctatttctatttccattttggtttagctcgaaaaaattaagttaactttagtaattcacacaagatttttttactagatagcactagaactgattttttacttatatatgttttttgatcttctttaaattttagtccaaacaaattttatcaaaccatataccaacggtttaccaaaccgaacacctgcagtaactgaccatgcagtaaccactgttattgtcaaccctggtcaaaagctctgcgcactgctgctcttatgctcggagactctacattgaaggaaatgctatccttctaaatgcaatatgtaaaattactctttcatcaaggaagggtgactagttctgatcttcaattgtattgtaaatttgtaagcctcggtgattacctgcaaataaagaagtctttaattttactcgcaaaaaggaactcaatagtttcattggaaaatgatatttcctgcaaaaaacttgactacatttttttatccccaaatttcattcgaatgctatatagcaatcccctttctcaaatcatgttcctgtaacttttctttgttctgcttcgatggtctctttaaataaccagtgagtctgtgagtgcacaagcagcagcgagcgacggcgagtgaagctcgttccccttttcttttttccttttctttttttttctttttttttctaccgagagatcagcgtaccgtcaatataggacagttactatcgatcatatttgagctaatttcttctttttctcacggttttgaacactaatattgttctgataaattgtctatatctagctagttaactctcaatatttttatataacattgaagaggtaatctcacctaactaaataaagaattaactacacccaaatttatacaaccaactaaacaaaaacatcttctaaaccgtatctctcatttatgcaactaaacaaaatctcatactaaccagacaaaatcaatacaaggaaacaaacaactttatatgtatctttttatctggagaactgctagaccacggtatcccgtgtaacgggatagattataatgagttaatgatgagtcgttgcccccaccaaccatgcgcatgtgtccccacgcgtctgtatctcttcctcccacacgtacgcatcgctctcccagacccttcacgtgtccattgcgctcccccacacatccatgcactcgcattgagtccccacacaacttttaggtatcagatctgatagttgatacctgaggtaccagatctggttggtacccgtatcagatctgatagttgatacctgaggtaccagatctggttggtacccgtatcagatccgatacttgatacctgaggttccagatctagttggtatccgtatcagatctaatacctatggtatcggatccggtacttgatacctgaggtaccagatccagttggtacccatatcttgaaaatgatacctgaggtatcagatttggttggtacctgtaacggatctggtaccataggtatcagatccgatacttgggatattagattcgatacttgaggtatcagacctggtacccatgttactatggttggtggtacctggtctggtatcggtacttgatatctgaggtaccagatcgggttgatacccaaggtatcagtctggtaccataggtatcagatccgatacttaggatattagattcagtatttggggtatcagacatgggctgttacccatggttctaaggttggtggtacctggtctggtatccacgaggtatcaagacctgtagttgcatattaggcttggtaacaacaaaaaaaatatatcaaagcctggtacccagaggtaccattttgtaccaaataagtcatcttcttcctctctccaacacactatatcctcatccacctgttgattccttagcatgaaatcgaagcaacagcaacaacaagaacaataaaaagagatgagattgtgagtagatgcaggcgacgaactactagaaaagccatatcctcatattcttccttcttcctgtggacatctaaccccatgcaggctctgccattgttgcactcatgttgaattgctggggacatcgccgatggccggctcagatggtgttacggtcgatgcggcgagaaaacggctcccggtggccagcggctagtggtcgtgggcgtagagagggggacagaggatggagggagtaacttgtgcgtggtgggtggtggacgacgctgcatagacgagtcaagaagataaggtgtagggcgttgatcattactctactccgttcaaacggtatgtagttctatagattttctgttttatctggaccaaactcagtcgagaactgggttaggccactacccgtgcaaccaaacacatccataatgaagtgtctggccactacccgtgcatgatacgtacattggcacttcctgtccaacaagaagtcaagaacagagttacagccgacacttctgcaaacaatccattttacacgcttgaggtgaaactacgtggtatttaccgtattttcttacgctaatttataatacatcgtgttaacttagcacttctgaatttgtttccaaatccgagactatccaagccaatatattctgtttctaagaattgtttgggtcgatcagaaactatctgatccgttttcacgcatactacttacctcatagagaccatatataaaaggcctctgcacaagtagctgtactacaatatactatactacaccgtggaataaacactcagctggagttccatttcagatagttttgtctctgaagttcctgcattattccaagcaatatcaatgggtcaagctaaaactaccatcaactatatgccgctaatttttgggtcatgcttatgacaaaaatgtcggcatgtcttcacttagaaaaggagcaaaagcgtaatgtttatgtactatagtactactaataatcatctatccaaagttgcattcatgaaattgttggagcagttcagatttcagccatgaatcgcgtgatttggtcttctcttgacaaatcaccaaactgattaataattaattaaccaatcttaacttagtcatcaacagcaaacatgtagggccatggtgtgggttatcctgtgcccccaaagctgcacaggtccggtgttaattaactggttttcaatcgatcgatcaggttcaggtcgcctacccagcaattagcatatttcggactccggaaagtgacgcgataaaagacgcatgcatatgcatgctgatatgaatatgcgaagcacgcacgcatggctcgtttgtccactgctgcaacttttgttctcgtggaaagaagggcggttcttgtcaattgttcgtcatgatcagaggctatgcatgcactaccagcattaggtacacgaaaatggagggagtagatagatgtaaaaaagaagtataggattgatagaatgttactcttctactgtactctactctctctgtaaaaaaaaaaaaaaaaaaaaaactcctgcatacttaggagtgggttttcttacggagggagtacatgtcattaggccgagtttagttccaaaaattttttttaaactttcaatttttctatctcatcaaaatttttctacacacacaaacttctaacttttccgttacatcgttccaatttcaaccaaactttcaattttggcgtgagctaagcacacccttagttattttccttttttgcaaagtttgcacaatgtgatcatacatgagaatgatatggagtactactatgagactccatataagtttctctctcaaaaaaaaaagactccatatgttagtaggtattttccgactccgacatttttacatggttctttcaaagtagagatccgcgattccatttgtcccttcaatcttgataataattgcagagttggtgtggtacgtgccctagttagtactgtacttgttgttcatctcgtcagaaattgccaatactttgttcggagtggtaaaacattagttgtgcaataaccagctcactccctgctgtgtatactactgatctgatgtttatagagactcactttgaggtctaactttgagattgttttcttttccttactttcccatcttcaccctttgtttttcgtgcgctcgtttttcaaaccgttaaacggtacattttttaaaaaaaattctatagaaattattttagaaaacatattaatttatttttaaattttttttagactattacttaattcattacacgctaatgggtaacaccgttttcggtgactaagaaagaggttcccaacctctccactaaaaggttcgttgatgaaaagtttcgggacataacagacgagactagatagtgctactcccagtttggagtatttttatggagtaactacataaagtttggtgttatctttagcaaccatattgttggtgtttgtgcagacaagtttagctttgccctaattgtgaggcgacagttgattaactttttgacaaatgaaagacaagtgagctgaccagattctcttgctggcttgcttctttgtccagcagtgcgaaaaaggtttgcttccactgctactaccatcacattaccaatcatcatatgctcagcttaacgtcatcccagattctacttacacactaaccgaggttaggctactggtacttcctcgattagtaataatactagtactaataggagtactaattaagattataaaatgaggaatacacgcaagcgtatcccagaagaatgcaaacttgcttctctgcaacaatggaatgtgtgtctgtgcaaaagatcttgagaagatcacttggcttcagagcgatcacttgttcaggcttcaggcttcagaggttcagagcaagcaggatacgtgccgctaggagtagcattcctataacttgcagggcaatggttgccaaactgctactgggagtagtagtagagctaaaagtttgctgatttgactgactgaagtgattgagagggattttgtgcatctttttctactgggagagataattgcacaaagccctatttttgactgagcaggcagtacctctttttctgtatttgggacagcttcaacaccatcagaatcttggggtttcgtatattttcgttcgtgctagattacccctgtcaccctccctccctcaaaaattgttgctgtgtatttatacagaaactatgttcaaataccaggttagcccccctttgattcaaaggaaattcataggattctataggatccattcccttgatttaaagggctatatttaaaaaattcctatagaaataaaatcatctaaaattcctataaatttcctttgaatcaaaaggagcctgagcctttatctctcctcaaattcctttgtttttcttgcggattaatcaaacggtctttcttatatttttcctatattttacatttgtattcatgtcagaatcctatattttttctattcctccgttttctaagataaagtaaatacaaccttcgaaagagaataacttgtatccttaaatctagacatgaggtatgctcagattcataattgaaagtttaatttattttacggaaggaacatagtaggcttcttattcaaaatcttgtggagatttaaccatctgctttttttttgtctcatactaagggcatgtttgggggagctttagattctgagaagcagctgtttggtagccagcttctaaaaatctggaaaagctctgaaacccagcttatccagcttctggcttcttagttcatttttcagaatctgtaactatagattctcagaagctgtggactatttagggcagcttctagcagaagccaaaagctgcagctgggagaagctcccccaaacaggacctaagatgtggctaattcgatcctaagggcattaccattgcaagctacaccaattgagtttctttgtaaaaagaaaacaattctacataggagaaaacactaataagacacatatcccacaggacagagtatccctaccaggctgacaaggaatgtttagtttcagcccatagaattttctatttcagtcctcataaaccctaaatttataaataaatccagaatttgttaaaaaaaacctaaaaacaaaaggcacaactacctttgaccaagtcatttccttatttttatctcttaccaccatccaccattcattcttatctatggcctagtacaggggaggttaagattccaagaatcagccggtgaaaatctggagaagctggaatatcagcttctggcttttttttttttgaaattagcttctggcttttaatttattttatggattctacaactacatcttctcaaaatctgagtgaaaatctgtattgtctaggggagcttttggcagctgtagcttctagaagaatcttcagctaccagaagctcccccaaatagaccctgctactcgttcactcattgtcacctatggccatcgatgaatcgcagcagctcctcctctgaccaacacctcttctccctgccagcgtcgctgtccctcagccggcgcccctctcctccttcctgactagcacgcctcctttcctagccgatgcccctcccgcttccgtgggcttgccggatttagaccaagcagagttcggaggagacggctcggtccagcaagctcggcaatgacaccagcaacaagctccccctaccaggtcaacggcagcaacaagcccaacggggagcagctcatcagctggtttcaagccaatgtcgttccctccccctcctcctgtccttcgcttgtcgcaacctttgctggcggcagttgctagtggggcgaagcggtggtggaagaagggtgacaaagatctaggcgcggggcttggagcagcggtggtggcgcagttcttggcagagggccacgagctccaccgacggtggccgacgactcctcgagctcccctatcccactccactggccgctctacccctcctcctctagagctaaggcggcgtagattgacctccagcaattctggatgatgagggaccatgtcgttattggattgtggggcaccgtgcgtcgcagcggagcactcatgccctaattgagtatcggaaaaccttgcatgggaacgaaagagcatggcatgaaaagaatctttgacatggcacctcgaatccataaagccatgttgctgcactgttatatttttttggaatataggatcacgttggaatggggaaattttagtttggaacaagtacgaattacccaacccccccccaccccccgccggaactatcacggtcaactgaattaccccccataaacccgaaaacaagacatcgttcaccctaaactttcaatacagtcaaattacccccttcgacccaatctagaatcacctacgtggcatgcacgtggcagtcccgtcagcattttatttataaaaaaatatgggacccacctgtcatgctcctcttccactctcttatctctctctatcactctctctcatctctctctctatcactctctctcttctctctctcttactcttcctctctctctcttgcgggttggcggcaggcggtgggcggcgccgcaggacacggaggcggcgacggtaggggacgcggaggcggcgacgatgcgggacacagaggagggagtggcgaactctgagagggagtgggagggaactccgtcgaactccctccgcgtctcgcgctgccgcccacggttggtttacggactgcaatcagctcggaccaccagcctgcgcgcgccgaccgcccgcctctccaccacagtctctgccgtgccgtgtgtgtcacctccgtgttcgccgtccacacccgcccaccgcctgtccctgcctccgtccatcaccgcactgagggggcagccgccttggcgtcctgcgccaccgcctcctccacatcccacggctcgacccaccacccgcgcgccgtgcatgcggaacacgtgccgctgctcggcccgcacgcgagagagaggaagagtgagtgaaagagagagagaagagaaaggaagagtgagagagaaaagagatggaagagggaagaggagtatgataggtgggttccactttttttataaataaaatgctgactggattgccacgcgcacgccacgtaggacaaaaccgctctggattgggtcgagggaggtaatttgtccggtattaaaagttcagggtgagcaatatctggtttttgggttaaggggtaattcggtcaaccgcgatagttcagggataattcgttcttttttcctttttgtctagaggaatataaagttgtacggtatttcacacgagaaaacagcattgcaactattttaggaagcattatcgagggtcgaagcggattttgtgaagaataatttcgtacctattaaaatgtaaaattaattcctgtaaattctctctaatctcctcctttatcccttcattttatggacaacagaataggcccttaagaagtgggagtttgtcggaacgtttataatttgatttattctgcgaggaggacttgttctcgtggtacagcctcaaattttctcaagcgcgaaactctcttttgatcctttgagttttttttttttctaagcaagcctgtttcaagttgcacaggtaatacctcaattcacgttccaaggtagttttgccactgctagaattattttggattaatggatccatgctattataaatttttaggattaggcatatgacattataattcatgtatttattacaatgccatagttttagagctcattacatatcctttcactacagttaaaaataaaattggaccaaatgacccacttctgccttcctacctacgttgaaaatttaaagaatatgtgcaaaaactaaagaaatataattcataagtttctaatacttcgtgcatcttagaacgtactagaatgatttagttttgttataagtcaaactattttatgtttgattaagtttataaaaaataacaactttaaaacacaaaatcaattcattaactccactatcgctctaaaaaatgaaactccattattgaatagtatatttttataatatatttgttctactccctttgtctcataataagtccagttgtgggtttcagtgtcaccgtccgtcttattttttattattattattattattattattattattattattattattattattattattattattattattattattattattattatcatcattattattattatataaaatatgaatagttctttatgcgtgacttaatttttaaaaatttatcataaattttttaaataagatggatgatcaaatattggaaaaaaaacgtatgactacacttaaaatgggacggtacttggaacgggaccaagggaagggagtacgttaaaatgttgccacttaaggaaaaaaaacaaaatacctttactccattctacgaaacgaagggccggagcaggaacctaggccctgtttaggacccacataaaaattgtacacctgtcacatcgaacgtttgaacacatgtataaatattaaataaagacttaaaaaactaattgcacagattgcgactaatttgcgagacgaatcttttaagcctaattgcttcatgatttgacaatgtagcgttacagtaaacatttgctaatgatggattaactaggcttaataaatttgtctcccgatttaacgagggattttataattagttttttattagtgtccgaatagcctatgcgacaccttatataatatccgatgtgacacgtcaaaattttataccactactccctccataaaaaaaaaagacaacctaggaggggtcaccctctagtacaatgaatctggtccagatttgttgtacaataaatctggtccaaattcgttgtactaggagggatcatatcttcttctagattatttatttttgggacggagggagtagatctaaacacccccaatcgtttgataccgcataggagtacactgactgcattatgttgtagccgacagacagatgaccacgccgccgtcggcgcatgcaaagagaaaccaccggacggaccgacggtggccggccagacaacacgacgaagcactggaaaggtaaagctacaaggaaagaaccggtactggagcagccgtggcctgtcacgtgtgggtgggtcccacctcccgacacggctctcgtcccatctccaaagcacaggtttgctagaatgatactatcctgtattttggttttgttaaattgctactctcaattaaatccatataaaaaatgtcataaaaacaaaaatatccttgactcctaccttcctctaacatgccggaggtgctttgcctgtggccaccgaactccatgaccgccgcctaggctcactggctctggcatgcgctccattgccaccagcttagagcaaccacaatgtataaaaaagatgaccttaagataatgattacacttgtaaagtaagctatatacattgtggaaagtagcattaacttagggtgcaccttatgcttaagatctaccacaagcaaaaagaaaatattttttttctctctcattcacttcatgaacaagagatgaaacaattatttttccattctatgtgggcccatcttgtggctaaattctaaccttagcattgtgggtatggctttaacaatggctcactattcatagggccaccttaaggttacactacaccacaaacattgaggatgcccttaacccaccatcacttaattccctccacccgccaaaccctagttgtgccgcctaatcaaagccgccgtcgttgtacatctatcgtcgtcctgtgaccctcttgtcctcggccctcttcagcagcccgcaggtcatggtggtctgtcgtcgcgccgatgcagaaggagtgaggaagatagaagagctaggcatgatgtactcatccgtgtccctcttcgacgaggtgcatttcaaattttcagttcactcatatgtcaaagggtattctagcatgtaactttttttttttgtgaatatcaatgttgaatagttctacattgattgtgaaagggtaaatgatctaagatataagttggggaacccctcacctcaatggctggcttttggggtgggaaatgccctttacgatcctacaattgatatcagagcctggctagtttaacatctctagcctgatggacccaggctagtttaacatctctagcctgatggacccagtgtgtgaaggcctgatggaccatgggtgcctgtggagcccatatacctgatggaccgtgggcggggcccgtatacggtaaaggggcgatgaagggctgagggacacattggcccgatgaacacagtgtgtgaaggcctgatggaccgtgggtgcctgcggggcccgtatacctgatgaaccgtgggtggggcccgtatacggtgaaggtgcggtgaagggctgagggattccaatgtgtgaaggaggagattgttgaatagtcctacattggttgtggaagggcaaatgacctaatatataagtgggggagcccctcacctcattggctcaatgtctagtttttggggtgagaaatgccctttacgatactacaatcaatttaacaaagccgaattttagcgtgtactacataatattttttgggaatatcaatttaacaaaatactccctccattccaaattaatctatatatttcataggtacaccaagaccaagaaaagctaataactctctctcatactatatttactatagcaacaaactcaatgcatgcaccatccccactattttctagccaatagcaaatcaaaatattgcatgtgggttataaatacatgtgtgcatggatgcatgcatcaatgtccatttagagcaagtttaatagtatagccaactactagctccaattcatctatagtcaatctaatagctcattcatacaatagttacatactccctccatctacttttgatagtcatatttcatcttggcacacagaccaaggataagtaattctacttatcatccatttaaacatgctattagttattcatcgtaaacaagcgattcattaatatttacatttctcaatgcccatgtagccaatcatgtgtgaaagaatagagagtcatgcattaaattcgagaaagtcattaagatgataggttgttggattgaaatatgcctatcaaaaataaaattttcagatttggaaatatgactatcaaaagtagatggagggagtactacactattaatacctggtcccacctgtcataaacacgctgcgtcttggagtccgtactatagctggctattaatctgtagcccgctgcccatctctctccttatttatctccttaaaatatatttgcatttggcttatagcctgctattgtccctgctcttactccaatacacaaataacgaatagacctaataaatgaatataaatatgtagatcatttagaaataaccttaaaaaaactatatgtagattaatttggaatggagggagtactatttggcatactacaagatagtattctcacaagtcagaagtcagaaaacccctgttgaatgatggcaaactagcaattttctcctcgatgaaagccatcggtagtggcccgtgctagctacacggaggaattaaactcggcctcgttccccgaggtcaaggcgtcacgcacgtactcagccgcggccgtccattccagctcctgccgcgcatcgatctccgtccagccccccaagtgtagtgtcaaccccgcccctgctgctgccttgcgcccagcgtactccttccgtttcggtccgtgtgctgcagcagcacagcctacccgtaggttgtacatctagccctgctgcccctgttacgcaccggatcctcctcctctaggctgtgtttagatccagtttggatccaaacttctgtagtttttcatcacatcaacctgtcatacacacacaaattttcagtcacatcatctctaatttcaaccaaaatccaaactttgcgtgaactaaacacagccctagtagtggtgtgtttaaagatcctcgggtaaagtttacattaggccgtgtttagttttaaagtttttcttcaaacttttaactttttcatcgtatcaaaactttcctacatagtagtaaactttcaacttttccgagtttagcttatgccgtgtttagttttaaagtttttcttcaaatttccaacttttccatcacatcaaaacttttctacacatatagtagtaaacttttaacttttccgtcacatcgtttcaatttcaaccaaacttccaattttggcgtgaactaaacacagccttaccgcatcggatattatatagagtaccttatggtgtattcagcactaacaaaaaaacctattcattaaacaacgagataaatttattaagcctaattaatccgttattagtatatgtttactgtagcaccacattgtcaaagatttgtatcgcaaagtagtcgtaatctgtgcaattagttatttctttagcctatatttaatacttcatgcatacatatgttcaaacgttcgatgtgatggagtgtaaaattttggggtgtactggcctagtctcagcatgcacatacacacaagtcatccgggagaagaaaaaaaaagacacaaggcagcaagagagatcagagatgtgcaagtcgcatgtagttgtatactactagtactagactgtcactgtagagatggagatcgaggagctcaaccagtagagggatggccgttgtcactgttcaccacattccggaacgggactcccgcgacatgccactccggcgagatcgctaccctgcgcccacaattcggggctttcatttttcctaggccgtccgatccgatcgtgcctactctctccctctcctctgttgaccgcccacttgctgtcacccgggccccccccccccccccccccgttttccgttgaggagtgcaccattctagtactgccactactgtacacatcactgttactacctcctcgctccaaagtggtagtgttcccggtgttcaatggcgttcacatgcttcaatgcgccggctgatttggcaagttcacgaacgccttcatccgcattcactacctctgcccagggcccccccatcacacgaatgaaatttcgctctccttggattggattttgcatcgatccttcctgcattccttccttcgcctggccatctccttcaattcaattcaattcatatgccagtgtctgaactcacatctcaattctcacaccattcttctacacagagctagttggagcttggaggaagaggaaccccgtaacagtaaatgccagtacacgtgtaaacccaacgccagggcccctacaccaaccaccaacaatcctagtagcagcagcatcatgaaccatccctacaatacgaggctactgctgctactactactccgcccttcacatcccaagaaaagagggcaccggcatcacatcgcatcacataaacactcccttctccaattaatgccacacgcaggcaaaggcacaaagccccatcgcgtcgcgtccatcgcatatctgtcaacaacacagacttcatgcagaggaccacggtcttttgcacaaaacaccacccccacccctacctttgcctccgccgtatacatgcacgccaccaccagattgccagcatcagcatcgcagcggcatgattcacccatcaaccacacacgacacgagccacacggtgtggggaggcagcaatggttgccattgcccttttgccaagatggcattccgttccacatgacatggaactgggacctcctcctcactgcctcacagggctcagcacaggggccaaaccacatgcaaaagcttgagccaaaaggagaaagcaagcaagcatgcatgctttgttgctgcaacgaacagtgtagcaaacctgcaatcgtagcagaagcaacaagacgaagggcgaaggttgaaggacatgtctacagttgttaacttgacccgggcctgagacgagccagagggggggagagaaagagaagattccattttagcctcaaaagtgcaattaattccacttccgacgagctgtcacccatgcatgcaccgattgtacttacacgtgacctgattcattcccggttttgctacaaccaaccaccacctcaaagcacagtaccacgagagggaagcacaaccaaagagtgacaaaaataaacttgttccatccgcgccaaaaccacccgagagatttgagtaaaacagggttaattacactttggtctgcctgacaggcaacttaacaacaacattaagctgcatgcaagaagcaggaactactgctaacgctatactgcaggtctagtagtagtataatgagggtttcatacatgttgggaggagtacgcactgcgtgaggcgtagcaaatggtgagctgttgttctgtgagtgatactgacatggggtcaaaaaaaaagaaaagaacaaaaaaactagtaaggcaagagatgtcactagtactactgtttctctttcgtttcttttgttttgtctactttttccttgcggcgattgacggcggctatggggcggcggggtcgacgacgcaggttgcgacggagacggagagcttgtaggggaaggagttggtgtactcgaaggagacggtctcgccggcgaggagcgggcggccgtcgttgaggaggcagtcgtcgtggccgagccggcggaacacgcgcgggtccaccaggctcaccgagctgaaccacccgcaccgcacgtggatccccgcgatggcgcactcctcgtcgccgccgccgccgccggcgcaccggttcatcacgtccaccgtgtacgccggcaccccgctcggcagcggcgtcgccctcccctggtagatcgcgatgtcgtccgcccccgcgcacccgtcgtccacccggcgcgtccgtactccgtctcctcctcctccgccgccgctgccggagacgaaaccgacgccgacgacgtccgcgcctgcaaaaagggtgaaagcaagcgggccccaccggtcagtcactgcatgcatgcggcgacgaaaaactgagagcaccgcagacacgggcccacatgtcatgctccgatacgacagaatggaatgtgagggcgacggaatcatggcgcgccaaagggatcgtctcgtctccgaggacaaaacaggaggcgtctccgtggaccccacatatcaggctcccccccctctggcccccacggcctgcgtcagaggcttgtcggagaaagcgccggccgcgtgggccaagcagcagccgtccgatcggtcaatcggacggcgagataagcatcgccgagggaatcggggataggaagcttgcttttaccttgcgggcggaggagcttgcggggggagaggacggcgggaggcgtcgccggggccggagaaaccgccgcgggaaccggggcggcgagcggcggcggcggcatcaacggcgagagacctgcacaaaaaaacgcccgcacgattagacccccgccacacggcgacagacacgtgggaccaacccggagtgggccccaccccgtcagcgacacacaaaagcccaaaaacttcaccccacgcgacaaatccacgacgcggcggcggcagtagcacacagtgggagaacagcgatacgaacagagcgaaatcaaccaaccaaccaaaaaaaaaacatttcgaatccatgggaatggatggatgggtgggggtgggtgggttggtggtgggcccaccgcgctgcgcctctccttgttcgtatcccaatcttggaaaggaaggcgcaggtcgacgtggaggcatgaacacgatgaacagtagcagtacaatgcaaattccagaaaccgcacggatggagggagagagagagagatctcgtccgtaattattaatgatgctcctagtgatgcaaaactaatggtgcaaatccattgcacccgtgcggtatttcgagaattttattcatacaaaaatttttagggagaatgatctcatcgaaacggagccaaaacgcagagagatttgacgaggaaaggagtgcgatttttttttcagaaatatatgtgcagacaaaaaaaactggcgaatcatgtgtgggagaatcaagcagcagcgcacaggatgaagcggggtggttttggaatggtgcgtcacctgtgtcgtcgttggaggatgcggcggcggcgagggcgacgtcggagcggagcatggcgagcagcaccaccgcccacgccgcggccgcgaacgccggcggcggcggcgtactggacgccgaggagaccctcatcgcgcggaaacccgtgcgcacgaacgcctgaaacaaaaaactccggggggtcacgagacagatctgccacctccatggctccatctgcaacgaaaatactacacagaaaaggatgcgacgaactagagcatcggcggagaaaccaaaaaggcccgcagaaagcttgcgagagagaggacacgcagcggcgccgcctcgggccacgcgcccccttcccccgctcctccgcctccgcccaaaccgacgcggacaccatccctcccacccaccggagcacgcgtctccgggagggagacgagaccacactcgcacacctcggaaccctcgcccgcgtaggctcgagaaggagaaagaggaggaggaggtcggcgcctaccttctggtggatgacgaggcggaggcggcgacggaggccggcgacgagtggccggcgaggacgcggaggaggaggaggagtagtagtagggtttgggcgcggcgtcgctatccccctctcccctctcgcacgtgcgcgcgcgcggcggaagcgggcggcgaaacgaaacgaaaagaggcggtgtgaatggacccagaggcctacataggcggcgcggccggagcggatcgggaggaggcgtggcgtcgcgtgttgtggtcgagtcgaaccgggccggcgcggtggagagagagagggagagggaggaggggaccgacccgacagggaccagaaggaagtgatccggtctggcccggttctggtcaaggctgctgcacacagcctgcacagggagggagggagagagaggctgggtaccggtacatggcactgtgtagtgtggattggcctttggaaagtttggggatttttgggcaaactttttgttggtttgaattctgggtttcttttttgggggattgggtttttggtggccttctctgcctcctcctcctttcttcctcttgtgcttttggaagcagagagaatgttgaatcggtagaggagcgcagccatctctgggaggaaacaaaatagaaggaatattatgttagagtgctcgttggaggttaatttaccaccctcatgcttcacttgtcacaccaaattcagtaaatcaacagtccgacctgtagtatgataagtgaaatattacgcagttgagatgtaggctgtgtttaattcacgtcaaaattggaagtttggttgaaattggaacgatgtgacggaaaagttggaagtttgtgtgtgtaggatagttttgatgtgatgaaaaagttgaaaatttgaagaaaaactttggatctaaacacggccgtagtaaagggtgcatttatgggtgcacgcgtgtgaagaaagagactccggtagcgacaaatatcatgctaatcttgtagctgatgattaccgcgcacagttggcctcgtttgttgcttttgttccattcgtgtgtcttcattcctcccatcatgtaccactaacactaacgattgcatacgtggggctttttagaacacaaacaaaaaaaatgttggagtgccttttggaagcttaatactaacattgctaacttgtaatgctagccacctattaagcaaatcaaaagtttgaggctggactatatcgtaaagataaaaatcacatggaaatgcgataaaaccatgcattcatgggtgcatgcatgtgaagaaaaggaattaggaagtgacaaatatcgagtttatgactatggttgaactgttgtatccttgcaccacctgttgtaccctcatttgttaaatgcttggcatgcatcatcataggaaaccttgtccatgattatggattaaatggttccagacttatggaacaacacacgattcataagtacgacacaaatttttagattaatttggttgacgatcctaaccaataagatcgattatgggattacaccattcatttttgttcttagtttcttgaattaggttaagtctaatttaccacacgactattgtgaaaaatatgatttaccctcctaactataatttcagacatttgacaccctcaatctatttaatctagacgaattaccaagcacgcaaacaaatagttatataacatgtgaaaaacaaacgatcatatctacaatcactgtctaaaaaaccagcgtgatatttatcacttttaggttccttttctctatatacatgcactcacgaatgcacactttgtcatatttccatgtaatattgaccttctacactacaggtcagcctctaccttgatttgccaagaggttgctagagtgacgttagcaatgagcgataaacctccaaccataacttcaacatttttctacaatcttcaaacaaataaggtaatacggatgtgatcgttggcggtacgtacacgatcggtacagtgaagacacgtgggcatatttgagaggcggtgactagtgacttggttgttttggatgtcgatccaacggtttagggcctgatggcctgttccgctttagtgttaaaatgaaccattttaaaatttggtaatactaaaattttaataaattagcagtattacgaagtagtaaatgtgttactgtcaaaatttcttagtagtagtaatactacaattttcttcctgcattccacccaaagcatagacaaatcttgggcagaaattcagcgagtgattgtgtgtgtgtttgtttacaaggaggagcagtgtctgacgttaattagaagccatcatggtgccggccttcgctgcccctgcccctgcccacgtggaggaacggttcgggccaaagcgtgcatgcaacctgaaccaaagcttgccaaaaatgtggcaacgagagaatcctctcccacgaacgggtgcgtcgctggagacacaccgtcaataatagtagcagcgtgtttcatcggattttgcttaaactctgtggggattgtcttgatcagttggttggttagttcaaccaagttttattttagaggggcaaaatcagttggtttctctttgtgagtttgaagacgtgtgaattaatttggtctgcacgtgctgagatgttcagggtgcctgccatttggtctgcctcttgctagctccgagtgattggattttgcacgatgttgggaaggtgagggtggatttgaagtagtgcagccattttcacgaggaatatgtgggagtgcttttttggaggttaattcagtaaatcaagactcagacctatactcctatagtaacatatggaagatgggacaaagcgtgcatttattactgtatacatgtgaagaaaagaaatccagtagcgacaaatatcatgctgatcttaccgcactataaaaaacaatttttctgtacgagaccctcgttaggttacaacggaccataactgactacgtctgcaaaaatcgaccaccattttcgcatatggtttcttaagataacataagcacccgcacacaaaaatagtgtcttttgcagacttttggcgcgtgcggtaggactaaccgcacgcggaaacctgtttctgaccgcgtggaaaaatgtctattgtaatagtgtcgttggtgactaccgcgcacggttggtcttgtttgttgcgtttattccattcgtatctcttcattcctctcaccatgcaccactaacaatcgcacctgtacatagaataaaaagaaatgttggagtgtcttatggaggcttaacactaaaattactaacttgtcacgttagccacctgtcaagaaaaatcaaaagtaaaggctggaccactggtggagaaaccctttgtagtcccggttcgtaaccctctttagtcccggtttccaaaccgggagtaccaatccgggactaaagatcgctatctttagtcccgggtgaaataaccgggagtaaagatcgatctttagtcccggttggtaacaccaaccgggactaaagatcgagctgaccttttttttttttttgcatgcccctgttgctgcatggtttatatatatatatatatatatatatatatatatatatatatatatataaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaacgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgtcgggccctttgaatctccattctacaacgataaatgggagtatattattttctatggtctacttatatacaaggacctaattaattaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccaccttttcgattggtgcgactcttagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatattcttttctggacttcgaggcttgaattgtctcttgacttctgatgcaacgtaagcgtcaagctcctcttgcgtgcaatcgtaccccgggtccttgttcttggcggcgtcaactttcgccttctttgttgcccttgtgtgggcaagcggtggagctgggggggcccttgactttgaaggtgccggaagaggagcttgcgggggagtaggtgtaggagcacgaggaggagtcggtgcaggatcctgaggaggagtcgatgctggagcctgcggtggagacggtgctggcggagcatgaggaggagacggtgcaggatcctgaggaggagatggcagagccggaggagatggtacacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttggagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgcgatcctacctgccccgttgaggcgcagctgctacggtttcctgacgggctcaccattgcaggaggaatggtcggctggggatcatgggaccgatgtgcggccatgcgttcatcaaccttccttgccacctcctcttgcatgttgagttcgtagctcgatacccggaactctaggtctgcaatcttcgcctcggtatctctcttgctcctcatccgactcctgtacgtgtggatgtcctccttgaaaccaatcttccaaggaatcacccctttccctcgagttcgtcctggatgctctggagtctgcagggcgagtgtcagctcgtccctatctctgtctggtcggaacgtgccctgagaggaggcttccactgcatctgttagtcgtcgcgcagcctcttgtatctgatagccgaagaccagtgagccatcagctgggttgagcgttccaccgtgagcatagtaccagaacttcgatcgttccggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcacctgcccttgttcacctgtcttatatgcaacgaactcgtcccagtgatcccttagctttgggaatgtgtcgaagttcggtgtctgccccttcagtatatacttctggtacagatctcccttgaagctctgaaactgttctgccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccgtactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacatgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtatatgctaagtgtttcgtgcgtatatgctaagtctaattaagactacaatagtcaattgctacttgtcgcaccaattccgtagtcaataattacatactaagtctaattacaaataaagtaatcttatattaaaactcaaataatattacatgctaagactaaaatagtcatgtatgctaagtgtttcgtgcgtatatgctaagtctaattaagactacaatagtcaattgctacttgtcgcaccaattccgtagtcaataattacataccaagtctaattacaaataaagtaatattatattaaaactcaaataatattacatgctaagactaaaatagtaatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataatattagaacactacacaatcttatatgataagtctaattgcaggtctaataatcttaattaattgcattacaaatataacaatcatttatattattacgtcacttgcctgctcgaattccttctagggctagctcttccactcaggcttgacggacgactccgacaacacgtcttttctgcaagatacaaaaaaatgtattaggataaatgcgaagtaacatatatatatatatatatatatatatatatatatatatatatatatatatatacatatatacatatatatacatatatatacatatatatacatatatatatatattgcatttcacgttaacgttcgtcctcgttcgttcgctcgttcacgttccctagctcgttcacgttcgttcgctcgttctcattcacgttcgttcgattgttctcattcacgttcgttccctcgttctcgcttgcttcgttcgatcgttctcgttctcgctctcgttcgttcgatagttctcgttctcgttcacgttgtcgcggcaacgtacgttgacgtgttcgttctcgctctcgttcgttcgatcgttctcgttctcgttcgttaacggcggtgtg

SEQ ID NO: 59683 - DNA, 532 bp, Oryza sativa
ttttctgaccgttactgccgtgctttaaatactaaccgtcaccctcgagaaacctcacaccgtgacttctgttttctctttcttctccggcgactcctccggcgcaaaggcgatttctaggcgacttcctcctcgacgagatctccgcccgcaacaatgtcgtcttccgccagcccatctggtgcgccatcagccgaatatgctgaggtaagttctcatcggctaaatccccttctttagcagcagatcgatcttctcttatctcatattgctctcttcctctgaatctctttggatttgtagcacctctccaacctagttgcaattcccaacctgtcgcatgaaaaccactactttctcggcccagtcggcaatccagaccccgccgagttcactattggtgaaaccaataggatccccttcagattaaccaacccagatctaggtcactagaagaataccttcaagtcctggccgtctctagagaaagttccaccagaaaagagctggactacatggttcaaacgtgtat

SEQ ID NO: 59684 - DNA, 2828 bp, Oryza sativa
gccaggtccctacgacgggcctcgagctgtgaggcgtgccggcggtgtgccttgcggcccgcctccaccatggcctccaccgagcgccgcccctcctcgacgcgcgcccacgccgcgtcgagctccgcccgctcctcctgcagggcctccatctgggcacttaacccgtccagcaccgtgctgttcgcggcggccaaggcctgcaggaggggctccgcgctcagtggggcagcggaagacagaggggagagccgcctcggtatgggtgccgcgcggctcggcccgccgattgacgtgccggactcgggggcgtcccccgaagctggctcgtcccaagcgtcacccgaggggtcgggcccgagcggcgcgcccgcagcctcgtcgtggttggcctcggaaatcgtcatcgcctcgggcggagtcgggtcgggggtgtggcaggctgcctggcgtgcgcgcgccgcctctgcctcccggacggactccccggcccggcggagtctggcctcctcccgagcggcctcctcagcctggcgaacccggacggcctcctgggcagcctcctcagcttcccggaggcggtccgcggcttcccgccggtcagcttcccgcctccgggcctccgcggtcgccgtctcctcggcctcagaccggccggacttggaatggcgggggggcgcgacgggatctcactgaggcagaagaaaaaccagaagacaaaaagaaacgggtgagtgaaaactcgccttgggagatgggagaatgaatacggccgcggtgggcgcggggacgaacctgcggggaggtcggctaaacgaccacctcggcggcgagatgaggttcccccggcatggcacgatcccccccatcttgcggggccgtttcttctttcgctccccctcgggctgcggcgtcggcacggcaccctccgggcgcctgctgctggcacgcaccgccccgccccctcggggaggagatgggggaggggtaccctcctgcttcctcttcccccgggcgtcggcagggcggctgccccccgggcccccgtcgcggggcccagaagcacgaccccctcccggggtagattgttcccccctgcggctcccgcccacgccatcgtggcctcggggggcccgctcccccgacgccccgaccgcctgcatgatggccagaatcttggcgcgctctggatcgcagcagagggggaggaccccttgagggatgagggatgcctccacggagctgagattcagcacccgttggaccaccatcctgaagtcctcagggtcccagtcccatttgcgcccctggtgggtcctcatgtagtcctcgggcccggtgtactcccaggcgcctcgggcgcgccgctggagcggcgcgatccggcgacgaacgtagtcgccgaacaccatggcccccgtgagcccctgggatcgcagacccgccaggcggtcaagaacggcgtcgtagccgtctcccagatctaccgccgcccgccagctggaggcctgcgccgggggctggctcggaagtcggaggtgcgcttcgtcggcgagggggtgtagaaccaatcgctcttccagtcgtcccactttttgcggaggacgtagggaatgtagcggttcagcacctgcccccgcggctggaagtagcagccaccgactaccgtcggcggcgacaccggctgtacggtgaagaaccaccggaacagccggagaaatgggcgcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcatgaatcggcgcggcagcctggcctgcctctcgctcacgatgcgggaaggcggcagcacgctaccgtcgagcggtgcggagccccgtgccatgacgccggcggaggaggagcttgagagcgagcgagtgcggcaagggtagggcacaggaaacgaagagttagagcacaagtggcgaaggcaaggggaagagtggcgagaggaaagaaacgaatccctttctcggcgtctttacacccttgccaacgctatgcccggctcctcgcttcccgtgcccactacctcgccccctcgtttctcgcgcccacgcctccactaaccccactcgcccgtttgcggcgcacgcggcaaatgtgcggccgtggcggttgagatggggcagattgtgcgcgcattaactacggttgccaaccgtgaaaagcgccatcatcatgtctccaggcgaaacgaaccggctcatcccgattcgcgcgctgctcgagtaatgtagcggtcttaaagaggccgctcattattgtcggtcggttttcccttgccgatgcgcgcgatttgcgaccgctgggtttctgtccgcctgtagggaccggccccacctgtcaccgggcctaaggagtggcgtcacgcccgagcgcttccctcgaggggggcgatcgccctggcgtaacgccgggggctactgtcggtgacatggggccggaggtatcgtgactagaggcttgggtagccgcggtcacccacttggcctgaccccctcgggggggtcgggcccgaggatgacgtggccacccctccctctgtctccccgaggggtcggaccgctcccgtttcggccccgagggctggggcgccccgaccccctgtggtt

SEQ ID NO: 59685 - DNA, 1353 bp, Oryza sativa
  unsure (1)..(1353): unsure at all n locations
aataggttaattccacccaatgacattcgaaaataaatgcaatagttgaatagaaacagtagctttaaacgggatcaacatgctcaaagggttgtttgggatctgtgtgacttgccttgctggccttggaactcttcaaaatcttctcctgcgaaaacagactctccggaaacgtcggaatctaaacagaaaggagcaaaatcaccaaaacagcacataaacaagcatgaacagtacatgtggatatttttaacatgtagatcttaattttagaaaaatttagagacttgaaccaactaaatccgagctaagatgaattagttacgaatttttaaagattaattcggattaaaacacttatatgaattttaattatgacgcaataatgaattatttttgaaaaggaaaagggaattattgcgtcagcggctagggtttgcggtggaccgggcgcacggcagcggttcacggaaacggacggccgagatcgatcttatccaaaacgaacggccgagatcgaccggtccacggccggaccacgagagacgacgacgatgacgtcagcggtgacgtcaccaccggcggcggctcgggcttgcaaactcgccggcgaacgacggcgcgacgacgcgaacggagggcaccagcacgtagagggtgacgcggcgaactcaccggtgaccaaaacggcggcggaagatcaacggacggcgacggcgtcaaggaagaagcggcggcgaccttcggcttgacgacggcggcggtgttccggcggtcgacagcaacggcgaaggggcggacgaggacggcgacgcaacggcgaccacgatggcgacctccccgagcgacggcgatgactggagcgatggcggagcacggctggagcacggtgacgacggcgtcgcgaggctacacggggctagagcgctaccgacggcgagagacgaaagcaaaggtggcgacgggtagcggagacaccgggggtccttttataggggttggagggcggcggcgaaggcccacggcgaccggcgacgcgaaggaaaggttagggttcggaggaaagaggccgatccgaatcgaactcgaatccacgaatttccaaagcgatttagacgatgtttccaaaaaggaaaaggtagaggagatctcgggaaacatttcccctcaatggatttcaccagagaaggaaaggggcggccgaatttggaaggaaacggcggcacggctcagctagggttcgggcggcggcggcggcggcgcgaggttgacnacgaccctgacaggtggggcccacctgtcagcgggagagagagagaagagcagcggctcggttgcggactgggccggctt

SEQ ID NO: 59686 - DNA, 3025 bp, Oryza sativa
aaaaaggaggcccaggcctaggagaaaaaaggagggaaggagggggaatgggcgggagagcctgaactctctctcgctctccggctctctggattccttcacgcacagatccaccagaacacaggagtagggtgttacgcttctcagcggcccgaacctgtctacgtcgctcgtgtcttgtgcatttcctctctcgctgacgttcttcagatcaagggcgaagaacctcacgtagcgcccccggccgaaccggcaaaggggggcctgcgcggtctcccggtgaggagccccacgctccgtcagccctaatccagttggtatgggattatatgatggacaccacagattacaaagggaataacagaactcgatgataccgacgagaccatagtcgagttggtccgactagatctcccggcgacttgactcctgtaggctccggctccgtaggctgtgatgggtgtgttggcggtgagattcgatgccttaggtcccgcccagggggtcccttatataccgcaggtcagttgatctccaagtaggactcggagatatcggagtcctcacgatatggtaaaaacccagcctcatccaagtaggactccttccaaacgtagattctgcttctatcgcgggatagatttccttaatgtattcggaaactattcgtacacgcgcgggtataccgtatcggtacccatcgtatatccgaggatagacggtataccttatccataaccctgacaaactctgtatatatctatgattatacatggtagcaaactaaaataataaaataataaagctgcactaaaataataagtgttcttttaaaataataaagatgcacattgaaacattagaaactcatataaaaagcgttcgaattgcagaagtggtgtgtgaatataaattttcccttccgctcacagaagaatagaaaaaaaagaaaaagttattaattgaaatctctattttattataaaaattaaagatgtttttacctgtactttagtaaatcatccgtctatgagtcgatttttaagttggttcgcttttgaaaatacaaatccgtattttagttagttttcaagctcgttcgtttttggaaatacaaatgaagtcgtataagaaatcttttaaaaaaaaacttacatgctaacttgacacgatcaaactcctaattacagcttataattttctaaaaagatatatatatatatatatatcctatttctataataaattttactttacctaagctaataataaaattaaaatagctttcacccacgggcgggacattttttctaaggaaaagagaggaaaaggcaacccctttcctcgcgcgcgaccgctggctggcggcggagccgacctcacctcgccggagtttaatcccccctccattcttcctcgtcctgattgccaacgacggcggagagctcgccggtgcccgacgtaccgacggctcgatcagtccttcccatcctctgttagcctcgcgtgacgcccgcctgcggtggggggaagaacctcgccgtcgcacgcgatggcggggacgccacccgatggcggaggagataggccgtgggagtcgtaccacaccgcctacaccaacgccaaagctggtgagtgtgcatttcccctcttcccgtcgcgtaagattgttgccagtagggggtagggttttgggcattagggggtctgcatcgcgcaaatcactggtacaaataaatccaaaagattaaggtagagagaacacgaattagatggagctttacttaggaagttatattacatgtttaggtgaatatgtgatatctgtggaaacaacatggaaccccagtgtgcaaagcatggctttggtctttattctcttgttattctgccttaggaatggagggagttgacaaagagaaggtgcagaaggtaatctacgaaatgagcaagggttcaaaatattttgaaaatgaacagaggaaagaggcaattaccaaacaaaaaatcgaccatctgcgtgcacaatgtgcaaagctgactgacaatgacatatcacattttcagaaggtaaagagtatttttttttaatgctggcctttgtctgtcgggtgctactttgttaattttaatgccatatttgaatcctaatttttgcagcatgcttaattttcaggtcgccgaacataaaattttggagctggaagcttcacgggatctttcaaagatatggcttcacaccgacatggatgccttttatgctactgtcgagatattggaaaatccatccttgaagggaaaaccattggcagtgggtagcatgtctatgatagctactgccagttatgaggttagcatactaggatttatgacatcttgacatgtgtaaggaattttttaatcactaaatagtgttggtgctattgtataccattttgttttggtccctattgaaatgattactgaagaatcgctgatcatgttgtgtaaaattagctttctttaagcattgtagactggatggacctgagttggtgttgcaatttatttatttattgaaagcacaatcaacatcccctgctatatagtgtagtacgtaatcaatttacttattcaggcacggaagtttggagttcgtgcagcaatgcctggttttattggctgtaaattatgtcctgagttggtttttgtccgtccaaattttgagagatacacttattatagtgaattgacaagaaaaggtttgtacattattactgtttattgaattaccatgaaatttttttagcgtatcgtaattgtattaatttatcgcttactttgtagttttccaaaggtacgatcccaactttgttgcaacaagcctagatgaagcatatctcaatattacaaaagtctgcttcgatagaggcattactggtgaggaggtaattatcatgacttcctggtgaattacttatgactaatgaaataaatatggtttgatttgtatttgatggcttacattatttttctacaatccagt

SEQ ID NO: 59687 - DNA, 1860 bp, Oryza sativa
gacgccgccgtcgtccgttcatcttccgccgttgtttggtcaccggtgagttcgccgcgccgcgctcaacgtcctggtgccctccgtttgtgccgtagcgccgtcgttcaccggcgagcttgcgctcccgagccgccgccggagatgacgttgccgctgacgtcatcgggaccgtccgtcgtggcccggccgttgatcggttgatctcggtcgtccgttttggataggatcgatctcggccgtccgtttccgtgaaccgctgccgtgcgcccggtccaccgcaaaccctagccgctgacgcaataattcccttttccttttcaaaaataattcattattgcgtcataattcaattaaaattcatataagtgttttaatccgatttaatctttaaaaattcgtaactaattcatcttagctcggatttagttggttcaagtctctaaatttttctaaaattaagatctacatgttaaaaatatccacatgtactgttcatgcttgtttatgtgctgttttggtgattttgctcctttctgtttagattccgacgtttccggagagtctgttttcacaggagaagattttgaagagttccaaggccagcaaggcaagtcacacagatcccaaacaaccctttgagcatgttgatcccgtttaaagctactgtttctattcaactattgcatttattttcgaatgtcattgggtggaattaacctattgtttgttatagccctttttgttcttgattactttattccttgataccttgggttattataatttgactagttgggctatatatattggttcagctagatattagatgtgattgcttagccatgcttagaaacattagcacactattgggataacttatgactcactattatttaatgatggcttaatgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgcggagcaccagactgagaagtggcggagataagcccacgggggtcgctggggagtccatgccttgtttataagggggtgattatgatccaggaaaggtgcgctgtggtggattgtgttgtgcaaggggtattgtcacagctcctttccgaggtaccgtggtggtattgaggcacatggtgacatgttgtgggactgtgtcttgtgggtacagtggtacacctctggccaaagtaaaactattcgaatagccgtgcccgcggttatgggcgggttgagcaatatttttcatgattagtctcacacctctcacaataattatggatgttatacctggtaataatttgcttagctcctggtttagagttagatctgtacagccgggtatggttgttcaggatggttgggcctgtgcagcatgggtgtgttgttcagtgttgattaaaatttctgattaattactccactggtttatttctcttaaatgttttgctaaatgctgcttttgcaaatgagcctatattatgccatcctttggtatccttgggcacttgcatatttgctgggtggcttgttgagtatgtcatatgctcattcttgcaataatcaatcaacctcagttgaagaaaaagatctaggaggagaagacgtttggcttataccccagttgagctgcctgtgggagtggagccggagcttcactagattttattttccgctgcagttttcttcatggtgaggac

SEQ ID NO: 59688 - DNA, 12003 bp, Oryza sativa
atttcggaatccatggtttgatttgcgcggatttggaggaggaattcgcacgggagggagagaaggccgtgcgggaggaggaagaaggcgacggcgccctggcgcgtgggccccaccggtcaggcggcggcgtcagcgcgcgcacggcgcggacgtgcgggaggggagcggctcgggggctggggcggcttgggccgagcggccggcccaagaggagaggaggggaggcggcatgggccgagcaggccgggagggaagaggggggggaaaaggcagcccgagagagagagggaggagggagtgggccgagagggggagaggcccaagaggaggagggagagaaggagagggagagaaagagagggaggactttgggccaaatttggcccaaaagaaagaagaggattatttttagatttttctttttaataaactttgacaattgttgttgttgtttaataaatatttccggtgctctgaaaattcaagtaaaatttgagggctcattttagaccaaggagaatttaacaaaaattctccgggccacattcgaatttttcttgcacgtattttagtgtttgccgatttcttttcgaattttaattaattctattattccttttagcgaatgaatttttaattttgggatgaatttatcaggacgtgacaaatccaccctccttacaagaatctcgtccccgagattcgaggaggctagcaagaagataggttgggcggtcttctcttattgtctgacttcttccgctccgtcttctataacaaacttgcctaacaaaacttcttcactctggactgcttggctcgatctcctgttgcagatggaatcttctcttcacctgacttgtccctggttgaacctttagctgacttcgactgggttgcggcacttgaagatggggcttcagttccagaactttgcatagttcatatctttggagtcaacctcatacaagttacccacttcatgtcatgcgtcgagatcagctcgtcattactaagataccatgcttgtcatcatttagcattcaaagtattcctttacacattcagccctgacgtattctttttagatttctcttatcaatcacctttcgacctacttctttgcctggtaataaacatctttttcgatatcttctatcagtcatcttttgacctctggagaaacttctcttgtttgtcttcatccgtttccacatcttctggtgcatagtgagccaaacgatagaactcgtgccggtactctgtgacggtcaaatctccttgcttcaggtagcgaaactctcgttttcttagtgtgatcattcctgcgggaacatgtgatctcctgaatacagaggaaaactcgttccaggtgatggtatgtccttctggccgtgatgcctcgtagctatcccaccactctgaagccggtccaaccaactgatgagttgcgaagccaacccgctcctggtcggtgcactgaatcacccctagcttcttctcgactgtgcgcaaccaatcattggcttccataggatcgacggccatggcaaaggttggaggccccgttttgagaaattctgataacttgcactgttgctggactgtaggtacttgaacgttggttgcccctgctgggttgttccgattctgtaatagttgaaaggcggttgccaacatgttggtttggttaaccacaacttggattagctctggtgaggtttcgttgatgcttctctcattcccattggcttgggttcttgagtcatcggatccatcattcccatagcctttgttaccaatgttatccatctgtcacaaggtagaggttgagaggggaagcatacaaggaaagaatagaccagagctagggacaggaccttaaaggaactaactctttttgttgatgtgttgtttgtttcatttattctgcaagttgattaagcaaacaacctagcatggttacatcaccacccaccgatgcaaaccacgcgctacacacacaagcaaggaaacacacgacaaacgaaacactagagggtggcttaggttctgcgacgggttctccaagatcttcactcctgcttcacagctggcttcactgcttccttcgcttcgctggcggatcctgcagtcttccggagcttcggcaaacaactgacgacatcttcttcttcgcaaagctgaccatctagtacttagttgaaatccgaagaaagaaaagagtaaaccttttgcaaatagcattaggggaaggagaaaaagaggaactttcgcaaataattttatttataaaatatgtccttaggttttatccatttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcacttaaggcctgacaatcaaaaataaacggcagcggactagcgggcctacggctccatcttcacaggcgctcaactggggtataagccaggactccacctaagacatcttctccaaagcttctcttactgaagggggaaaagattgagcaagaatgagtacaaccacagtactcagcaagccacaccggcagatgcatgattaatgcaagggggtacaaggggataatagtaggggttaggttttgcagtaaacagcatttaaaagtcacttagttgcccaaagccattttgtaaagacgatcctagagctacacagtattattaaacaaggccgtgaaccctcacgaacctgccttaacccaaggcctacgatgatttggaccgaactggcaacccgacctgggttccagctcgtcccaagccaacccaggccaaccattccatattttagttgtggagcaaattttaagaattaaaacactgacttgggtacattgctaggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcctacctacggccgggatacccgggacaggcaggcagaactgagcccctagcattgggcaccaaccctccgccgtacgacatctcgactaccgggccgcagctcgtgtagccttcatttgccctggagaatgtccatcgacgcccgacttcatccatctccaatccgtgtacttttgtttatgactagactgagccacaaactaagccttacccattagacatgtggaagtacggtagtgctttgcaacagaggcccgagctttagtccttatagtggccggggtgctacttcccacaactggcatgcacccaaaccccaccgaaaacaggttttaggggttttgaaagaggaagagaggtgtttgtccaattccaacataagccaaccattccaaagtgtccaaatgatatgagaattcccaaagtctaaagttataaaaccacctaatgttgcctaattaatcagcgaagcatctacctaaattcatactagtggaaccatgaatagagtacccactagttgaggttttgtttaatctagggtgaacaaggtaataataataacaataacaataataatatggtcataacaaaggtaaataagcatggctaaataaaacagtggtaacgcgggaatttaaataaagcgataatgcaataatttaaatcaacataattttataaaatgggattcaatatgctcaaggatgatgtgacttgccttgctcagaaagaacggccttccgaacctttggcgacgaccacgaaccacgcttcgggaacctccggaacgacgaaagctacgcgaagcacacaagcaaagctacaagcctataaagaagcaataacaatacataaaaacaaagcacagggttctttaggttataacaaacattaggagacttgaacgggtcgattcagagttcgtatgaccgagatatgatcatccgaagtttaatgctgttatatggagatttgcggattattataattaagctttgcaattataaaacatgtgtaagcgctggcctggaaaagacaggaaggctgcgccgttgacatgcggaccccacatgtcaacctaaaggaccgcggtagaccgagtacacagaggcggtccacggtcgacggaagcggatcccgtgtgtcaaccgaggcgagtggccgacaaacggactccactagacaccacacggtcactacccgcacacgtgaacgaccaccgacaccggtacacgggtaccggggccgacaaccgcacaacgggcacgggcgacaccgaaaggacgaggacagggcagcgagggagagggaaccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacaaagacgaggacggggctgcagcggctcgcttgacgaacgcggacgacggacgagaacggctcgacggagggacgaacgccacgacgaccggaaacgacgagaggacgacgacggcgacgaccggggccggcgaggaggcgacgaggacagccggcagcggctgcacggggacgaggatgacgtggaacacgccgctgcgatgacgatgacggaggcggcgccgcgagacgacgagccgggcgagagggaacggtgaagacgacgacgggcaccggcggtgttcggtcggaggggaggcgaggccgaggacgacgtcgcagctgcgatgccgaagatgatgggggtgtggccgaccggtgcacggcgaggagggacgggcggccgaacaactccggcgaggcggacggagaggttcgcggcgacgttccggcgaaaccgagggcaggccggggtggagggcgatgcggcgtcgccgagggaggagacggcgacgtcggccgacgctctggcgcggcgaccggggcagccggaggagatgtcgacgaggaggaaggtgaggccggcgcgggcgacggtgttccggcgatgttcgggcgaggaggaggtgatgccggggatgagagcggcgtcgtggagccgaggaaggtggtggcgacgtcggccggcgctccggggacgcggcagaggcggccggaggcgaaatcgtggcggcaacaccactggacgccggcgaggacgcgtctccggtgctttacccgcgaaacggagggctgaccgagggagagggggcagctgcgaggccgagggagaagacggcgcggccgggcggcgctcgggcgaggagaggaaggcggctggaggtggccggcgcgaaggaaggaggagggcgacggcgggaacgtagttccgggggtctcctcgcgaaacggagggcaggccggcgtggaggaggtggcggcgacgctggaggaggcgatggcgcggccggccggcgcacgggcgaggcggcacaggcggctggaggtcgccggcggtgtgggagagagagggcgacggcggggatggggctagagaccacggggaggctcgggatggggttaaaacgagagaacgcacggagggggttgcattttataggatgggggagggagccgggcacgggagagggcggaacggcgacgggaatggcggccggcggcaatggagggcggccgaggaagacgcgggcgttcccggcgattgggggcgccattcaagggggaaattagggggaattgaagaggagtcaatggggattaaaaccccccaattaatttcggaatccatggtttgatttgcgcggatttggaggaggaattcgcacgggagggagagaaggccgtgcgggaggaggaagaaggcgacggcgccctggcgcgtgggccccaccggtcaggcggcggcgtcagcgcgcgcacgcgcgcggcacgtgcgggaggggagcggctcgggggctggggcggcttgggccgagcggccggcccaagaggagaggaggggaggcggcatgggccgagcaggccgggagggaagagggggggggaaaaggcagcccgagagagagagggaggagggagtgggccgagagggggagaggcccaagaggaggagggagagaaggagagggagagaaagagagggaggactttgggccaaatttggcccaaaagaaagaagaggattatttttagatttttctttttaataaactttgacaattgttgttgttgtttaataaatatttccggtgctctgaaaattcaagtaaaatttgagggctcattttagaccaaggagaatttaacaaaaattctccgggccacattcgaatttttcttgcacgtattttagtgtttgccgatttcttttcgaattttaattaattctattattccttttagcgaatgaatttttaattttgggatgaatttatcaggacgtgacaggcaagaggcctaagccagatccagaggccactacctctgagccgtggggactccggtttgcgcgagccagcgactaccctctacctgccccgggatcctgcggatggctggaggattagactgacggactccttgcagcttcgatctcgtatcagatggtttttggatagtatgcgagacacccccttcccttacctagattgacgagtagtttgatgattggtttgatgtatcgtttggatgaaccttatttggactgcgtatgtatgcagtcaattgcatcatgatttatgtaccatttgtgaaactctgtgatgttatctatgatatctattgttgttgtgttgtaaatgagtttattccaccatgcttgcgaaacaaagtcatatcgacacaactcccttaatgggataaagccataggagctagttagaaaattaggatgcttactccatcaacctacacagatggcaagccgacgtcgggcaacaaccagcaatgacgaaactcagacacccgacttaaacactctggccggaattatggccacccaaactcaacttctgcaagctatcgcgagcaaccaaggcaaccgcggagggtcaagctttggagagtttatgaggaccaagccgcccacgttcgctacggccgatgagcccatggaagcagaagactggctacgcatcatagaaaagaaactgactctagtcagggtacgcgaagccgacaaggtgatcttcgcagtgaaccagctggaaggacccgctggtgattggtgggatacctacaaggaggcccgagaagacggtgctggagaacccacctgggaggagttcactgcagcgtttcgcgagaatttcgtacctactgcagtgatgcgcatgaagaagaacgagtttagaagactgcggcaagggaatacaacggtgcaggagtatctaaacaagttcactcagttggctcgctacgcaattggagacctggcggatgaagaagaaaagatcgacaagttcatagaagggctgaatgatgaattgcgtggacctatgatcgggcaggatcacgagagtttccagagcctgatcaacaaggtcgtcaggctagagaacgatcaaaggacggtggaacacaaccgcaagaggaggcttgctatgagtcgcccacctcagacaatgcctcagcgacttaagggagccactccgtccggatggaagccccctgtcatggtgaccaaccgtcccgctgcacttagcaacttcaacaggccagttgcacttcagaaccgcacccctacaccaactttggctgcccctggggccaagaagaatgtggactgcttcaactgtgggaaatacgggcactacgctaacaactgccctcatccacgcaaaacccctgtccgaactggcgcgaacgcaatgactgttcgcggcactactacccctgctgtcgggcgaggcctattcaagactccgcaaccgaacaggaccaccactggatttgggcgcgggcaagtgaaccatgttcgagctgaagaggcccaggaagatcaaggcgtactgatgggtatgttttcactcaactccactccaattaaagttctcttcgattcaggagcattgcattcatttatatctttgaaagcaagtcaacaacacaatttaaccagagttaaattaagacaaccaatgttagtacattcgcctgggggtgagatagcagtggatacagcttgcattgacgtacccatccgccttagggatgtggtatttccctccaatcttatggtgctaataccccaaactcttgatgtcattttgggtatggattggttagcaaagcatagaggagtaattgactgtagacgtagagaagttaccctgaccacaccctggggatcggatatgagagcaaccatggatcaagatcctaggctaaccgaacgtgccggaggtatatttaccatgctacccctaaagggaatgccagtagtgcagcgatttcctgatgtgttcccagaagatttacctggaatgccaccagatcgtgacatagagttcattattgacctgatacccggaactgcccccatatccaagagaccatatcggatgccggtcaatgagttagaagaacttaaaaagcaaattagggagttgcaagagaagggatttgtacgccccagttcgtcaccttggggagccccagtgttatttgttaaaaagaaagacggtagcatgagaatgtgtgtagactaccgatcactgaacgaagtgactatcaaaaataagtatcccctaccacggattgatgacctcttcgaccaacttaagggagctaaggtgttttcaaagatagaccttcgatcaggataccaccaactgaagattaggaccgaggatatccccaaaaccgcgttttcaacacgctatgggttgtatgaattcacagtaatgtcgtttggtctaaccaatgccccagcatacttcatgaatcttatgaacaaagtattcatggattacttggataagtttgtggtggtattcattgatgacattctaatctactccaaagatgaggaagaacatgcggaacacttaagattggttctccagaaactccgaaagcacaagttatacgcaaaattcagcaagtgcgaattttggttgaaggaagtcgcttttctgggtcacgtaatctcagccggtggagtagcagtggaccctgctaaagtggaggctgtcacggaatggaaagcacccaaatcggtgactgaaatccggagttttctaggcttggctggatactaccgaaggttcattgaagggttctctaagatagcccgaccaatgacacaattactcaagaaggaaaagaagtttgcatggtcggaacagtgtcaaggaagctttgagcagctcaaagaaaagctgacctcagcacctattttagttcttcccgacatcaggaaagactttgttgtatattgtgatgcgtcgaggcaaggactaggaggtgtactgatgcaggagggaaaagtggtggcctatgcgtcgcgacaattgcgaccacatgaggaaaactaccctacccatgacctagaactcgcagctgtggttcatgcactaaagatttggagacattatctgattggaaaccattgcgatatctacactgaccacaagagtctaaagtatatcttcacccagtcagatctcaacttgaggcaaaggcgatggttagaattaatcaaggactatgatttagaggttcattatcacccaggcaaagcaaacgtcgtagccgacgctctgagtcgtaagagccattgcaatcatctgagaacggaagggatggtccctgagcttagggaggaaatggcgcagctgaacctacatatagtaccccatggacagataaacaccctggatattcaacctcttttgagaacccaaatagaagaagcccagaaggacaatgaggaagtccgagaggtgaaggaacgcttagctgccggacgtgcaaaggaattttcaaccgacgaaaaagatgttctatggtataaaaagagaatttacgtacccgaacagggtggactgaggggattaattttaaaggaagctcacgaatcggcatattcattgcaccccggaagtacgaagatgtaccaagatctgaaggaaggatactggtggcccaacatgaagagagatgtggccgaatacgtagcactctgcgacgtatgccagaaggtgaaggctgaacaccagaggccggcaggtttgttgcaacctctcaggattcccgaatggaaatgggatgagataggtatggatttcattgttggattgcccaagaccgcaacaggatatgattccatttgggtaatcgtggatcgactcaccaagacggcgagattcattcccgttaagacaaattatagcagtgcaaaactcgccgagttgtatatgaccaggatagtgtgtcttcatggtatacctaagaagattatatctgatcgaggcacacagtttacctcacatttctgggagaaagtccatgaagccctgggaagttacctcgcatttagcaccgcttatcatccacagacagatggccagacggagagaaccaaccaggtcctggaggacatgctgagggcttgtgctctggattttagcaaggactgggagaggtgtttgccctacgccgaattctcttacaacaacagctttcaagcaagcctaaagatgtcacccaatgaggcattgtttggtcgacgatgtcgtaccccgctaatgtggtccgagactggagaacgggcggtatttggacctgacattattcaagaagccgaagaaaaggttcgcttgatccgtgatcgtctaaaagtagcacaatcacgacaaaagagttacgccgacactcgaagaagaaacctggaatttaaggaaggagattacgtttatctaaaggtttctccgatgaggggaacaaaaaggtttaaggttaaaggaaaactggcaccaagatatgtggggccattccagatcatcgccaggcgaggagaagtcgcatatcagttacagctaccagaatatatcgccgatgtgcacccagtcttccatgtgtcccaattaaagaaatgcttacgagtgccggaagaacaagccccgctggaagagattcacattagcaatgatctcacatatccagaacacccgatccggatattggatgaagcagaaaagaggactaggagcaaagtgtggcgtatgtacaaggtacaatggagtaatcacactgaggacgaagccacctgggaaggcgaagaattcttgaggacggagtacccgcatctattcggcaactggtaagaaaatctcgggacgagatttatttaaggggggtaggtttgtaacaccctgaaaattcgaccaacgaaatcaaaactctaaaaatgcggactttcaaaaactttttaaaccaattgcatcatgccgactttattcgcctgtttcattggattttgatgtcggagtctaattaatcgcgaataatgaataactagctaggaacaaaccataaaataaaatctagttgactaaataaataattaaaatataaattaaaataaaggttaggtgggattgaaataaataaaataatatcgcaaccatattagcaataattaaattttagtacgatggaataaccctaattaaaataaattatataaaaataaaatatgagtaatattaatctagggagaattcattagttaagattacatgaatattgagtaaaatgcatatatgtaaaattaggaatcgtggaatcaaatttatatggaaaata

SEQ ID NO: 59689 - DNA, 744 bp, Oryza sativa
aactccataccaacagtagggactgcaggttgagattggaccccctcgtctttagtctctccatcttcacgtccaaagtcatcttgtatttcaaacccatcacctgtatcaatctgatcaatgctcatggcacctgtaaacagcccagtttcaagcagtacttccctcaacatatcatcatcatgacttgcttccctcaacacatcatcatcatgacttgatacttgctccatctctctttcaacacaaacatcatccttgtcactctgttgctctttcatacttctttcaccaaggacatcactcccctcatttggtacctcttccataattcttccagcagatccaactgaggaattcattctgcaggtaagaagaagggtcagtaccatattctgactgaagaccgaagatgcatcatttctataattctgttttctgtggacagtgtatgtcctacataactcagttgagaaaattgagatagttttagatagtgtgatttcagttgccaattcacatgattaatacatggtaagaagcatttgtttcttttttggcaccatgaatcctgctagtacaaccatgatatacttgctagaatgtgaaatgtacctcggtttttatttttgaaccagtttttatacatacattcagcatttcatttcatgttcaaaccaacaaattgccgctaatgatgaatgcacaacatggtacacagtggttgcatgatggcactgcatt

SEQ ID NO: 59690 - DNA, 22574 bp, Oryza sativa
  unsure (1)..(22574): unsure at all n locations
cccatattcttgtctttttgctaggtttgctctgatatcaacaagcctaatggacagttcattttgccgaatgaccaagaagctgtgacaacatttgtatcaacactacctataagaaaggtactcctgtttttagtagtgaagaatggaccttgtttctagaagtattttgttgttctaatagttcttgtttccttcatatatatatattcattcgtacattgttaaaccactaaatattctaaccagtgcgcatattctttccacagtagtccttcaaaacaatagcatttgggcattccccatttatggacaccactttttacttctttaattgagatggagttttctttactactaagtgctttgcctctttggacattcatgaaaaaggtgaaggctgattttttatttgaagatctttgtatgcagataggtggtataggcaaagtaacagaacaaatgttacgtcaggttcttggtatcagtacatgccaggagatgctgcaaaaggcttctttcttatgtgctcttttttctgaatcctcagctggttcgtatgttagtaacacttgttagttccattgcaagttttcagaagctatattatacctatcccaagcagacaccacaattcaatttcttgaaccaaacaccattctgtgcctgcttaatttgatcctttggacgttctccagatttctttatttcggttggtcttggactaggcggtactgaaactcctgagcaaagactaaggaaaagtataagttgcgagcgaactttcagggcaacagatgattgttctatgcttttcgagaaattaggtaaacatccttactaagttattgttctagctatgaggcctgttgattgtagatttcaaaccttgaagctactttgaaatttcatatgctattgttactaagtaactaggttgtcttacagaagagacttgcaatcttattcgaacagaagcatttttcctattttaatggtatatttgtcaataggccaagagcatattattttgcgcaataatttgagacacgtcatgattattcgagagcttgagtagaaagtagttgtttgaaattagtcaattatgctgcaacaagctgtttacatttgatgaggaaatataatttctggtgagtggtagttttggttgggatagcaaactatgcaaggtggaacttgttaggcagctttgactgcatacctgagatctggtgttcaatcttgatagtgctggggaccactggtccgggattgaaggatcccaacgctctatgaatatgagctatttcatgtgtcaattattctacatttctacatatgagatactagaagccaagttgactggaaacaggcaactaaccagggtttggtatttcagaattctgaaatcttaaattttggataaggtacagaaaaaaaaaagagtattatcagaacatgtgtgtgtacataggaaaagaactggtgccactataactatgtgtgtttgatatgataaattcctaaagtaactgcaaaaataatatacttgtatgtaaagcatttaaatgcgttaaaagattatgtaatgattttcaggccttaccacatgctatgtgctaaatctgtaaatgtttctccatgcgtgactcacacccaccatattattatttatttgcagatagtctcgcagacaatttggccgatgatatgcaaaaagaatgcctgaagggaaggacactaacactcaaactaaagactgccgcttttgaggttttcatcttccatttgtataacattaactagtctccagtaattataggacttagatcaccaggagtttttgttcatggctcattagattgatcaaccatctaaaccaggtcaggacaagagcagtaaccacacaaaactatatcaactccaaggaagacatcctgatctacgctaggaaattgcttaaggctgaactgcctctttctttgagattgatgggtaagcatgagcttccatagtatttgatactgttattggatgatgcccaagttgatctagctgtgttgacagcgtaggcatgtgattatgccatggtgcatgcttcttttttgaccttatctggaatgtaatgaacataaaagacatggggcaggagttttctttgagcagtatatggattaatgttgtgctccttaaaattagcgaatgaattctcctcctttgatgcattaggtagagttcctgccctttttttattaaaaaaataatataaaaggcacactatgtactgatttttattttactatgttcatatttttgatgtatctggatgtattgcattttatatattttttaatatgtttgctcttgtttcccaatggagtgagtaacagtcatgccaatacaattcaacagggttgcggatgtcccaacttcgcgatgagaaggatgattcatctacccaaacccaaaagacactagatagatttttccgcacgcctgacaactcaaatgtcattggagcaaacagtccaagcatcggtaataccacaggaggggataactattgcactaatgtgatgaccaaggtcgattatttagagcatgattccatggatgatcaggcattgtttttgcatgaaaagaacttatttgttccagaaggaaggagctcagacaattataataatgatgctgcatcaagcaatccacttatgtgtgatggtgttggtggaaaagaattggatgatgactcctccagttcgaaggtatgtgcttttgtctaattattccattgacaaagggataatattgattcaacaccttttaagtgtttctttactgagtgtttccatgcttaatgaaagacagaaagctaacctttttccccttgcagggtacacatactgtaaagtttgatggccagctcaccagctctaacgcaactacttcatcgagtaaacctgatcagcttttctggataaatggctacatttgttccatttgtggatttgaactacctccaggttttgaggaggagagacaagaacattcagatttccacttggctgaaatgcttcagcaggaagaggcagtggacagcacaggccccctctcgaaagagaggtatgtatctattgccacacgctcatagatatccctatgttatttcttgatctgctttagttcagtgacgtaataaatattatttaacgagatgtaaatcctgaagtgttttactgggattattactgtgggtgagttgccttttgccatggttatttgaaaataaattagctgagatgaagaatttcatgggtatgaaccttttttttccctgtggagctgttatcatgtagacatcagatgaatttcatgggtatgaaccttttgtgtattcagcaggttagctgaaaggccatgctctagcacacccacaccaaagaagaagctcaagtcttcaaaagaaggaaaacacatacctattgatgctttctttcacaaggttaacaagaacttgtaacatactgtagctacctattcaggcactctttttaatcctacagagcgatttgcccacttgaaaaactgctgtacatgtaacttcattccatgttcttttcagactagcatgtaaattgtaaatatataactcaagaatcctgttaaattaatttcataatttattcaaatgtcatacgattctgcacgagattttttttctgacataaagaagctctaccttatagccatttcattgatagaaatgataagttacgaagttggcacgattaaggggaaaatgagaaaaggaggaggaaaggaagaaagagagagaggggggcacgggaatgtacaaaagttgaaaaaaggactgtacattagcctcgtctgattagttcagaccagaggctgattttcgttttgatttagttgttggcccggcaactcggatggtccggagaaccgatgatttattgctctgtgtttgaccacccatattgctgtctttcccaaattctgttgtccatcgacttccatagtgcgtgagcggaccgcacgttgcaaatcacatggtagcaggtcgccactcctccgtgacaataatataagtctggtctccgacatgctactttgactatctatactatataaaagtgagacgttttaaatacaaggagctgtgtatcatgacaaattgcttaatgatgactgtagtaatatcactttgtatatgatcgatctttcttctattaatacttcatgtatataatgtgacttgtctctatactaaacatattcatattctgagactgagggagtaacacatgtctaaaaataacctgtcgagctggatgatattatctgcagtctttatcatcaggcaaattttttgaccatgttggctttaggatactccatataatttatccataaaaggcaacgaaaggaaacatattgaaagcaaaatatttgacagggagaagaggaaatatcttatctgaagtctgaactggttgctatcaagcacacaagcagccaaatctctcccagtgaacgtgtttactgtgttatcctgggaaaaaacaaagaggagaaaaattctcaaaaaaaaaaaaggtgaggtgaacggtagcaatgcacagcggcgtcaatggctgctgcccgcttcggctccccgccgccgccgctgtccacggccgccggatcccgccgctgctgcccccacggggggcgtggccgggttgtatcgccgcgccggcgctgcacaggaagcccggccgcggcggcggcggcgcgctctccagctgcaggcgagcatcgcatcatgtccgtctcttccccctcactcgcagttctgttattaatttagtagtttctgctagaacttgctactgcgatccactgatcctctcctgctgctcgatttttttttttttttgtattctcgtttttaccttttttttttttttgggcactgggttctgaattctgttaatatgcgcacggattgctgcgttagaatcatagtgtgtgtgtgcgcgcgcgcgcgaataatccatatcgccgggtttctcaattgacatccttagctggctaaaaatcgccgggtttctcaattgacatccttagctggctaaaaatcatggacataggataatgcaatgataagtactaatttctgtcgtggcaattggtctgtaataacggcttttcgacaagtatttagcaactaaaattcaaccttgaattttattttcctgttagaactgtaaaattaaatcacacgtggtagtttgcttggatgtaaaatcaagtatatttatgatacatcgcatccttttttctgtaactactgtaacgttctatgagctagaaaatattgcttaacctcctgtcattgataactctgaacatgctataattaacattgtctaatttttaatgccattataaatccttttcaaaccttcatattctcaaacttgcattagtagtgttagtgcactaaaatgctaggttcttttgcttgtattcctctaagtgggtttgaactttgaaatttaagcatcaagtgtgtggcaggagaagttacaggttgctgcactgccatccaaagctacactcgagtttgaacatggtaattttgtaattattcaactgtttcatcttatatattgcagtggagtccaagtcatgcccatattttctgatttgaatgcagccttgaaagattctagtatctaagtatgttgccaaaaaatacatatactcaggtgtctcacttcgaagtgcatatattgttcctgaagatgttcaagctgcagggttccagattgatgctgatgaactagcatctattgttgaaagtcgcgacactaaaaagttgactgtgcatggccaattaaatgggatcgcagacaaattaggaacatcattaaccaatggtatagttacagacaaggacctcttgaatcaaaggcaggacatatatggagtaaataagtttgctgagaccgagattcgcagcttttgggagtttgtatgggaagcactggaagacacaacccttataattcttagtgcgtgtgctattttctctttggttgttggcataaccacagaaggatggccacaaggagcccatgatggcgttggcattgttgcaagtatcctccttgttgtttctgttaccggaacaagtaactatcagcagtccttgcaattcagggaccttgacaaggagaaaaggaaaattcttgttcaagtcacaaggaatggcttgagacaaagagtactgatagatgaccttcttcctggtgatgctgtccatcttgctgttggagatcaggttcctgcagatggcctatttatttctgggttttctgtgttggtcgatgagtctagtctaactggggagagtgaacctgtttttgtaaacgaagataacccttatcttttatcagggacgaaagtgcttgatgggtcctgcaaaatgctggttacagcagttgggatgagaacacaatggggcaaattaatggctgttcttactgatggtggggatgatgaaactccacttcaaaccagacttaatggagttgcgaatactattgggaaaattggtctattttttgctgtattgactttcattgtcctctcacaagggataattggccagaaataccttgacgggcttcttttgagttggtccggagatgatgtgctagagatattggatcattttgctgttgcagttacaattgttgttgttgctgtacctgagggattgccattggcagtcactttgagccttgcatttgcaatgaagaaaatgatgaatgacaaggcacttgttcgacagttggctgcctgtgaaaccatgggctctgccacagtcatttgcagtgacaagacaggaacactgacaacaaaccgcatgactgttgtaaaagcctgcatctgtgggaataccatacaagttaacaatccacagactccaaacatgtcttccaatttcccagaagttgctgtagaaactcttctggagtccatatttaacaacaccagtggcgaagtggtgactaaccaagatgggaagtatcaaatactaggcacccctactgagacagctttgttggagtttgcactgttgctagacggagattgcaaagaaaagcaactgggaagtaagattgttaaagtggaaccttttaattcaaccaaaaagaggatgagtaccattcttgagcttcctggtggaggatatcgtgcacattgtaaaggtgcttcagaaatagtattggctgcatgtgataagtttattgatgaaagaggttgtattgtcccccttgatgataaaacttccagtaagctcaatgatataatcaaagccttttctagtgaagcgctcagaacactttgccttgcttatagggaaatggaagaagggttttctactcaagagcaaataccgttacaaggatacacttgcatcggcattgttggtattaaagatcctgttcgtccaggtgtcaggcagtctgtggcaacttgccggtcagctggcatttcagtgagaatgattacaggagacaatattgatacagcaaaagcaattgctcgggaatgtggcatacttaccaaggatggcattgcaattgagggtgctgagtttagagagaaaagtgctgaagaactccatgatttgattccaaaaatgcaggttttttatacacctaataattttaaattttggttctgtaagtgtttatccatctggggagctctcatgtgataattctggtaactgaaggtactagcccgttcttccccacttgataagcatacacttgtgaagcacttgcgcaccgcattcaatgaagttgttgctgtgactggtgatggcactaatgatgcacctgcgctgcgtgaggcagatattggacttgccatgggcattgcagggactgaggtaataaactagtaacaccactgagtcatgagtacaagcacttaaaatctcttcatctgcaaatgtttatgtaaaaacttcactggttaactcaactggacctgaattggacatcgcatctagatatccttattaactgtattaactaaattgtgaaggatacctatgtagttaaatttctataagaaatatgctgtgagcctttcttttgtatattatcagtattctagttttctatttccaatgctatttaccatatcactggtccattggcttgtatttacttgtaatgctccatttgctgtaaaacccctttgatggcacaaaagtatatctgtaaattctattgtcgaagtcctctgaggttctcagaggatgtagctcctacattctgatgatgcacagctcatcgatatataaaatagagacaatccattatctctataaaataatagaagtcgttgccaacatgagatagctatgaaaagttgctggatgatggaagtagtgtggaactgtacctataaggctgtaataggcaatcttgatttaacttgctacatgttggtttactgctttttgtttggcaaataacatttctttttggaatttggaaatgaaatgaaaataataatctggttcgtggtttgtgcttttccattctgatcataaattcaatatcctctataatgttaatttgaccaagcgcgccagtttgtggtacaaactacaaacatccctgaggcttgtataaattgttttatgcaggtggcaaaagagagtgctgatgttgtaattctggatgacaacttctccacgattgttactgttgccaaatggggacgctctgtttatgtgaacatccaaaaatttgtgcagttccagcttactgttaatgttgttgcattactagttaacttcacttctgcatgtttcacaggtaaatcctctttataattctattaacttaatcagatctctatctcatcatttacatttctcttcatgccaggggatgctccacttacagctgtacaacttctttgggtcaacatgatcatggataccctaggggcgcttgcactagccaccgaaccacctaacaataacttgatgaagaaagcaccggtaggaaggaaagggaagttcatcacaaatgtgatgtggaggaacattgtggggcagtcgttataccaattcgctgtcatgtggtatctacaaactcaagggaaacacttgtttgggctggaaggctaccatgctgatattgtactaaatacaatcatattcaacacttttgtcttctgccaggtatgttagcacttgcaaaataccattcttttgtactggtaaatttaggagcaaaaattatctctttaatatggaagagatatatcagacaagaggatctgtgtgtgtttgtgtgtgtgtgtaactttatccttgcattgccatatctttttaatatgttccagttttcattaattgcatgctttgtaggtgttcaatgaaataagctcaagagagatggaggacatcaacgttctgaggggcatggcagggaactccattttccttggtgtcctcaccggcaccatcttcttccagttcatcctagtccagttcctgggcgatttcgctaacaccacacctctgacccagcaacagtggctcatcagcatactcttcggcttccttgggatgcccattgctgctgccatcaagttgattgctgtagaacctcatgaaaaagccgatacacgtagaacgccgtaaaccacacacaccaggataagacattcaatcaattttgtgcaccaataatccaagtatacctccactctatgatcaaagattggcagcattttgcgaagaaaatttgatgcaatggagttcctgttgggtttggccaatctaaccagccacgaaactgatgagataagagagccaattagtggttctgggaatatgtagaagtgattttttttgaggtattattttgtacacgctgatctagtattatgaaaatgtaaagccaactggcatagttgcgtagagtgtaaacagatgagattgtacataaatacaagactgacatttgatgatagcaacaacgatcatattcttaagagaatttgattcattctaaaacatcagttgcccagtgaaaacatttcaagtgtttcactacacattgttagtactaaaaatttactggtccatggtacagatcgaacttcctttcgtcaggctaagtatgaaagttggtacttctcacatttgcaagaacaatagttaattattgacaactagatactnnnnnnnnnnnnnnnnnnnnnnnncccttcaataccccattgcctaccttttacctaccacttcatagtacttattgataaggtgcactttggtcctttaccctcatcactgaattatcaattttgttgatgaagggagtagggttttttttttctcggggagaatcagcaattgccatcccaaatcagccataagtagggatggcaatcataaaggattgcatgtttatccgtgggtaaaaactctactagtattaggatttggtatgtcttcaaatttatgctccggtcaaaacttatgtctgatgggtaaataggtatggtctccacttcatctattttctcatcaaacataaccaatatgtggatcttactactcacaaatatttcaatatacacttatcaaaatctaatttctatggtgtactacgatatagtcattttacattaaactcatgtttaacttggtaaaacaatattttagttgttagttaattcatggatgaatttattaactagatgatttttctattgtttctaccatatacatatgattgaggagtaaaccgcatacccgcatgtatatgatgcctgtgggtaatgggtatgggcaaggttttatgcccatcatggtaatgggccgtgggcaaaaaaattatctcgtgggcattggtttgggtgtgcatctcccgtacctgccatgtctaattgacattcctagccaaaaggccatgataacgcaatatctagcgttataaacaacaaacagaatatagcaccaatgtgttttgtctggataaattccttccgtgccactaaaaatttacttgatcccttatttacccctcattatctccaatgacacgtggataagaaattggggcatctttgtttgccctatggcttataagccaatgccaaattatgaattgtaagacttgattttaaagttgatgttttttcaatataatatttttttcagttttggcttttaagttgctaaagatacatacacaaaagttttactcacaatacattttttgatcgttaataagccgttacggcttataatcagccgtaagtaccaattgggacccaaatgtttccggtggtaactaagagattgccttttgttttttttaatttggacgtgacggtctgacttgggccataggatgtggtctttcttcttaaatttacttaataaaaatgtgaattgtggattttgtatacaccagacaatatcatttagaggttgcatatttgatggattgatttattttcagggtgacatggctcattagcccctttctatttaaagtaatatttaattgcataatagttgtactttccataatctttataatgaagataatacttaattacctctagtgactgtggatggcattacctcttggataaaattgatggctcgtattaaagcggactactaattttccatttatattgatatatgcatttgttatttaggatgactcttatgtactcccagatgtacatactccctcttccatattggatctaataggatccaattaggacctgcttagccggtgggaaattttttttgaaattcctaattttcagccgaacagggaataaaccaagtaaaaaaaaaggagaatagctactttagtccctaaagtttctctataggatcagtttattccctaactttttaaatggtccaaagaaatcttaacctttgtcataaggcctagaatagtccttgggtccactaaaatcatcatatgaatatgccatgtcatcattcatgcaaatctatgatgaattgtccaatatacccttacgtatatcatagaaaaataaatataaggtgaattagacataaccataggaaaaaaaatacttcttttttcacccttttgaggtatatttttgctcttacatgtaccatatattttttttaacttttttcttttgttttttattttcctatgcgtaagggtgaattggacaaatcatatagattttgcatagaaatgtgacatggcatgtccacgtggcgattttggtgggaccaagaactatattagcccacatgacaaatttaaaggacttgtttggacaatataaaagattaaggactaaaataacccaggagcaaaactttatgaaccatattagctattctcccaaaaaaaaattaagttgaaaaatatccatgcatgtcggcatggaattggttgcacccctgtatgtccgaatttgaaatgtagtatttgtgcacctccctgtagcatggaaattcatgacttatatactgttttattttatgttttattttagattaggtatatacttattttttaggaaccagtatatactatatctctgtttggaagagtatatactttttatttgatgatccagtatatactaaaagctggtttgagaagtatatgctacttaatttaagactattagtatataccgttatctttagagtctattagtatctgccacttgttctagatttatagtatatactacttttctaaatttgtagtatagtatatactgattttctttttgtttaatgagcatatactgttctatcttgagaaatgcccaggggtcttccggctagctccataaggtggtgggctagacgacctgggttcaaagcctcacccctcctaattatttgatattaggtcctttcctaatattctagttttatatactgtgatatctttttttcagtatgtaaagagtcagtatatattgcattcctcattgaagatctctttgtttggtcagtatgtagctctctgcttttggtcttttgcggcttcagatacgtggagtaatttgtttgaatttcctcattccaaatggcgaccgttctacaagaaaatattaaaatattatatcagcatccgtaagaaaatatttgacgcatcaatacatgtaatacgacatagaaagacatagaaagccttaatctctgcatcctcgctgacatatcagttagtagggatcagagaggcagagactagtagtatataccatgctgacatatcagttagtagggatcagagaggcagagactagtagtatataccagtgtttctagagaacaagtataaatcacttgttctagattcatagtatataccacttatctaaatttgtagtgtatactgaattttttgttgaaggagtatatactgttccttttttttggggaatacatactattcttttctctcttttttttcagtatgttactactttttcggtataaaaaagccagtatgtgctgctatattgaaaaagtccagcatatctatggaaaattcagtatatacttctgtgtaacaaagttcagtatatacttgaccatagaaaaattcagcatatagcactccatagaaaataaaaatcagcatatacccctctattgaaaagttcagtatatttatagaaaatgcaatatatactagtctaacaaagtgatcagtacatacccctccaaagaaaaatacagtatttactactccatataaatgcagtatgtacagagcatgccgccatccagcatattgttctagcacgccgccatccagcacattgtgacgagatcgatatggtcgcagcagttggcatcgatcgttgccgcggcccctgcgtttgttgatgcatgtgaaatcaaataaaatatgatgcatcaattatgattgacacaatcacctgaccggaattactgctgcacgggcagcacggcctgtatgccagccgatggatcgatgccgtcgtgtcctggacgctggccgggaagcggcgcgatggatgacgatggcgccggaagcgcctgtttctaccagacaaatcctggtagtctcgttggatgatgatcatcagttggagggggctcgccgttgccgatgctgtaaaagctagtggtgtgggtgtctccagcgccgcttgttgccatggttgtatgatttcagggagccgatggattgtgtcgtcatcgcctccggcttgccgatgggctgcactgtggacaccaatctagtcgtcatgactcatgacgtggccgtggactggttgtcgatcgaatcgtcgccgtcgatgccgagttgccgacggatcacgctgccgaaaatcctcgatggatctagaagaaaaggagaaaacaggatggacataccagaatcaatcacctgggaattgatcaagccacccgcaggtggacgaactgcattgccgccgaggccgtatgattcgatggatcacgtcggcgtcagcgcgtcgcctccaaattgaccgatctgttatttgcagtccggtttagcagtaagtcggaaagagatatttatgctagcatcctggtatggttacggttaatgcgggatacaagtattacgaagattttttttcgtccgcaaaaactttaatgggtccgtacgtggatccgttagcaggttcgatcggtggtgtctgctgatggacggtggatgagagcaggagtacgtacacctgggtgtatagaattattttcctttgttatttttcaaataatgatatatacaatttatttttagtactcccttctttcaaattactcgtcattctagcattcaaattactggacatctggaagctaagattgcttgagcaaatggatggaagcattcctacggcatgagtcaattataattactactaggtaaactctgttgtatattaccttagtcctaaaattcagcatttttttgcctatgaatctagaaacacagttatccagttatccagattcataactaaaaatgcttatattctagtacggagcaagtaactctgaagttactgtcgtaaaagtgacgtttgggaccttgggtatataacccgacacaatggataaatgaaatcaagaagtaacaaacactatccctgtctcgtactccttggtagaacttagaatttgataaattttgttacagaatatgaaaactttgtggttttagccgttgggcatcacgcgaaatgacttttggaggaaaacactatgtaactatggttgtttgccaacagacatcacgtctattattttagtatttacatgttgatgacatgtgagagagcctacgttttacatggcgtgaccaaaatgcccctgcattgaaacaacatattgctatacctacaaggctacaactagtacaccaacgattgaacacactgcaaagtgaacatagctcaactgattaggttccttatggtgaaacaagcccacctaggttcaagacctaggcttaacatgggtgctcgtatttatatctatttattcttttggtgataggcatcgtgtccatcgacgttgagacatcatgatgacttcatcaatctcaagatatgccgacccaatccttcgaagatgttcatagaggtagcgcgtgcgatgtgcctatgtgcgttcatagagatgagtgttctaaaaaacacattaaactttaatcgcaatcatggcactttgaaacttacaaaatcatgatgtcctatagcaaaatgtgccttagaactgttttgcgacagccacagataatgaacgattgtgcaagttgagggccacagatcttctgaggtgaaaagttcaaaaaacggactaagttttaatagcatattatttcgtcctgccgatgtcaatatacagtggaaacataagtactactactgtacaaggatatcgccagtgcttcgcctacatcgcgctgcatattgtggctccaaaggcaaactgatttactaagtgaaataagacagtaactgttcaaataaacagaggaattccactcaaatagacatttccaggctagctgtatgacatattacttaccaagttagtaacttcctaaagcaacagccaacacatcttgatcttacagtagtatgtacatgatcagacgtcagagagaattgatcttatcaaagctttggcactctccagttgctgcctcgattcctcgctgtcaactagatcgtccatgacatgcttgtcaatctcaaagaagttctcacgaagtgaatcatgagcaagatgcagcttctccgatgccgaggagtcactcccaagcaacctgacacagacaaagcgtgtcaagcccaagacaacaccgtactccgctctctgcagcgccaacttgagggtggacaggaagacgccagccacagaatcaagaattttcgggctccctttcttcagaagaattaccatcatttctgctagttttctggatgactgtgagtcctcactggcctgctcgctttgatcatcatctctaggtttttcatcatcaagcagctcattcttggccaatgcaaccacccatagtggcaagcaagacccaccaaagtcacacatgttaccctcagcctgtggcccaatcaaccagcggcatccaagacccattatgacaactggtagccactgctttacgacagaaactaaactgagagcaaatttggagcctgcagcagactcaacagagggtacaagatcaagaagattattggcaagaaagaaggcttcctctgggggactctgtgactcaattgagtttgctaggaccaaatgaagcagcttggctgcatatgtgaaggaactccgtataagcatcaatatgtctttcagatcattccctttgaaagatgagctctgctcctgatgcatttttatggctgatgatgcatattttgtgaaggacaatgcaaaattgagacatcctactttattatcactgatcaacttgatggttattgtgtcaacgataaacttgagaattgaagtgccaagcatgtatacattaactgtccctctcaatgcattccctgcacaagatacataacccactcatttacaaggtatatcatgtgataatgccagatagataacatactgattttggtgactacaagttgaaagttttaaagttaattacataactactttctctagcatgctttcgaaaatcatatcaatattccgttaataaataaagtttcagatcaaagaggttttctgcatcaaaagttgtaaatatctgtgcaggtataccttcaggaactccatgatggtgtttctgccgtgcagatttcttattctgcttcaacttcaatgagtttgtggaaccagtaacagattcatttaggagtttgtcaaaacaattcagcagatggtccagtgagtgattgatggttgttgactgaaacaagagatcaaacttatgagaatggcaacatgttaattgttaaatgaaaaaaaaatgttgaacacattcacaataatctacataaccgtagcaaaaatagcttaagtgcaaccaacaaatatcggttccagttaccatcaatgtttgaccagatggctagtgtttgagttcatcaacatttctgtgacaactatacagtgaggtggaactgactgttttatcaacatttttgtgccaattatcaaagaaagtgggcatggtggaatcgtgggggttaactcacctcagaggtgctgatatcagtttggtcaatatcctgaagagcgctgtgtgtagccaaactcaaataagccaaaagaggtgtggcatttaaagagtcaaactgcaggcactgctcaatgtacacttgacaaatgaccttcagagatgaaaatgcgacgtctgaataagaagattgtagaaaggcaactctcttttcttcatctttcagtatgtcattaatctgccatgatgcacctgcaacaatatcaaagtcttcactggatgacccgtttccaatatcatgaccagactttgctggtgttttcttaagtgattttcctttcttcctctttgaagtagcaacgggacagataggaggttctatatcataaatctcagcaaaacaagacactttagattgcagaatatttgtcagtgcttcaaacatttcgtcagaccagccacttgaaaaaaccaacttatgtgctgctagcactgcttcttggcaaccttgttgcgtggaaacccctgcagcgttcatgactacattcatgcattcatcgtgcaaagcagatagatcatcaggtgatacaactggagccatactgagtagagcagaccgggctcccacagaaatttctgttttaaagagtagcttcaactttgcatttgcaaagaattctcttaaggaagctaaactagagcgctcctcagataagcttttaattagattggctgaagcaataacaagaccatcagtctgttcagagttcattcctgttggtgccagtgccagagtaatagagactttgatcagttcaacaagggatcttgggggagacccttcagataaagcaaattcacaaaaccttgctccagctgtgggtgacctctttataagtgcaatgcagcgagcacacgcttctttcagtggcaattttgttggaaaatatgaagggatgagaagctttgtgattttctgtgcgacacgggggtggtcatttgagagtgaagacagcaaagtacccaatccaacaacctgaaacaaaaggcatacatctagtttgtttgttcaaagtctcaaactgaagaaaataaagatccaaaggttacttaagttacagaatcaattatcacatgcatatgtaatgaagaagtacgtaatgtaccttattaaactggaaagatcgaagatcacgtatagccaaaagaagatcaactgcagaagatctgaccgataaagcaggatcagagaccatgtcacttaatcttggaagtagaactttcagtatttcatgactttgcggattgtcaagtaagtatatcagaccatttatggttgacacccgaacctcagtgcaagaatctttggatatgtcatcaacaattttacttaaaaattttgaaatagttagggaaggaataacttcccaaaactggttaagaatacgacagagtccttcaatcgcaaccgttcgtatttctggacaatcgtccatgagaagtttgtctagcaagaagtattgcttctctagtagaggatcattgacatcctttgtcacatccgggtcttcaagggggaacaaatctaatagaaggtgcaaagaattatggcgtacattggagtttgcaacctgccaaacagtaatgacttcagataaaaacggaaacgtttaaagcataaactgttctatatatttcttatttgttgatgcatacatgtcataacttcaggttgtgaaaccaaaaagtaaaacaaactattgagcatgcttttctaaggaagagcattcaaatcaaagcaacacataaatcatagttttcattcacaaatcacaaagaataaaattggacagcattcagaaaagattttgagctgtaacatattgacattatgtacatgatattaatatccatcgatctaatgtttgcgcgaatcaattattttatcaacatttggatggggaaagaacatagaaccacaatactgagcaatttcatttgtacagacacttaataactgactctactatgagttgtgaccacgtggaagttcaaccaaaagaaagtgataaaacaataatatcatatgttgtttagcactcatgttgataattggacaatctacttctttttgtaagccataaatttgtcaaacacaaagaccaaatagggaaagaaaagttggaaacaataaactagcgcaagtaaatcatagtccacagcgttgatgtctagagaataagggggagtagttagtgttttagtactgaatgttgaagagacaggaaagaaagacaggaaagaaagacaggaaagaaagagaatcagcgataaatgttacatgcatgctttatctctatctctatctctactacttaaaaaataagagatgtttccttcgtccgtcaaaacaaaaaaaatagcaaaaaaaatataaaaaaagtccgactcctaccgattccctctcagaaaaggaaatcgtccgtcaaaaaaaaagcgaaaaagataaaaaaaagtccgactcctaccgattctttctcaggaaggggaaaaaaatcctgactctagattcacccttaaaaacaaaaaataaaattgatgtaccggattgaaaatctgtttccaaaaacggaacctaccgattgagagcattccatttttatatgattttaatttttgggtctgtacttttgcatttgagtccatgtaatttttatatttacatttgagtccctacaatcttgaaataagatacttgagatcgtttttgattgaaaaataataaaagggaaagaacaaaggcagaaaggtgcataaaaataaaaaaagaaaaaccacacaataaaataaaataaagaaaaaacaaagaaaaacaacaacaacaacaacaaaagtctgtttatcctaagtggcgaaaaaaaaccgtagatccgattcctatagaaggcaaaataaaagtggtgaaaaaatgctagatctgattcctttaaaaactgaaaaaaaaaagtctgattcctgtaaaggcgaaaaaaaatccgaaaaaacatctaaaaaaagttcgtccgattctataagaagaaaaaatggttcgtaaaaaataaaaaatgcgcgcgagaaaaaatggaaagggcaaaactaattccgatttctaatcagtatatatctcttcgctatgtctaatctaatctaactatttaaaaagagaaaatgcacgacaaaataaaaacggttcaaataaacatgtgagaaaagtcagaaaaaagcgcaaaaaaaacacactaaaaaggttttgcatcttccataaaaaataaaaaaacacgcgagaaaaattatttccatcgtcggtaaaaaaattttaaaaaaaacatgcgaggaaaaaaaatgttagaaaaaacgcgccatttctaaaaaatggtttgaaaaaaccgcgcaagataaaaatatcgtctactaaaaaacaaatcactctgaaaaatctgtcagaaaaaacactaaattgatggacgcttgagccggataggatccatcgattttttgtcatctactacacggtttttatttcgtcatatattctcctgtattggaaaaaaacaaaaaagaacattcgaaaaaaacaagcaaaaaaagcgtgagaaaataattgttagaaaaaaaaacatgcaaaaaacacacgagaaaagaaaagaaaaaagggagaaaaatacggttttcgttgtaagtaaaaaaagcaaaaagaacatgctaggaaaaactgttagaaagaaatgcacctttctgaaaaatggtttgaaaaaatcgcgcaagaaaaaaaacattgtttataaaaaacaagtcgctcattaaaatacaaacattgtcattgacataattatgcatgaaaaacatatattatcattagaattttttcacccgttgcaacgcacgggcatttttgctagtatatttcaaaaagaaaaaaaggcttgcaggaagccaggaggtatatgccttacttttgaaacagagggaggtatttgctgaaccatttaaatagtctacctattaccagatcatgttaatgtgttattgagcttgtcgtactgtttgaccaatgtaacaaagaataatcctagtcaagcagcaccatgattgatatgtctatgtaatgctagaagaccaatactccactcttcgctcttctaccattcatcataactactaattttaatttggctgtaacttcatgtacacaagtagtgcataacaattttattctgtgatgctcaccttcgacccatccataatgaatatcgtaagcacatcatactagttactccctccattccaaatttatctacatatagtttttttgaggttattcctaaatgatctacatatttgtgttcattcattaagtctattcgttatttgtgcatcggagtaaatggacattgatgcatgcatccatgcacacaagtatttataacccacatgcaatattttgatttgctattggctaggaaatagtgggaatgatacatgcattgagtttgttgctagagtaaatatagtatgagagagttattagcttttcttggtcttggtgtacctataaaatatgtagatcaatttggaatggagagagtaatacattagcacaggagcagaaaaagatactagacagtttcatacctgcaaagaccggaacagcacgggctcggcaagctgaaagattaatttttcaactccagccaccattctctgctcgacgaacgcagacag

SEQ ID NO: 59691 - DNA, 681 bp, Oryza sativa
  unsure (1)..(681): unsure at all n locations
attcctgcagccctatcaagaaaaagaacgccacaagtctcatctatggcaacccgggcggctaggaaattttgcatgcaacatcaagaatcaggtaaatttgagataaatgtacctgaccttatccgcaaattccactgctgaagcattatgattttgaaattgcaagatcaaattagtggaagagcaagcagcagccgaccagggacgaaatgtggtgggcgttgcgaatctaatttggnaaccccggcgagttgggtagacagagaaccgcttatggcagccgaccggttacggcgatcggtgcagaagggtgcaaacgatttgtgggttgggttggagtctgggcttgggcattgcgcttgaccctcgccccattctctagcaacagatcaatagggaaaggaggcgctatcggctgtatcggtgacggcgaccaacagattttgacggtctctccatggtcatcggcaaaggacttgcacgtggcatggtgggcagagagggggaaacgaggggggtgttcggttttcccgggccccttttttttttccccgcaaaggttgaagggggccccgaaaacccccccccagcgaaaaattcgcgagacaatgaggaattgaggaggcgcaatctgtagcgtggaagacgggaaggaaaggggaggaagaatcgcgtgga

SEQ ID NO: 59692 - DNA, 570 bp, Oryza sativa
gaaacaacaacaacaaaaaagttacaaggtttctgagaaattaagcatcagaaactatcatccacttaagtatctcatactgttggtgtaatatgcaactttatgagggacctacttgtaattctgttgaataaagatatgtatgtgtgggggtgctgatcggtggtgaggccaacaagctcattccacccctctctcaggcgttaggcagcagcagcaggaaggcgggagaaggtagcagcaggagcagcaccggcgtgcggggcagcagcagcgccgccgcgccactcggcgcgctggtagcagccccgctgcgcgcacgcgaggccctcaggttcgtgggcttcctggaggagaggagctctgtgtgcgcaagctaggaggaagaaaagacggtactgttttgggagttggatttgggactgatttgtgagcttgttgtgggaaagagagcaagtttatttctgtttctttgttgacaggtgcgggaagaagcctggtccagttatgtgatttgggttgctaagagcacaagcgaggatatgttcccgttctttgcttgctgaaaac

SEQ ID NO: 59693 - DNA, 3359 bp, Oryza sativa
gcaagcttcctttgcttcctccactcaaatctagagcctatcttgtgagattgagagattagattagagtataggagtgttttggagatggcttaaagattatgtttgtttgagcactttggataccttgtgggctgtcacttgggcttattactcttggagatcttctcctagacggttaggtgtcgcccgtgagcttccaaagatcttgtgaatgtcccgggaaagtttgtgaaggttttcctcacctccacaaggaaacgaggtaagtgagtaaagattcttgtgctgagttttcagaggttgtcctaggtagagcaacttgcacttgtggtcttttctagaaggaattgtgagttggatcttggcggtcactcaattctagaaaatgacctagaagtgttgagttgaaggctgtggacttcttctgggatctttgcataagtgaggcaaggggttaatcgagacccggctctttgagcacttcaatggagagtaggacccgtgtgatccgaacttcggaaaaaaatcgcctttgtctctcttgtgcatgatctatgtttgaatctgctggtatcttgtgatttacatcttgtgcaaccttgtgcctgattgtctatagctaggacctgttttgcttccccaaattttgattttctctattgcccggaagttcctggctcaagaactccgaaagttccgggctgctcatctctgccaggaagttccggtgtttttcaccaggaggttccgggcactgttaatcttaaccgctgcgattgttgagaaaatttcaggaaagcctattcacccccccccccccgctctaggctacatctctgcgcgttcagattgaggggtttcgatccttatctcctcatttttccccttctcaagaattagagcaaaatcgcgtcgtatctatcttggaattgagccctatagcaaaccctagagttcacctcagagtccgtttcgcctaaaaaaatcgcgtctacatgcagatgatgataacggacgaaaatagtgctggaatccttatgtattttttaattaggtacatatattaaactagttttaatgaaactaatttgatacttcttatctttttataaacttaattagatttttcaataaatgttaaatgaattatcatatacaagggcagggtggctatactctgttttttttttttttttgcataagtaaacctgaaaagcaccacaaattatggccttttgttccccgaatccatcctaaatgtattggcatcaggaatgaatcaaaaatgatttggactaacctatttttttcaatccaaaaaggatgagtttttatttaacgtgtcacatatttattgccgtaaagacacgaattttatttgaggcattattttattccttttgaaacttatgatcaatcataaaaaatgtttgaaattgctttgaaccttgtgtatatttcttacgagctctctaaaaaatctaaatatgttttttcacccttcctctaataagaagcatttaggtaattttttttctctgctaattgctcctttggtaggatttaagatatttttggacagagcaagtaatatcccttgtttgactttcgttcaaaacgacgtgcatgtttccacgacccaagatagtaatatatatattctctccttttcaaatttaggacgatgttaacttttactccctctatcctaaactataagcatttttagcatagagataagtcaaacattgtcaactttgaatatttatttgttaaaaaatctaagaatatcaatcatgtcaaattgatgttactagaattatcattaaacaaactatcataactatcatagaatggactccctccgtttcataatgtaagtgattgtagcattttgcatattcatattgatgttaagtaatctagacatatatatctatctagattcattaacatcaacatgaatatgggaaatgctagaatgacttacattgtgaaacggaggaagtaactctttttatttaaaacatattacttttatctatattgttggtcaaattaatatatcggagaccgtgtcagagtctaaaaatgcttatattttgggacggagggagtatatataatatgctttgatagagtaaatttcaaaatccccatgttttatgatcaaaattatataaaaccacatatattatgacttgtgaaacataacccaatgtattatggttctaaagttttataaaacatatattatgatttatgcatgttgagtacaaatttacttaaaataataaaacatatagtgtatataaaaattttaattattaagttcttaactaatgttgatagtttatctcttctgtactttgaaaaattgtttcaaatatgctataattaataaagattttaataaaggtgtgattttacgaaacatatatatatatatatatatatatatatatatatatatatatatacaccaaaatatcaatatcaatagttatgtgccacgcgtcataatatctgtatttttttttacaattttgaccataatgaggttctctaaaatttactctaatatataatgttttttcattccacttattcaacatattttagtgaaatcatataagtcatgcgtaaatgcctttaatgaaaatttttttaaaaaaataaaataagatgaatagtaaaatattacgtccaaaattcatacaatacaaaaacaggggcagtatttcacaaatgctttacaaagatttaataagcacacgaagatcagttctcaagcggccatctgtttccttgagttggtcgtcttctccgctggcacgaggtacttgtggaatatcctctccttgagctcggcgacatgggcagtttcacgctataggggcaggcgccggtgacccgcctccatggcagccgcaagagccgcctccgtccaatgcgcacgacgaccgaggcgctcgatgagggacaccacacgtcacggcggtgtgtggtgtcatttaaattgggaacttagcccctcaaacaactcaatgtgaaattcgctctcatgaagatttcaacatatgaccttgaggtgctattcgattagatcactacaaaccactaaactacatgtactttcgtataaattaccgagcatattgtattttggatatgatattgataccattagtaaagcactgacaaaatataggagccttgttgtttcactaattcatatgcttatccgattcgattataagcagaagcataagcactataagatcctgcagaaaggactagcttaatttgaaattacgatattataattatatgcattcacaactattagcacattc

SEQ ID NO: 59694 - DNA, 23678 bp, Oryza sativa
atgggacgggtcatacctacttccactccgcctgttacagaagcgacgtgggggcacggccgcccgttcaatcggatgtgaccggcaacaggccggtcacagactggttacatccgattgacgtgggtcagctaggcggcaccgcacatctgcccttaccgcataaatgcggtgagggacagttgaggcgctgcgcattgatggctgttcagcctcggcccccttcctgctcgctccccccgccacatggtagctgggcgagggcctcgggacaaggcagcgggagagcccgaggggcacgacatggcaccccgaggccccccggccgcttttgtgactcgcgaggcgcgggagtagggctaggctgtagagccacgcggctggatggaaaggtaactttcccccacttcgcatacccccaggcccatctccgacagtagcccctggcaccatattggacactgacctcctgaggtcggtctgatgtggtgcctcacgacttcccaagctggggttgtgggcccgacagggaatctaaggaaatgtcgccgagtggccaggttggcatattaaccacggcagcagtttgccgccactgaccacgctgatgatggggatgtttaaggcgtgaaaatcggggggtcggtcaggccacgcctcgattctcttgcccgctactcatgcggcggtagtggtgacggttcactcaggttgtgtccgtgaccgttgtgcgccctactccgagtgtgccgctgataggcgcactaaatgcagggcgtggattcaatgggcgacgtgatgagttgacgcgggaaacgaagagacaaccgtgggcgcgagaatcgtgggggcaaccgtgagggcgtgaaacgaggaggtgagcgtgggtgaggcgaggataaaaggatacggaggcaaggatgttgtctccttcctttcgccaactgcccactcgtcttctcgctccttaagccctaacattctcaccacttcacactattccgcgcgccaagccctccgccgcttctccgccggccatcatggctcaagacgctggcgacacggtgctcccggcatcacgcattatggcggatagacaccttagcctcccccgcaagatcatgccggaaggcgccgtcgtgagggcgggggagttgcggccgcggccgctgtatccggagcgatccgtgcacctcttgtccttcgctatggcggggttgattccgccgttctccggattcttccatgaggttttggatttctatgaaatccatgccttgcatctcgcacccaacgccgtgatgacgctggccatcttcgcgcatctgtgcgagatgttcatcggggtgcggctgacgatgcggctgttccagtctttcttcatcccacagctgctgcaaggtgcggtggtggggggatgttacttccagccccggccaggcacggcggggcaatacatcgagagtcatctccgcaagaaatgggaggactggaagaaggactggttctacaccgtgttgccggaccacccgcgacttcggcttcctgccggtcctcccgaaagatccgccgtatggctggcggtttcgtaactgggcgaagagtacgacgcggtgtgggatcgccttaggggcctgcgaagcctgggcctcacaggggcgatggtctttggtgactatttccgccgccgcatcgcacctctccaggatcgatcccgtggcgcgtgggagtacactggtcccaacaaccccatgcgcacgcatgtgggtgagcgctgggactgggaggaggaggacgcgaagatggtgattcggcgggtactgggcttggactccgccgagcaaacactgattccagacgggatcctttccctatggtgcgaccgcgaccgggagagcatcctggccgtgtcggttgttggcaccggcaggagcaggtccagccgggacggcaccggtggtagcgctgccgatgttgctggcggtggcgcgacagcaggcgggagtcggacaagcggacccggcgggggtgggagctctaggtctcccggcccaaaccgcggacccggggacgactcggccagcgacccgaaagggaagcggaagatgtccgaatctcgaccgccctctcccccgcgtggagggggcgccgagcgcgtggatcgtccgctagcgggccacaagagccctgccgggaccgaggccggacggaagaagaaacggctccggaagataggacaaatggagccgtgtcgggggagcttcattgagcccccgaagtggactttcaaccgccctccccgcaggtacgatcgccggcacccacctcggtgcttttatccagcttggtctcttgttccctccttttctttttatttgttaacgcgatctgggttctcttgtagcgagattccttcccagggggtcacgcggtccgacccttcgcgggggaccaaatccgaatgatcggagcggcccaggcttggccgatccaaggccgcggggccttcacagcccctcggcagggcccacgggccgcataccgggtccggccccgagcgaaccccagccgggactcgtcccgccgcgggcgatagcggcggtgacgtccctcctgggggcgactccgagaccagggttcatgcggagcgccacccgggatcggggggcgaaggaggtcgtggctcggatgccgaggccggaggcggccttgagctcgaggtcaaggccgaaatcgggggcgggcccgagccggaggccgagtccgaaattgggggcgggcccaagcctgaggccgaggccgaatctacccgaggacccgaggcggggggcgagagggacggccgctcccccttgcacttggggcgccctcaaggctggtcgtgtagaaggggggccgagagcatcccccagtctcgcgggggatccagcggcactccgtcgtcccgggggcgggccgcaactttttcttctccgactccggcaagtatggagccgctcctgcaggtgctcgctgccgccgattccaccgttcgggaggggctcaacgcccaagttcaagccctggcggaagagcgagcggccctggaggctgcatgggcacagctcgcgtgcgagttgacgaggggcgtcgcgccgtggacgacatggtgagggtgggacgcaaaatgcgccaagcccaactagccaaaatccaggcgcgcgaggagtcgctggactccgtcatgcgagaggtggaggaagagcggcaggcggcgctgattgcctcgagcgtcctggacgaagcactgggtgacatcgccttcagtacgaggcccatgccgaggatctggcgaagaggatcaaggacgcccgcggtatcctcgacgcagctgctgcccaagagcagcgggtatcggaggccgatgcctcgctgcgggctcggacagcggcgctcgaggccgaacgcagggccttggatgagcgtgtccgctccacgcaggagttcgagaccacgattcgccggcgaatcgaggtcctcgatcagagccagcgtgagcaaaacgcgcgtggccaggagcaggcgcagcgagcccaggagctgtagaggcggactcaggcgctggaggagcgagcgcgtctgctcgatctgcgggagtccaccttggccgcccacgagagaacagcagcggaggtggaggcctcccttcaccttcgtgaagaggccgcagctgagcgtgaccggatcaccctcgccgcgaaagcttcagtggaccgccacgcagaggagctacggctctgggaagaggcgtgccgagaacgggacgttgtactcgccgagcgcgaagctgaggtgaaccgccatgaggtggcctcgcgccggctgggcgagcagctcgcaaaacgcgaggaggctgttgccgggcgcgatgctcggcatctggagagtgctcgcgccgagcgcgcggcgatagcggcgagggcttctgagctggaggcccgtgagaaggacctggcggcgggcgggcagcccggcggcgcggagttggggagccagcttgccatggctcagagcactctcgccgatatagagcgcttggtgcaagatcaggccagggagattgcggccctccgcctcaccaacgggatcggacccgggaagctctccgacgccgtcgaccggctggagcgcgcggggcgccgagtcggcatttccgtgcaccgggatagtaagcttccgcccacacgccggcagtcgcactccggctggacgggctggcggcggatctggagaggctggagaaggaggtcggcgagactgtgaaatcgtcgtcggctttcttggcgcgggacgcggtggaactggtcctcgcgagccaccaagcgcgtgaccccgacttcgtcccatggcgcgcactcgaggattttcctccagggaccgaggcaagggctcgggagcaagtccgggaggcggccgacgcgatcgtctctaacttcgaggggtcggccccccggttcaccttcgggcttgcctcggacaaggagagcgggagcggggacgatgatgacgacttcggcggcgaggactgggacgacgtctgtcacgcccagaaatttaacccaaatttccggactattttgtgtattaaatccctgtccaggacaagccagggtacacaaaacgacaagtaatatacagttccaaacataaataaagcgtaaatacttacagaagaggcacttagtcctcacaccgaaagaaaatgacaacagcgggaaaaggcgatcctagcggggcttcagctccactcacaggcaaaacttaactggggtctgaaccttggtcttctaacttcgtcttcagctcagaagcactacacttctgaaaaaaggggaataatagcaaggctgagtacaaccaccatactcagcaagccacaccaatgatgcagacgtgcaacgggattcaagaatggcttgtggctatttgtataaaggcggttgtaaaacattttattgagcaaaacagtaaaactattgagtaattaaggtactattaaatctccactgatcaacgctataccacgttgaacaggcccaaccaacccacctgaactacagtgcattgggtcgatttattaggggtgagactaatcacggtgaatctggtcgaccgaccataaccgcgggcacggctattcgaatagttttactctgatcagaggtgtacaactgtacccacaagacatagccccacgacacgtttccgtgcgctgacatgccaccacgacatactggaaagaggtcgtgataggacccttctcataactccctctaaccaagcacaccacacctcagatttcacccccactcctcgcaaggcagcgggcagtcccctctcgtgcctaggtgaatccggaagccgcataggccgtcgcagggcccatccaaattccatcacacccacccttgcctggatgcgtcggctagaggaaagctacactacaagcccagctgttgcccacgctggcttgtggtaagcacgataaattcttccagggtttcccgtgaaccggttcttaattgccatgggcacgactagcaaaaccatgcacccacagcccaccatgaagtcacattttagttgggtaattacgaccatgaagcatggccagatgtctcgagcatgcagctcattctgacactaaaaaggtctaatactataattatcccatcaaccgggctagtggtaattaagcatggctaagcatatagttctagctaggtcacataagtaacatgagctagttgatttattacccaaggttgacaaaggacagatatcaagtaaatatggcacaagcaagcagataggtaatacccggatcccatgtaattagcaagacatgcaattttatttgtaaacgataaaacatttgtaaattaggatcaaaattctcaaggggaatgtgtgacttgccttgcttcttcactttgatcttctgaactcttttcctcgcgactacgaacttccgaaacaacggaaactacaccttggcacgcaaaacgaggaaaaactctaataaaaaccaaggaaacagtacataaaaagtaaacaaacatgtagagctcaattttagatgaattttgcaagttgaatggctcaatttggagttcgaatgaattagatatgatttttagaagctttgagccatttaatcaatttctataattaaaccgaattattgagcaattattaattattttctgaagggataagctcatcgctgacatcagcaaagagccggcgccgacgggcgggcccaatgagtcagcgggccaaaggatttggtccatcgtggacttggtccacggtagtggtgcgcagcagagaggcgggttggctcgccggccaacccgactgggtagcggcggcgcacgaccggacggccaccggcgccaacactggcggtgcaaggaacggcggcgcacagcacaggaggcggcggggaaggaagagggatgatcaccagagggcacgacggcgagatgaccacgaggaggcggtcggcgacggaagcgatggcggtggtcggcacgggatgaggcgggaacggcattccggcgactcccgaccacgccggaggcacggccgagggccggcgggatctggcgaacggggaggatgggttagctgcagggaaaggggcacgaggagactcccggcggcgtgaatcaccggccggaagcaagaaaagcggcgggtgctcaccggtgtgcgatggaggtggagttccgacgggattcgggcgacggggagcagtggccgaggacctcctcgtccttgcggagccgagggaggcgacggcgtggattggcgacgaccaaagcagcaggacgacgcggttggagtcggcaaatggagttggtggctcaggttggtggtggcagcggcgtttcggcggcggtttggggaggggaagtggtagccgggcttgcccttgagacggcgaagccggtggaggttgtcgcgtggcacaccggtggctaggacggcggcgatgtgcggctggaggcggtacaggtggcggtagcttggcaccacgatgggaatggtgctgcgggggtggagggggcgaacggagtggatgccggggtgcggcacgatgcggcggagcttttggctgcagcggcgcagcgcggcattggctagagtggcggtggcgggcggctggaggcgttggaaggggcggcggctcggtttcatggtggagatggagtttcgacgatggaatggggaaacggagtggaggctgaggcacggcgaggcacggcgaagctggcggtgcaagcggagtggcgcggcggtggctagtgcggcggctagaggcggctggagctcgccggagagcggcggcgcgtgggctcggcgcggggagagcaagggagggcgcggcggcttgggaaaaatggaggaaacggatgaggggaagacgggagggaaggcgggatcgagcccgagagaggtggaaaccggccggcgacgtggagctcgacgtgggggtggtggcagcggttcggtgccgattccgtggggagagtgggggaagaggaggtggggatcgagtccacgcgctcacgggacggggtggggcgcgggaggcgcggcgtcgtggggcggaaccagcggccatggcagtttcagccggccggatggaggtagggggagaagctgacgagtgggccctgcggtcctacttgtcggccggagtgagagagaggaggctgaggaggacgtgaagcggacttttacaaggggaaaggggaacaggccgacggcccaagaatggagggggaaggccggcctggccggggaaggagggggaagggattgggctgagcccaaggaaggaggggagggattttatttgtttttcatttaatttaattggtttaaatgaactttgtattattataattactccttgagctccgaaaatttgctgaaaaatccggagagtattttagggcaaagagaatattacaaaatatttccggccaatgatttttaaaggaaatttttaatttcctctataatttcacttgattaaattgatttaacttttatttaatttctagaaaatgcattattaattgatttttattcccgaacaaaaatcggggcattacaacgtcgttagcggcaccggcctcgggggcccgagcactccgtgattacccgcgctttcaatttcccattgttgtgtgcctgtagcagacacttcttgtatttaggccatcgtgtcttcctgtcttgttctgcaattaaaacttccttttcgcactttttacccctttgctttttccattgaatgcctgcggcatagaaagaggaaaaaacaagagcaaaagtatataattaatctgcctgtgatcgaaatgccgcttttaccccatcctccccccccccctcgggcttgttctagcgaaaaggcaaacccgcgctcggtccgtggtacctaagtggtgaaaggcaaaaccgacgccctgaggaagccgcccagcgggacttgccagaccggggctacgacgacaaggggtcggggacggccgagtgtaggcccttccgagcccccagggttcggcgcaacccggggcgcggcccgcgtttgtgctccctttgggcggttttcaggtcgccccacggcacttagggttcagagtaagcgcgaactatcctttgaaccaggacaagccaaaggaaagagagagaaaaggggggcataacgggcttcacactaagtagaaaaattcattgcttgtaaagggaaaaggatacacagtggtagcccccgaccaagcccgcacaaaccgaggggttgtgcgggggttggcccgagctcctagaaagcaaaaaatctcgacgctatggatagaagcgacggaggtgttcgatattccaggggttaggcaactcggtgccgtcctccctggttagtcgaatagagcctagccggggaacaccgatcaatttgtatggcccttcccacattggcgagagcttgctcagcccagacgcgattggacgcggcgtaggacgagatcgccaacttgcagtgactgggcccggacgaggcgctgatggtagcgccacaggctttgttggtagcacgcggcacgcagggccacacgccttctccattcttcaagataaacgagatcgtcgcggcgaagatcatcctggttggcctcattgtacagcgcgacgcgaggcgatcccagggaaagctccgagggtaggaccgcttcggcgccatacactaggaaaaatggtgtttcccccgtggcacgacttggagtggtccgatttgcccacaacacggtgggcaactcctcgagcctcgaatccccgtgtttctttaggacgttgtacatcttggtcttaaggcctttgaggatttcggcgttggctcgctcgacttggccgttgctcttagggtgggcgggtgaggcaaagcacaatttgatgcccatgtcgttgcaatagtcgccgaacagctcactggtgaactgggtgccgttatctgtaatgatgcggttgggcactccgaatcgtgacgtgatgcccctgatgaacttgagggcggaatgcttgttgatcttgacgatcgggtaagcttcgggccacttggtgaacttgtcgatggcgacgtacaaggtgttgatacccgcctcgagcagccttgaatggtccaaggatgtctagcccctagaccacaaaaggccaagagagcgggatgacctgcaaggcttgggccggctggtggatttgcttggcgggatgatctgggttgcccttgctcgggggccccgggggggtctcgagtcatgtcgggatcataggccttaggaccactcgccaaagcctcccttcctcccacgggggcctcgggctccgggcctttgggagacgtagggccatcgcgagttaaaggggcctccggttcgccctcttcgcactcgactactagggcggtactcaccacatggggggttgcggccaagtagagtagcaacggttcctccggccccggggctaccaagatgggggggaggtgaggtaagctttcaactggttgagagcttgctcagcttcctccgtccacacaaacggcctagagcgcttgaggagcttgaataggggtagcgccctctctcccagcctcgatatgaatcgacttagggcggccatgcatccagtgacgcactgcacatccctaagtttgtaggggggcccatcctctctatcgcgtgtattttctcgggatttgcttctatgcctcggaaggagactagaaaaccgagaagtttgcccgccggcacaccgaacacacttatcgggattcagtttcacgcgtgtggacctaagactatcgaaagtctcagccaaatcctgcagcaacgtgtcctagtggcgcgtctttaccaccaggtcatcgacatacgcctctacattgcgccctatttgattactcaaaataatacgagtcatgcgctgaaaagtaggtcctgaattttttaacccaaaaggcatagttgtataacaaaaggtgcccacaggagtaatgaaggcagttttttccttatcttccctagccatgcgaatctagtgatacccagagtaggcatctagaaaacacaaaaggtcacaccccgcagtggagtcgactatctgatctatgtgtggtagatggaagggatctttagggcatgccttgttgaggtccgtgtagtcgatgcacatccggagcttgccgttggccttcggggcgaccaccaggttcgccagccactccggatggataacctcgcggatgaagtcagcctccaggagccacgccacttcctctcggatgaaggcctgtcgctccagggcttgacgccgcactttttgccggacggcaaagcggtgctcgatcacctccttgaggaccctgggcatatctgacagcttccatgcgaagacgtcagaatttgcccgaaggaaggagacaagcgcgccttcctatttggcgcccaggtttccgccaattttggcggtcttggacacatcatcgccaagggggatctccttgacgggcacctcatcagccgaggtgaggcgcttcttggaggcgggacgcggaggcctccggggcctgcggctccgtggccaccgccaggttgtcggcgcattgctccgcgcaggtgagggcaactttgacatcgccaaagacggtgatgggaccagcagggccctgcatcttcatctggaggtaggcatagtgggtggcggccatgaacttcaccaacgtgggtctgcccaggaccgcgttgtagggcagattgaggtccgccacatcgaagtcgtttcgctcggtgcggaagttggtggagtcgccgaaggtcatcgggagctcgacgtggccaagaggccacgtatgtcccggagtcacgccgatgatcggcagcgacggctggagcttcatccccggggccttgagtgcgtcgaaggcggctggggagatgatgctcaggctggctctccattcaaccaggacacgcttcatcctgacgttgtgaatggtcggggagaccacaagggccaacttccctcctcgagcgagcactgtcggatggtcgctctggtcaaaggtgagcttcacctccgaccagcgcgccttccgagccgcctcgtgcgtgggaacagcggccaaaagctctcgcctcatggccttgaagccccggcgagaggtgtgagcgcacgccccccccccccccccccgtcgagcgtggcgacggttccctgaggtatctggaaatccagatcctcactgtcaccgccatcatcggcgggggccttgttcttggcctcttctcgccggttaccggttgaggtggcgggggctttgccctcccgtcgaccctgccgcttctcctcatcggcctttcggaatcgctcagccaaattcttgaccgagcggcagtcggcgagactgtgccgataagtgttgtgcaccgagcaccacttgtctgccgaccggccctcgccggatggagcagtggagatcgtcttgtcgccggtgtcctttcccttgcacggggcccgtgcgggcccatctgccgcaaggacatggccctcgtcatcggagcgggccggtttccttttgcctctcctatctcgccacttagagtggggggcagactcgggggcagccgtggccgccgcaccggtgccgggagagttccaggcccacgcctcctccttccgagccaccttgtccgccagctcaaaaagctcggcggtggtcttgggctccttggaggcgatcttctctagcatgcagttatgctgcacgccattccgaaacgcatacacgaccgcgtgggccggaatgcaccgaatagtgttgcggacctaacaaaagcgttgtatgtacgagcggagggactcgtcgtccttccgccgtatagcgtgcaggtccgcctcttctcccggacggggatatgtgccctggaagttcgtaacgaactgctggcacagatcctcccaggagtggatggagtcggggggctgggtcatcaaccagccacgcgcctgatccttcagggccatggggaagtaattcgccatgacccgatagtcaccccctgccaccacaataatcgtggtgtagatctggaggaactcggagggattgatgctgccatcatacttctccgtgaggttggggcgaaacttcaggggccacaggacattctggagactcaccacgaaggccttacaacccgtccctccaggggagagcgtgggggagggccgcctcgtgaggaggaacgtggcactccagatgaggaggcgcctttccccatgcgggcagctcagcgctcgtccctgcgtcgctcgatgttgatccgagcgtcctgctccccgtagagaccgtcatgacgcctccggcttcctgaggcccctgacgatgttggcgccgtggaccgccttgaggcggtggccgagcgacgggccctcctccttgccgacgaggagagggtaacaggggtacgcgacgtaccggtggcggcaggtcggtcgccagcagccaactgccgctgggcagaggtgaccaagttggccaagtcgtctagccagcgctgaacaggggtctctggctccgagtttacggggggatgccacagaagggcacccgccgcctgaagcgcgcctcggggcgaatcgtcgtcgccgtaagtgaggcggcgacgtgccccgacgcgtcgtggcctccccccgcccgggggcgaagagagggccgaaccacccgaacgggtggtatcctccctccgcgagggttcgcggcggggaggagttggggagtcgcggcggcggtgacgagggccgcggctcccactagaatactcactcccggacggggtgggggtaaacgccaccgcctcctccacctccaggatctcgaccatggtcgtcaagggcccagggaaacttggggcggaagaaaacgacttcacttcagagcgcgcgaccttccccctacctggcgcgccagctgtcgagggaaggccctcgatagcgggaggtcgtgagacccccctttcgtgagttcggccgggggaagaggctcgcctcttagaaatcgcgtatccgcccctaaggctactagctagcttgcacagaatcggattatacaggttcgggccgctgtggagcataataccctactcctgtgtttgagattatggttaagagttacaagggttccttaactccggagagctttctccccttcttctcctagagttcaggttttctgagagtcgtccctttgctcggtgggcaaggtcctccttttatagttcaaggggataccacatgcaccgcctctacctatccttccctgggagggggacccaccttaccttgaccgggccacgatccgtgccttcgctcggaagctaagcagcagcctgtccttgagtgggacccagcgccacccctcgcctgacacaggggacagccctgtcattccctcataaatgagtgaagacttgtggtgttccttctctcatggagggaaccccgaatgacaccatgataggacgggtcatacctacttccactccgcctgttacagaggtgacgtgggggcacggccacccgttcaatcggatgtgaccggcaacaggccggtcacagactggttacatccgattgacgtggatcagctaggcggcaccgcacgtctgcccttaccgcattaaatgcggtgagggacagttggggcgctgcgcattgatggttgttcagcctgggcccccttcctgctcgctccccccgccatatggcagctgggcgagggcctcggggcgaggcagcgggagagcctgaggggcacgacgtggcaccccgaggccccccggccacttctgtgactcgcgaggcgtgggagtagggccaggctgtagagccacgcggctggatagaaaggtaactttccctcacttcgcatacctctgggcccatacctccgacagatatagttgtagatttcaaatacgcgctgcatttcaagtttgtagtcacattgcagtggtttaaaatttcacatttcatctaaaatagaaataaaataatttatgtaaatattattgacgtaatcaaatattcagatccaaagatctaaagttatgctgatccggccttatatgtactgaacacaacatacccatgcattcgagcctccatgggtacggtccagcaacgatgtcagggaccacaggaatagcggtggcgatggtgacatgcttcggaggggcacgtacggcgatggtgatgacaacgagcttttagatgtgatgaacacaacaatagttgcctcgtcttcattgatggtaacagggaagataagcgacgcagacatcaccaccacaacatgagcgcgccaacatgtagacctacaacggagatatgtatttttgattttataccatgtagatcatttgtcttatttaaaagatgtataaattaaaaataaataaaacgtacataagtgcctttagtcatagaatagattaaaagatatagttttcgaataagataaatggtcaaacgtacatctattatatctatctattatatactaaaatcaattaaactttctacaaacactcctaggttgccatgtggtatcctataaacgctctcgagtcaccatgtgacactctaataaaatagtaaaaatctgaccattaattttcatttaaattgatgggcccattaatttttatcgttagatttatttcacgtggaaaaaaaatctccgtccggagtccggatgtcagccttcatgcgcacgtacgtacaatccccgcaaggctccaaccaccgttcctctcttttttctataatccccataacaattaaagttaaatactttcttatgggcctaaaaagcccatcaacatattatatctagccaactcttcatatatactctcctaataaaattcaacatcatacaaatatttgtaaatacatttccagattcgttgttcttaaatatgtcatatcatattctaatttgagtttttatggaacggagggaatatatagcactcttaaattagaggaaatcttaaaaaaaataaaacattcgacaatcgatttacattattttaggttattagatcgatctttttcaacaaaaaaacatcccaaatcttcctccgcgctcccatgcggcgtcaaaacatattaaccatcttataaatgtttctaaaccacccagggacacactaggggtctctcttaagttaaaaaaatcgtacaaaattatgtgaggaaaagcaaaacatccgaccattagtttcgcttaaacatccaacacattattttaggttgttagatcaatctttttttatgaaaaaacaccctctccctctctctctctccccgtgcggtgtgtatcgttccttttctcttatttttatgtttatttatgataattaaaattaaaattatctttatggagaaaaaaccacaaatgaaccctccacatataaggtctagccaggtatcccactgtccctattcttctctttctcctcttagaactaatagaaacaatataaataaaaataattataacttttcaaatcatatattcaacttatgatctatttgaactattatatttttagtgaaatcatatattcatattgactatatttaaatgccaacataaaaagtacattccggacccacatccaccttgaggccaacactaaatataaaatatattaaaattcgtcattgaaaatcggaatatcgcaccttaatttttaataaagctggtatacccattagttatatcctgatagacacctaacaactttctatcaacttaattattttttctcaacatgtatatgggggctatttgcctatacaatttgatcttggagctttttatcaataaatgattgacttaggagataaataaataatctttaggtggtcatagcatctaaattatatatatgatcaatgaagtcactaataaattagagaaaaactttaaatgatattgtttttagtcataatgtgtagcccatctagcgttaattttttatagacaacataatgaaaataaaaacatgctcggttgaacatcatattgatcgtacaagcaagtgggttgcaacaaagaatcttatcagtgaaacaatgatgaggtggccttaccaatataatgagtcactttcatataggaattaaaaatcatgttcatttatttctttttgtagaacttgctacaatacgttgtaaatttctaacatttagtgtagaacaatctagaaatgtgtatttattacatgacctctattttaatattcttactctactgaagtgagataatttagaagagaaaactttaccccatatcaggttgtaggctcaacccacttatgttttcaacccaaattgcagagatcaaataatttcaaaagatgcttcatagaatagaattctccaaatttctttaaaaaatggacatgaaaacaaataaaatttatctattttttttataaaaaattggttttaaaacccattctaaatagaaatattcaaacttttagcagcgctaatggaatgaaaatatgtaaaacttcaaatagcataaaaaaaattagacattttgagcaaatgtttgggggtaagatatctctgtaggaagtcaaaattcccaaaatttactcataggaactacacatattgtttcgacataatattttctcataaattaagaagtgtacgttcacaagtaattttagtttagaatttatgcgctgtaaaggtaatcagaagaaaattataaccagcattcaaaacacattaaataagttcaattcttatttagatatagtaaaagaatattttaaaacaaagtcacacacacatggacattcataataaaattttacgtacattaaataaggtgcacgcgcatgtgcgcgggctaccttcctagttatatatatactaaaagtccattaaactttctacaaacgctcctaagcctccacgtgacatcctataaacactcctaagtcgccatgtggcactgtaatttatagaaatttataaaaattctctagccattgatcttcattaaattaggtggacccaatatttaccaccattaaatttattaaaaaagattgcctaacccccaaaccgggtccaccttgagcctgtacgtattaccatatgtataggtatgttttttttaagatagtacttatgtacgtacttccaccccttcttccctcaatttcttcatatttttgcacacatttattcttctattatcatactttttagaaaaaaaaaaacttttgtgctgaacaattccgcaactatacatctaaaaatcataccacaaatttttaacctaccattgacaataaagtttaactggcctacttatagataaaattatggtctacgcttatcttgaggagcgcgactatatcacgggacccatgaataaggcattagagaaaactccttagtaactatagtcggcttcacccgatcgttacaggagcattcgtatataagtttaattttgttttatcctattaattggtagaagtggtgtttttaaatatttacatataaatttggacatctacgagacatgggcacttgggtatgatgtggagattaactttttatggtattaatgatgtatttggttttttgtctgcaattccatctattaaaaagacactcatgtttcaagacaatgaaaataagttatggtgaatgctgaatttatatataaccggaataaagtgatttttgattggatatgatagccattctgattatttagtacataccaaaatctatggtctataagagtctatttcttatagtgaatagccattccggtgagatattgcttcttttaacattgtttttatagacaataaataaattggccgcgcatctagcgcgggcatccgtcctagttaagagaaacagagtaactacgttacaacggctctacaaaacattcaatgagcacagtaagatcagctctcaagcggtcatcagcttccctgaggagttggtcgtcttctttcctgccacgggctacctgtggaatgtcctccagcgccgaaatctccgtgagctcggcgacctcggcagcttcgcgctgcagcagcagccgccggtgacgcgccttcatcgcctccatggccaccgcgagagccgcctccgccccctgcgcacgggcgaggcgctccacgagggacaccaccgcgccgacgtcggcctcctcggcgacggcgccggacagcagcagcagccgccgctgcgttcgacggacgacggcctcctcctccccgagccgcttccccgccgcgtcgatgccggcggcgaggtcgcggatcgggccctcgacagcgaggcgctgggacgcggcgcggcgcagccgctcctcgtgccccgcccgcctcgaccgcgccgcgtcgcgcgccagcgccgccatcggcgcgctcccctcggagtagagcgcctccaggtcgtcgagcgccgccgtgacggccgcggggaagctggcggcgacgacgccgcgggggcgtcgccggagcaggaggcggatgcggccggtgtcgctggcggtgtcgcgggatagcagctgctctatgacaaggcggatgtacgccgccgcctgtggttggtcggcggcggcggcggccggagaagaagggaggtgatcttgcgtagctgcagccatgggttcttctacaggtttcgattggtgtgtgtgcgtcgccatggatggatcatggatggcgagctatatggcgcgtggaaactgtttgatcgagtccgattagcagtcggagaagaacgagggactgatcggatgagaactgaacattccgattaagcaccggaatcggacttcctaatggagcagataattttctggttcgaagcagggtttccgaaatttttggaatttcagtacttctttccctaattattttttgaaagtttgacgaattttgaatgaatttgaataaattttaaacaaattcacaaaaactgaaaaaagataatcggaaactttcgtgtgaaatatgtgcttgccggtgggggcgaaattaccgaagtttcagaatttcgttccggaattgtaatctcaggttcaaagctatcgacggttccgagaactagtacaatagaatataaaaaaatattgatttcattactaaaccactgagacgaaatatagatttgcattgcacgaagtgcctcaatggacatactctgtttttacatgtaagcaacaaagagtaggtcctgaaaatctatgaaaaatatgtagtgcaaaccacgtatacactaaaaatctgaaaacggtcgttagatctaaaaatagacatatgagttttatccacgtcaaccaaagtaatgctgggagtaaaatttttactctagttgacgtggacaaatctcatgcgttcatttttagatacagcgatagtttttagtttccactacatatttttcctaggtataaatgcagttcatccgtataagcaatccatatatgttgtttatataggcggacttggtgacggcgagtcaccatgagcccaacgctggatgaagtgattcttattatgaaactataggtgaatgacatagacaatgtactttttatgtgaaaaaacataacaaagaaaaccatagctaggcatgcatcgaatagtgatcatcactgttgatgcgttccttacaaatatacaaatatagacgatatataacaatatgccatcgcaccctactcatcatatagatttgtagttctagtgaaaaactacacccgctatctaaaaatataactaccttaagataatatagctatattttaatatggagatagtaattcaaatatgttgcatactaaaatcccaattacatatctaacaattttaactaattttcaacattacctatctgcgatcctcctagatattccatcaaccttgcatgttctttacaatctagatagcctttaatagtaaagcttttctcaaaaccaaaaatatagaatcaggattatgaccatgaaaagaaaaaaataaacagaccaacgaatggacacatatatgattttcgcaactttaatatgaatatttataaagataattgtattcaaagtttgacttacatgtctgacatgttcaaaacgccatgcatgtttctgtgaaccaagggaagtaaaatacatactcaatctaattttaaatttacgacgttatttatttttatatgtggcattcgaccatgagtgttatgtatatatatatagagggacgctccggtgctttttactgaaagtattatacttcaagtagaaataatctaaaccgtttattttaaatggtagattagtaatgtactgatataaactgggggtaattttggcaccagttgttttgtccgtctatgggctgtgcagactctgggcctgtgcggactcgtgtggaccaactaatgacgtgggcccaggtgtgtatgtgattaagaaagaacgtacgtccgatcagaaaagaacgtgtcagattaggctatgctatagcgtcaagaaaactggattaaagtttttaaacacaataaaattcggtttcaatttcagaccaaatttatcatgatttcatctggatggtctggatcgggttgacaacggaaaaaaggaaaaatatttacgtctgcaattcattcggttagtccagagtccagacaggcttaccaacaaaaacacatggtttttcatagtgcacacatagattagagcagtactagtattttagataaaatatgttacttccaaaattcattcgggactattcgggccgggtcgataacaaaagcacgtggtttttttgtcgtgaacacatagattagaggagaactactattttatcacaaaatatgtgggactcgagaaacacccaacggtattctagctagctccgcaagatggtgggttaggcctaactttgaagcctcacccattctatttatttgatattatgtcctttgctaatatttgtgtttttcatatgtggggctcagtcaaaatcgttttaaccgaatttatctgaaattcaaatgggactgtccgtcttaatcataaacaactcgattaaagtttttgaaataatttaacatccaaaatcgtttctatttttagatgaattttatccaaatttcaaacgagactgtctggaccgggcctaaatccaaatttcaatcgaaacactccaatccaactatgatagatacagggcaacggaagaataaaccggtatgtttttttatagggacttcacaattgcaataacaagtagtatacattcagccaaaaaagctatgatatacacagatcgacactttcagaaccacaaacttctcttttcaatattttgcgacgccataaccttgttagcatgacgggttttaactgcaccaaagataatataagatgctgatttataggtgaacaaagcgagaacatataacagtgaatattcagaagtcatggaatagacatgtagagtttttctttgtcttgccactcttctatatattctctgtccgagaagaatgtgcctcactctaccttgttctgcagaagttatgacatatcgatcacacattgtgctgaaaatatcatcacaagctgaaaaagtttttctttgtattgcctcactctgccttgttctgcagaaattatgacatattaatcacacacattgtgctgaaaaatatcatcaaattgataaaaacaactgacactacgccagatcctcacacctctgacgggatacctgtgacaggcaaacgaattggtcagtagtgaccgttacctttgacgggttatacgggatgccgtcaccggtgaggcatctggccgcggcccgtcacaggtatccgctcacctgtgacgggccgaaaggaaaacccgtcagaggtataccagtgacgagtttttcttccaacccgtcactggtatcccctcacctgtgacgggccgatacattagaagccgtcagaggtgatgggccgccacctgtgacggctttcatttgtggcccgtcacaggtgagcggataccagtgacgggccattgaatagaagcccgtcaaaggtatgagcaatacctttgacgggctttttttatctaacccgtttgaggtgtgttggctctataaatacccccaaactgccaactgctttccatcccgaccattgtactgttcacaaatcggttgggagggcaaggggggcgattttttgctaaaatttaaggtaaaaaacacattattctccattcattctcaacatatcgatcatcatttatttttcttcgtatgttgttgatttcagatggatcgtagatggatgtactatgcgcatcgttcgtctaccgagtatagagagggggtcactgaatttgtcacatttgcggataatgacagaaaaagtaggatgagcatgcacatgttgtgcccatgtagggactgtaagaatgaacagatgatcgaagacaaggatgaagtgcatgctcatttgataatgaatggattcatgaagaaatatacctgctggaccaagcatggagagcaagaggcgcctgatgtcgcagctgaagaagtgttagatcaggatgtagagaacaccgccgcagctcgagaaggcatgttcgtaccttctcctttaggtggagagaccatagatttggacactcaatgtctatctacaatgttgcatgacattgaagacgcagaggacaacgacagagattatgagaagtttagtaagttggtggaagattgccagatgccgttgtatgatgaatgcaagtcgaagcacagcaagttgtcatgcgtgttggaactcatgaagcttaaggctagtaatggctggtcggacaagagttttacagaactccttgagctgttaaaggatctgttgccagaggggaacaatttacctcagacgacatatgaagcgaagcaagtattatgtccgttgggcctggaggtcagaagaat

SEQ ID NO: 59695 - DNA, 3054 bp, Oryza sativa
gtgacactatagaatactcaagcttgggctgctcccatgtcgctctcgctgcatgtgaatgatttcctctcatccgctcgcgatttccaccggatttcccattaaccaaaagccatcgtcctcgcggcgagctcggtgcaaccactgcttccacctaccacttctactactcatacacgcagtgccattggtgtccacctcgatcgatctctcccctcacaatcctctctcacgtacgcaagctagctagctatctagccatgtcgatcagtccacgcttcttggccgtcgccgccgtcctcgccggcgcgatgtactccgccgcgacggtggccgcggacacgccgggcggcagctgcccgtacccgtgcctcccgccgccgatcgccggtggcgcggtgaacagctaccctccgccgccgcccgcggggagtagtagcagcagcagctcaggtggaggcgatggcggcgccggcgggttgtttggcgggacctacccgccgccgccgcccggggtgatgcctggggccttcgctccgccgttcggcggcgggttcccgtacgggccagcgccgccgccgcccaacccgatcctgccgtggttcccgtggtactaccagcacaacaaccccatcaccgggtcgacgacgtcggcggcggcggtgggccggacgccggcgagcatggtcacgacggtggtgttgctcccgctgttcttggttgctcttcttcgtgtgctgtagagtgcttaataaattctaatttgtcgctaggagtgttttgctaggtaattagtaagatgttttatgtacaacctggtttttgttaactgagatgatctatggagttacttttacgaaattattattatgatgatcatgatgatgtgagtatcgagaaatgcttgtcctttttttttttttgttcattataggtttcacaagttcatgaaatatggggtgaattatggataaacttcaccttggtgatttaaagttttttttgttaaaaaaaagtacctttcaaagattaattgtaaaagaaagttccaacttttttggagttcgaacaaacaaaaaaaaaggataatattgacagaacacagtcacacaatttgatcacctagccagtatgcctcctttctgaatcaaccgtgttctactttttgttcttatcgtcaaagtttcgaggtgaaaaggcgtttttcccactcacctttcaggcattcagctgtcaatcatagagaggctactgaagcttctagctagcattgtattgatgccatctctgtttgttcagatgtcaaagtctagcaattaaatcagtaggaaagcatcagcttgtaaattcatatctaggcccacatttgcccgtttttccgtgcctgtaccacacctttcttgactggattttctggaacatatatataacttgccacagaaccttctaatttaaacagtgccaaacatgaattaatacatttgcgattgtgctcacaaccttaatttgaactaaacatttcctcgataatccgttttatattctagaactggtcattgcccagaagactagaaccggaagatgacaagaacgaagaacacgttgccccctttacctggaaatctggacgtttctttctcgcgtcacaaattgccagttggtagtgagagtccagctaatggcgacgacggtttctgggagatatggtgacgtgagggctatcctgtttcccttttcggttttgatatagaggtactacaagaatgaaactgttggcttattgaaaggaaaaagggaatggaattatgcaagtgcccaagaagttatcatcggccaattcgtcccatacatgcatatataattgcatacacggatacaccaaccgaaaaaaaaggttcttttttctctttggggcctagctagcctgctaaagtcaggtactgcagagtacgtactctaccaaactctcgaggagctgattcattttatcatcagaaaatggatggccaaccagaacaaacaagtccttagcccagaaattgaaatttcggattttcttttttttaagtcagttaaaattattaaatgttaataattttgtactccatgcatattatgctcccatttattataataattactaataacataaaaaaccacatgagaaggacgtattaatattaattcagatctattcaatagtttattctctatacaattgagtggacaaggatcattaaattatatatagatccaagtatttaaagaagagtaaaatgcaccaacggtccttaaatttgtcaggaggtttcacttaggtccacaaacttgcaaagcgcacatcgaggtccctaaacttggtttattgtatcatcctggtccaaaaccgcgtttgaccgtggtcttggctacgtggcatgccacgtggatgatgacatggaatttttttatattttttgcttccttctttttttttctcccttcttcctttttttctctcctgtgcctccgccggtcgacacgggagcgggggcgaagagggggggcggcggcaggtacaagggcaggcgtcggcgagctcggcgcgcgcggggggaggtgttgccgaccggggttggcgagctcggcgtgagcggggcagacacgagctcgacggcggcagggtgagctcgacttgagcagcgacgactgggagaggaggacggcggcgctgtgtgcgtgcggggggtggtgttgccggccgcggcccgaggggaggtgtcgccgaccgcagctgcgcgtgaggggggaggcatcggcgagcaaggcgcgagctcaacggcgacagcggggcggcagggcgagcttgagctctctccccccccctccatcggcgagcttgaggtctctcccctcccctctcggaccgcgacggcgacgaggacagcgcgtcgatgcgagcgagcgaggggggcggagatggtggatacgaggaggagcgcggcggccaagcgcccggtggcggaggaggaccagggaggaggagaaggcggcggcgccggctgctgttgtggc

SEQ ID NO: 59696 - DNA, 776 bp, Oryza sativa
aaccacaagaacaaatcccaatttttccaggaacaaatccaattgcaaagaacatatgcaatgaaaaggattcagagggctcttaggtttttccatttggcttgtcctacagtcaaggtcggctctgataccaacttgtcacgcccagaaattcccgaatagaattccaagcagaatgtgcattaaaatccccgtccaggaccatccggggtacacaaacgacaaagttgacatacagatccacgtcttacaaacattataaaagtcttacaaaaatgcagcggaaaacttaaaggataactggagctaagccttgacttggacttgcagcgggaacaccactccacaggcatcctcgacggcacgggcgaagcctactcctcggaaagaccaccatctgacgcatactcaaattctggggtttggggaaaatagagcaagactgagtactacccactgtactcagcaagtcataccggaataggggtatgatgcagggaattatcaagggatagctataatggttcatttgcataaagcgagcatttataaacagaagttgaaagcagtaaaacagctgtaataattaatcaatattaaccatccactgttcaacgctacaccacgttgcaacaggcccaaccatccacctgaactaatcagttccaacagactacactagggtgaagctaatcatggtgaatctggttgaccgcccataaccgcgggcacggctattcgaatagttttactctgatcagaggtgtacaactgta

SEQ ID NO: 59697 - DNA, 6647 bp, Oryza sativa
cctcttcccccagtcaccgccgcgcgctcgcctccgacagtgacggcgccatggcgtgcagtggcgccaccccttctccccccatcgccaccgctgtcctcccccatcaacgccgtcatcttccttccccgtcgcaacatgccccagcacgctcgccaccgtcgcgcgctcgcctccagcagtggcggcacccatggcgtgcggtggcggcggcgcgttcgcgtgcgccacgcgtgcccatagaggagaggagagggcagcggctcggttgtgaaggagggagaaaaaaaagaaagaagggagaaaaaaattccatgtcatcatccacatggcgtgctacgtaggcaagaccacggtcaaacgcagttttggaccgggatgatacctcgatgtgcgctttgtaagttcgtggacctaagtgaaaccttctgacaactttaaggaccgctggtgtattttactctttaaagaatatagcaatctaagctctccattgttgctatcaatgtgaataacatgtttaaacttaacacaaatggtattatagtggaattaacatgttcattcactagttgtggtatgaatataagtgaaatatcgctaaactcttcattatcacttgaaacaacaaacaaattattttgtgacaaaggtatttcatcaattgtttccattatgggttgctttaatatagcataagaacaagacatatttagcacatcataactatgcacgccttgagtaaatgtagtaccattatcattatcaatgttctcatcttcagaaattgtaggtgctagctcaattaaactttcttgaagcatgcatagaacaacgggtaggtcgtcctgttgtatgtctttcttcacttccttattaccttggttgttatcagatacctgccaaatgttagaaacagatcggccaatccaaaactcatgctccaagtggcggttgacgcgctgtagtagtggcggaggatggtcgtgtgctcgctggcggtggcgtagtatgaaaagttgtggatggcttagcttgtgcaatcatggtcgatgttcttcgcatgagggagttgctaatcttgcttttgttcttttgctagtgtacctgcaactctttctctgcaatcataggaagctagaacaaagattgacaatagtatattctttataataaacaatatcttgaatttcatgcctccacccacgataaaaatgacaaattttatcctttatttcctctactaccccgcaacatttaataccctaattgagctcttcatagtattcatgaacaatcaaattaccatgttctagtcattgaaatctcttacgcaaatcacacaggtaggaaggaggaacaaatgtaccaggttgtaagtgggaactacctgttaatggcatcactagctcggatatgaccttggcccttatgtattcatcaaacaaaggtgcatgctttctatgtgagatttacgtattatatatttgaataaacattattacatcatgagttttgtgtgttctcgtttgcaaaggtacatgcttgggtaaaaggagagagaccaagcgcaaggcataataaatggctgatcgaataagttgattggggaccaaaccaagatctttcccaagtcttatcctacagtacaacgtcactttctgtcaatggaagtcaagatataaagttcggcatgttttggattcagattcggacttcgtgatagcgccaacttctaatggacctagccgctaatctagaaggaatctcggggcccatgagtacttgttggaaagcatatggaatctactttcagatggtttggtcccacatcaaaactcctatcaagctgtcaagaatctgcaaaacaagccacgaagctcatcaagtccgattctaatttgggccttgattcttgtaatggtgccctgagctaagcccaaggggtgtacgcccgagggctaaccctaggatgtccttaatcatatttatttagtagctgtcatattatagtctgatttttcttagattatttttgccattgtagtttcaccgctagtttggtttgtggaagcccaactttgagatcttaatcattcatctgcaaattgagttgcaatctaccttgttcttacttgtgttcttcgattctcatgcaatgattagtcttctcggtgaggcaaactgagcggcgcacggttgatgaccagaggagcgtggtattgcaattgcactgaacggatcgtgctgatcgaaagctgtaccatatgtgtcaagtttccaccaaatcgagagttattaatacctatcagaaggttgggaccctagttcactacctagatcattccaccaaattatcgcaaagtccttcaacacaccagtagcttgactaaccctatgtacctatggaactaggtgtgaattaaacttctgttgtactgtcatccccgaatcaaaatatgcctcaacatcataagcaatagaaaataatggaatactaaacttgacattagcaaaattattacctcccatacattgatgattgcagcgaaggcattgacatagtcattcatcttatgttgcttgctggtgaacctctccatgttcatgggtaccatctcgaaggagtagacggcccttcaactcgtcaagtatgtcgttaagactagctaaccgtcattccaaaagctcaatgaaattggttatgtctaaattggccatagcatcatccaaccttttcatcatttggtctattgttccctacctctgagtgcgaaaacctttggactattttctcctgttgacattgttagcgaaaacatataatagaaaacaaaaactcaaaaggattatccctatcagctactagacaaggatcgcagtggaggctagcaaatgaaagcatcttaccaagctcttacaagtgttttaccaattatgctaagtatggtataaccgatggctggttcgtgatactggagggcatgatctggcgattgaaaagggtcgaagctgtactgagcgagaagcatgtatgtggagcttaggaggccaaatttattgaagcaaaggaaagcaattgtgccaatcagaaaaatgtataataatagttcaaagtactagtaaatgtgttggtctagcctagactcaaactctagctcaagcaagcaccaaacaacactaagggtgtgtttgaggaggagattgggaagatacgcaaaacgaggtgagccattagcgaatgattaattgagtattaactattttaaatttcaaaaatggattaatatgatttttaaagcaactttcctatagttgcaaaaaacgcaccgtttagtagtttgggaagcgtgcgtgcggaaacgaggtgctttgtcaccctatctcacacaaacgaacgcagcctaaggactagatataaatcaatgcacaactctacactctaaacacaaaatcaaaggagtcactgaaattttctttttcacttttttcttttcgttcttttctttctttcttatttggtgcaccttttttttctttttttttcaactttctatctttttctatttgctttttttccctaattttttaacaggaactaaccaaatatctaaatcaggaaccaaaagttactgtgaggaaaacaatggtctcggccgcctttctggagtagactggcttgcaaaaaaaaaagaaaaatcgaatattaattctatctatgtactgaagctggtgtagatctatctgttttcctagtccttctcatcctaactcccaacacatataagcacggactatgttacatggaaatcgtaacacttgatgccacttcacaaccgaccgaaagaaactcttgcaaactgcaaaaaggggaacccgatgatgatagggttcaattttctagttgcagatgaatgattacgaattcgatgttggggttcttcaaattgactaacagcgaaatagcatgacgacatattaatctaagcaaaatttgactatggctgctactaaatatatatgattagagacgtcctagagttaggcgtttaccccttgggcttagtccacaacacaattataagacccacagacaaatcagacttggactggataagatacgtggcctgttttgcagattcctgacaactcaggaggaattttaatgtgggaacttgaccatctgaaagtagatttaataagctttccaacaagtattcatgggtcccgaaagtccttctggatcaacggctaggtgtgtttgaagttgatattttcgaaggcttgaatcctaatctagaatatgcagaacttaacctcttcccataaatggaccaaaagtgatgtggtggtgaaggagtagacttgaggaaagttttggttttatccccaatcaacttttttgatcatccatgcataccttgctctcggtctgttttccatcacccaagatagtacatctacaacgagaacacaaaaaactcatggtgcagtaaagtttgttcaaatatataacacataaatcttccgtagaaagcatgctccttggattgatgaatacatagggcctcctggaaacatttcaaagcgtaaaccaaacgtccattggttatgcattttgttgtagaagcgtgaagaggataataaatagtaataaatactacaatactccctccgtactcgtaaaggaagtctttttggacaatgtttaagtcaaaccttgggaatataaatcttgaataactctcaagttgttgagtttggaaatgtaaaaattatatgaatatatttttcttgaaaaataatttcataaaagtatacatatatcacttttctataaatatttttatagaaacaagaagtcaaagttgtgttttggagaccatgtcgctgtccaaaacaacttccattacgagtacggagagagcatagctttttgccagccatggatgaagatttggcagcatagtttgcttttgaaaatttcttgtcattcaatcgaatcgtgttggtgttactatgttttatggatgctgatggttgtgatgtaaactttgtaataatttagctttacttttttagattagttggatctatgccattacagatttactggttttgaaaaatactatcaaaattcgttaaaccagctatgtgtcaccgagattttctaaaattcaaacaggccattgaccgccattattgttaagtttcctgtcaccttctcccctaatctcattccatctggatgtgagaccgagtgtgtgtgcatgggggggaggggtggggggggatcgccggtgacgatcagtgtcccatcgttgtcagcgagcttcgaccaactggttctctaattttccaatcatggtttgggcactcaaaatctgaagaacattctttcttttttacttttccgccgttggcttgtgaaaaacattatcttcctttgtatggccttcaattattttatatcataatagaggatgtctcagaaaagtaaactcaaataattgaccattatagttccataatatttcttcaatgtagtagctctcttttctgtactccttgaggtaatggtggtggcagtgaatctattttggcaaaactaattttaaaactattttggcaactgtgaatataatttaagaacaacaaacagcagaaattaaatatccatttaagttcctaaccttttaatacaagtaaaggaactatagcattaaacatatacattaaaagtagaaattaaacttactatcttcacctgactttgaataaaataaaataaaaagctgaatccttgatagattaaccaagtatcaaaagctcgactaatgggaaaaaaggaatcgaatatcactccaaatgaccaatgggagattaattttaccctctaaaatgccatgaaactacctaaatgaaattcccaaagtttgtaaagtatttatctcccaataaatctggaactctcaaataaatgaagcattagaaatgaataagtctttctttggaggaaatatgaaaatatgtatccaaatttgaaggagttaatatcttcaaatccaagttacctgtgtcttctagcatctccatattttttatttagacctttttaataaataatttagaaattaaccattgcaaaacttatttcaatgatctgaacattttggccaacccagcccacctcgccatcccaccagctgctgtggctaaaaaatgttggcatgcaagctaggtaatcgtggcaaccatcgccacacaggaggtcgttccccgctcggagtcaaccacattctgacatggcattgtgcttgaaatgccagcgcaagtggtgtcgcacttcttgttgtcaacggtatttacgttggtaatgttgtggtcataatgtcatatatgtgagggaatgcatttgtagttatatcttttttttctaatttggacgtgtagatcgtgcgtacaatgtctatgtctccttgtgtgtagaagtcgttggtttgcttggatcgattgacaagttatacttattttgcatgtcaatattattttgttgtagatggatcgtgtactgcacgtagggaaaatatgtggtggaaaccatatatgcaatagaaacttgtaaactaccgttggatcgaaaaatg

SEQ ID NO: 59698 - DNA, 29783 bp, Oryza sativa
actcatgatgacatggacgaatctcggacgtccatttttcgatccaacggtagttttcaaattttcaccacatatttgcatgtgcatgtacattagggtggaacaatttgttgtgatggacaatttacaaatatgaaagttgatgtggtagtatttgaggccacacttacatagttaggattattctatcggatttgttctaaatttccttctttagaacccattggtgcgttaagcatggaagggatgtacgatgcaggcatgtgatcaagggagcacttttttttatcatacccatatcacgtgagttggagttgtcgacatatgttgcatgtgttcaagatttgcatgtacgctaagtacatgttgttgcatcaatgtttgggatacttcgtgcaacggtagatccgatttcagtcgattatacaaatattttggaaagacctcaagaatatagatacttcaacacaggtggacccatagtcgaggtagatgaacatgccaatgagggtattgttcaattaagtgagcataataataccccaatttatatggatattaaaaccgttggtcagggtaataggcatgtcaatggaaccaatgttgtactaatcccatgtggcactatgcaccatcggctaggcttgaatcagacctagcccacagtgcactccttctccctcttggcccagctattgtctctgccccactcaccatctttcctagcagtacaacgtacgaccccagcaggagaagaaaggcaggccatccctgcgaccattgcaacctggccgtcaccttctcgcccgctacgccaccagctgcctgccactgccgatgcacgccaagccaggctgcgtgcaggtcaagggatcgatccctcctcccaattcatggaatttgatttttctagaaaatagcatagggcagccggactgctttgaggttttatgtaaaacagggtggtttaaactctttttaccagctcatatgcatccctggtttcttaattggatcagactaaacttaggcctggttctggtttttagctaggttaaaccagtggtccactccggctttaataactactccctccgttccttaatacagggcgtggctgttgtagttgcaaagaccaataaaaccatttaaatagcagttacgatgattaattctctccgttcgaatagcaacgtttcagtagttgcgcgatagatacgctagcattaattaaccaccatgcatgcagcgtgcgctcgacctgcactttccgcgcgaatagccagcatgtatgcagatgcatttaaaagacaaaccaagtcatcagttaattctgcaggcaccagtagtacaggagccgaggaatactaattaattcatgcatgcaccgaggagctaccaccttgtattatgaaatccagttgaaaagaagttacgccctgtatttaggaacggagggagtatgttattacccacttccaggccagtcgagcataaccacaccatgctagaagcaacagttaggctagcgtgttagacttatgggcttccgatttgtttctctgggtgtcatataatccttaatgtcatccttgcatgcataagttggacagcgcatagctgatatatgagtatattctactcttactgaaaagaacgcatatttttttctttcatattttatagtgtctcgatttttttaaccaatttatatttctatgcaaaagcaatcagtattgcaaactcaaataatccggttacaagacgaatctccggcatggctattggttggtgcttgtagacaagctatctgctattatttaaatactttaaaattattgaaaatatcttctattataatatgtgttttatccgggctaatcaaattatgaaactctagtacatatgaattatctcttttggaagttgaatagcttaagtgagaatccgaaaaggatggcaaaaagaattgcaaatgacacaacggccatagcagccacccataacaagtcaagattgtaaccaaagtagctctcaacaaagtcagatacacgcacaccgttatcaaacttgtcatctacatccccaaactgtgaagtaaccaacccattgattgtccatgcaacagggcaaatccaatagtaccatctccaccatattggaattctctgcagataaaaggagccatatttaggaaaactaggagtgaagtttggtagtacttcttaattttttttctagtcttggctttgagataatttggctaggaaccttgtatacattgatatttgagaaaagctagtatacttaactgtttttggtattagaaatccagagaaaaggtgccatatggcatagaaagttgtggaaacaatagaggacatggtgtagtttggagttagacctgccgccatcatgccataaaatgtgaagtatgatagagtgaagtacatgaagaacatgtaccaaaaaaacttggtgcatgtccactcgtatcccatcatagaatacactatcacaccatatatcaaggtttggaggaagatgtaaggaagttcaactacaacctgcaatagaactagatgttaacaaagcttattcatttatcatttctgtccacttaccaagggttttagttttgtagaaattgaacacaatcttgaaacattatatctagcctcatgtgtaaacactatgatgccaaagaaccatacctgccccaaggcatatggcaaaggcgagtacatgtgagatgctctttccctgtaaaagaccgtgcgttcaatattgacaactggttgaactgaagaagagttctgcactcctagagtgaaacatgtggaatacatggaacccatggcactgagcaaggcttgttgactttgcctatgagaaaggaatatttagggtaagcatggtccaatggcaacctttaaaatctgtaaagaaaatcacaaatataaaatatttccttgtgtttattgttatatatatttacctttttctaccaacgccccagaacattgttccaaacaatagtgcaattacaacggtgaagaagaaattcacagcaatatatggaggattcctccaatatgacaaacgttgcttccagaggcaagccaaacattgtataacaaaggtctgtgaatatttagttggaaacaataagtcgcttgaaccgtcatggggtgtgcttaactcctttatcaaatttttgttcctcctgtagggaaaacaaagcactaatatcatcaaacaataacattacctattaaatttttcatatatttgaaacattcattataaaagtgtaaattgcagatcttttgaagcatctgtagtttagcattatgatatcatcacaatatatgattcatgtagggatattttttgcttttgccactaccttgtattgttatttcatttctttactaatattgaaaaaaacttatattattgttttttcagaatatcatatttgtaattttagttgtttccccagcttgttgaaaattgtttagacatgcataaaaggacaccattgtcttctcttttttcaacctatacttaagtaactaatgatagaacaaagtattttctacataccacaaacatggacacatttatcacatataccattatggaaccagacatcttgcacatcacacaaagtttgattttcatctaggttttctgttgctggagcaacgattaaaggtatatagtcagactattaactaaaggatgaccccatccctacctatatagttcagaattcttgtatacttgagtaaagttaaccccagttatctgttcctgcaatgtacaagtcacttccagcatccatgttgaaggattgtagccatgttttatcttcctgacaccttcaatagactttaaaaatgaaagcagttcaatagcatgtttctgagtgcaaaaattcaagcatgtattacattatgcgatttttttctaacctcaaaatatttgatcaattcacatgaatgttgtcctaatggacctacataaattgcttcacctcctcttttcattaggaagagctgtaaatatgaacaataccagaaggaattgagtgggatgcaaataatgttaatccaccagtgatttacttttttcttgtatacccattaaatctgtgtgagaaaatgcactatattgctataattttgttcacctcatcaaatgattcaaatatatcaatactaggttggtggattgtgcaaacaacagttcttcccatgtccacaatattccttactgtcctcatgacaatggctgctgctcgtgcatcaagtccagatgttggttcatccatgaatatgatagatgggtttgcaactagttccactgctattgttagccgtttcctttgttcagttgataatccactcaagccaagcaatccaaccaatgcatcttttaagggaaagagctccacaagctccatgaactcatcaataaatctctacaaaccaagcacacgaaaaaagactagcatgtcatgtcatgatacgtacttatatactacttgacgttcaaaaaagtgtttctttcatgtctaacctttcttgccatagaatcaatttcggctggtaatctaagccatgctgagaacataagggattcatagacagttagatttggtgaatggatatcattttgttcacaatatcctgaaactcgagaaaatgtttcttgcttcttcggatagccagatacagtaatattaccatgtatgtgtccactggtcttcctcccagctaacacatccaacaatgttgtcttgcctgcaccactgatacccataagtgctgtaagcactcctggcctaaatgaaccactaagatccttcagtagttccaaccgactccctgccataccctgtactttcagtgcctacatgttttgttggataaagacaattatatatggagtttgctcataaatgttatgtttataggcgatttatagatagaacatgcatgtcaagaccagacaaaggaatatttgtgtacctttggcatgtctatactgtatcttatatcttcaaatgtcatgtaaacgggtacaaaaggcaggatacttcctttcctggctggactagaattatgatttgcattgcttgaagttgcttcatcattgttgccaccctcagtgtctagtagacataacacagaagaaagttatataatttattaaattaaatctcattgtgatatatagtattttatattggtgaatataaaattacatcttttatcattggtaactcggcctccagatgatggctcttgatcataaccggttaaattttctagttttatctgcaatgtttcctgagacatttctcgcacatttcttttaagtactgcagagaacatggtgcataaatttagaatgtatagcccctttttaaaacaacaatagcttttactaatataagaaattcatttttttctctaactcacatgtgagaattgagaggcagatggtgtagaggatattgaacagaagcacatatccaagcaaggcaccaagaccaatccaataccatttggcctccgggaaaaccccacgagattccagaactaaccttccaagtggttctctaaaaccaggtagtgcctgataacaaaatgtttttaatggacatattatgatatatggatttcgattgattccataagtttttttttacctcattccagctgggacttaggaattcatttactgctaaggcatttagtgcatacatcaggggtgatgtccagtactcccatatcagccattttttaacttcatctgttaaatcaaacaaacatatcatacaatatgtatacaagtaccaacacatgtggaaataatatcagaagtaatgccaatatcatgtcgtgttttgtcagatagtttgtgtacctcttgataggatgaatccgcttgaaaccataactattagtatacagaattcactcacggtgcttgcaacaactggatgccttgtaagagcagcaatgaaacggaaaagtccacatattgcctcggacattacaaaaagcacaaggaattgtctaaaacatctacaagattgcattgttttcattaatctttgcaatatattcattacaagaatttgtccgatgtattgaattttgtttttcttacctctctatatttggatcaaatccaataacatagtatgttatggagacccaaattattgtattaaggaaggagattggagtcttaatgatccatgatggcaaggaatatgtccatgctggatagaagagtagatccctttgcttgaaaaaaactgggagatttgcaagagctgctcccatttctgccaaccctttaaacattattgccaacgtaccaaagaactgcactcccatgtacatcctcccgttttctatcgagtcatgatgcatatttgtatggataaagacactcattgcaattatcgccactagtgttaactgaacaagtcaaagaaataatgtaagagaggccaattagcttcaattgttccaaagaaattgtgggttgttttgctataatataatataaaatgtctcagattgtcagaatcacctgaagtgcattgaatatatatagaaatgattttcttttcaacagcaatatctctctgtcaatgttagctttaagtatttttttcaagttgacaccatgctttgatgttttcagcgctgcaatatggctcttgctgttatcaaatgggattgccaactcacttcttattgcctggccgacatggaaacactgaaatgcctcggcaatcactgtaacaggaatatatcgatatgtgtcatcgccatgtatccagtattgtttctgatctttccttgatgtaacctatcacatttcactcatatttagtaacaattatacactgcaaccaaatttaatcatctgatactaccatgattgaacatagtgagaaaactcacttcttgcaagaagtcagctacacctattctttctaggcatttgaatcccaacgatttaaagaactcaagcacatgatcacgagggccactatagacaacttgaccatctgagaggagaattatatcatcaaataattcatatgtctcgggtgcaggctgtagcaaagcaatgacagctgttccaccaagaacatgaatggtttgttggatggtgttcactatctggaatgttgttgagctatcaagtccatttgatatctcgtccatgaaaagagctcgtcctagtgtgacaagcatctcagctgcagaatcaacattaggggctgtatgagcatccaaacatcttaagtaaatccaattctaaattacctgtagttagtcaccttttttgccctccagatatgcctctcaacatattatcacctacaattgtgtcggcgcatatatccaaccgcaaaatcttcaaatgataaaaaaataaagtaaaagaattattatcgcgtatacatgtgaacttacacatgaatgagaagaaattttcaacagataattttttttaccaggcctataagtagggttctagcagtatccagggacaaagggtggtaatttatttacctcagggaggtagtaagtttttagtggaccaaatggtaggatgaggaagcggaatagaaaaataagaaaagggagggtgctgctctctgagacacgctacatattatgttgttctctgaggggcgttctatagcattgtatataagtagatagtgctcatatacctttagtatgtgatttgtaactatctcagctttctcctctcctgttgtagctgcctgcatatgcaaaatgagacattgatgttcatcaaaccttatactggaacattaatagatggtaaaaacatgaagagattgctcaacatactggataaggtgagttgtgatttaagaactccattgtaccttcaaatatatatcagtttcaggatctggtgtaatgttttcttcctcttctcttctcaatagttctagaaacagatctgaaaattttccataaaatgttagtttttcatatgatatgacactatgataagtttaaactccccatttcctgtcttaccatagtgatggccaactccttgacactttgcagagaaattgattgtctcacgaactgtcagttcagccatatgcagatcatgttggctaacataagctgcggatctttggggtataaatttgtccattgtatgcccattgtaagttatcatccccgataccttttgtaattgcattgtagtatttccttatattagtacggcaagcatactagattatatatactgaagacaaccagtaggccaaccaagtagcatggtaaaaaaattgaaaaacataaatgaaagtacttttacggttgatgggagtgttccagccaaggccaacaacagtgatgtttttccagagccaggagaacctaatagcaaggtcattctgaaaacagcaggataaaagttatatatagcatcgagataatttagacattgtcaattgctgagatgttatgacctgtgaggcttgatgatcccactagcattgtgaaggacagatattttttgcttacttcttgttgtcatgtgaagagtattcgccaggccctgtttagaggtgattgtcaatttttcaccatgtcactacacatggaatatagtaaaataagggagccatatgcagtaaatatttaggctgctgcaaaagtaatgtcatcttctaactaaaaacaatcgactatgcacagattccttgagttagagctacttgaattcggaagtaatggctatgaaccagtatttggtgtggggcgcaattttattcaaattggtatacgctggttctccaacatacagataggtattatttttattagaccttatttaccatctttatacctcttgcttcatttttttttcttttacattcattgcaactgtattatctcttccaccattaaaaaaaattgcacttctctcctttatcattcttcctccagtgcatagttttgcttctccatcacaaaaattctaacatatccaaaaataaatatacgtgtcacatgaattatggcttagctttgccataatccctaggggtggccgatatttatactcgtaggtcctttgagttcctcagcgaccttgctaaataattgaggctaatcagcttgtgcgaaggctcttgtctgactaggagtaagtactcttccttaatcagactctgttaccttgtctgttgcacatggccgtgtcgctaatgtttaggaactgttacaagatatgatacggtatatgtatttttggtatggtatatgtacgccaatacagtataccatatggagtagacgatcaccaccaccaccaccatcatcatcataattaaattcaccatgaaaatgatttggttcttaaatgtttcatgagataatatttaccgtggaattatgtgcatggatattattaaatatttgtggaaaatggtaaccatggtatatttatttttggatatggtagaatattttccttttataaacatctaattttgaaggtacagaggaaacctttcaatctaactgagaattttcctactgttgtatgtgatgtaaatttatagtgaagctatgactataacttctgttctattgtgatacggtattttcgaggttgtattcatgtagttcaacttttgatattttctagtacttcagtggtagcgatgtttttttttaattgtagctctagcatttcaactccatgtcctgaaaaaaaaacatggttgcggaaatggtttgagtatcttttccaatcatgttttatccctacctcctggtacctgcacctactcaaggatggtaaaaagactccttttattaataagatagtaagtttaacaaagtatgtaaataccttcaatatgttggcataggtattgagaatggtgggaaggcccctgctgccaacatatgactctgcttctacattcaggttcttgtacctcacctcaattgtcggcagtttaataccaaccctgtacaaacggaacatctttaaaattgagaaatggaaataagtttctaaatgaaactagcataattgaaaacattgcttttcccttatatttaagcatgcttgataaaataattatacgtgggcacgatatcaaatgaacacaactcaaaccatgcacacatgcacaaactccagtctaaccatccgatccatgatgggcgctcccacctcgcactaacatgaaatattgcaaaaagaaaaaaaccgcagagggaatacattttgcaaacaacctctatccttaggttcatatatcgacattgtcatccacacgaaatatgagcacgtgtggtatatatgatttaaaccttagacctctcactgatccatatatatccttcatgccatctcacctgtgaagcactttgtgactaggatcgatgctatttttgttgacttcacctctcttctaaactagtaacacacatttggcactttaaatgacattaaatgaaaatgtcgccaactacaacattgtaaaccttgttgagctctacaactatgacataaagcatgtctccataaaagttcatttgaaaaactgaaaaacattttttaaatagacctaagatattataataaatatttgtgccgtaaatgatctcaaattaaaaaaaatcaactacaaattttcatataaaatttatcatcatgtgacttcatatgaaaagttacaattttttcatgaaataattattctcccacttttaagggcgattttattaacacatccatctttgaaaatcaactttcacaggcttttccttatgagaaccacctatattgttcttagaagtggttccttaataagtccacatgtgaaaagatatttccttatttgtttgaaattgaccgattgaggtgtacaaatttcattatgatctttaagatattctctttattaaagccaggtccatatttcttcaaaacatttcttttaatattaatgaatgaccctactaaagaaaatatgaaccagctagttatattaaaagtgtcgacgggtttggtttgtttggaggatgtaggcatcggttggtatgaggatgccaaccaagttgtaaagtgagtaaggagatagtgatttttatacaggtttgggtccccctactgacgggtaatagcactactcctattgaccggagccgatgttgcctttatatatcaatctctcgtgaatacaacacgaagaaaaacctaatataatctaccaatatatgtgtgtgaagctcgttcatgtggtcgatggctagctattatcggttttcttgggaagtaactttttgagattggaggtggcttgtattgatttgtacctctcacgggttgtcttggctttgaaggcttgtgctggcctcgtttcatgtccccctcatgagaccttgtatttataccctcaggtgtcctcttgtctaagtaaaactaaagaggcaagtttagatacgatccatgttacttcgagggcccaaataggactcaattcttttttttcttttttgagattcctttcttattaactcaggacttttgccatacgtacgagccttgattccataggaagacttggtatcatgacttggtatataggtgtcgccaatcttggtacacaagtatatggtatctcatatttcgaatactaacagaaatgtaaaattataatgttctcacaaaactttggttcacctcaatcaaatttcaaataaatcatcaatgtttggacatcgtaaaaaactcactagtaaaagtagatattagagcttgtaacgaatatttagacacttaaacaatctcatatgtacaaagttgtaaataccgttgtcctctacaatgttgttatagattgcatatctccattcaaggttgtttggaaaactcaaaaaatgaagcttttaataaatatctggggcctaaatgatctcaaaagaaaaaccagttgaaagttgtagatagcattgatagccaatataaaatattatgtaatccaacttgatatgaaaaagttacaagatcttttttaaaaatagtattgctctcatttttcaccaagtttaattttgacttctacaagattctgcattgccggtaaaaatcaccccacttccaattaaaaaaaaagacctgtatatacagttttcttaaagacttgaaaattgcttcttatcgagcgcccaatccggcgctgagagattgggcggccatatactcagcgcccatatgcaacactacaagaagccctccactgcgtggagttgtgctcctcctcttatctactctatttttaacatttgaaacgatctttcttctaaactgctcatgcgatctagttccaattgcaccatcgtatttcttacaattaaatctttaaaacaaaatatcacatgattatattctaataaaaaattatatatgtttcatccattgaaatttaatgtttcacgcgtgatagttggatgttttagctggaacccgactctgttgcacatttcttagttctcaatgttgcaacgtgtatttttctaatgttacacttggtgttgttacaatgtttgagtaaatattgtttgatatttcattagttctttgcaaacgtaacgtcctatttattagatgtttcagcaaaactgaattttgtttcaccgcttatagaaaattgttttagttcagcgtataaaatgtttcaaagaaatgcaacattaataaaatattggctgcaacacaagcaaccacttatatgaagtattgagtcccaaggagtgaaacattaaaaaaatataaaagatccatatttgcaaaagcttgacattgttgaaacatttttatgtcatgtgtgaaatgtatttgttcaaacattataaaatactgatggaaacattaaaaaaacatcatgtgcaatatttgaggtcattgagacatttaaataaaaacaagtgcaacattttaaaaatccattaaaaaagctaaatagtttttaacgaaatataatcaggtgcggtcttattctaaagatttaattgcaactaatttaatggtgcaatcaaatcataaattggatgattattttatgagaaaaaatattttgaagtttgaaatattttgctaatatatctcttgggcagtgtgcagatctaccaccctagtacactataagagatatgaccttctgtgactaactccttgtgacattggagctattcgccataatttcattttgatttatgacgttcagctatgggtagcgtgactttgtgacaaaaatgaggttttcgtcatcgagaccaaggacaaatcgttataaactagccaaacagtgtatcgtgacgaatgttgttttgtcataagaggctaaccagcaaacgtcataagttaatgacaatgtttgtttgtcataaacatatttttattaattttttaaaagcaaggatatttgaggcgccacttatttggcccaaccattatattatgaagtgaatgccaataatatgaagttttttttcccggatactattgtctgaaagtggacattcaactcatgtcacacactaaaatttatttaatttaatatttcattaataattattacatttgattttagaatcaggaataataattattgacaagggcaataatttaacaagtgaagttgatatgggaaataaaattttacctagtaaactatgacttggaagttttaataatttatccataattaattatgctctcttaaattttcttgaaatgttcggagctaaagaattatttttaataatactaacatcatttccgtcattatttaaattgaaaaaaaacatttaaagccatcttcctatatttgggccaaaagcagcccagttcctacccatcactgcgcaggcttatagcccagccagggaaagtctatctcgtatccctcctttctcccctaaacgtaagccgatgagtctattttacatcattcaaccaaagttcagttttagtcacttcgccagagtaggaagcagcagcccacactgccagccgcagccctgctaagtctaatcagcctctctcccctctacttctaaatttgtaatgcttatttggttctctaaatgatcttaaatgaaaaaaaatgatcaagtaaaaagttgtagatctagccgatctctattacttttatatagatcacatcttcatctaaggtcggttgaaacatagatctgatattttgtaataagtctaagatgttataataaatatttgggcctctaaacattctcaaatgaaaacaatgtcaactataaacttttagatctcgtcaaaaacctacaattttgatataaagttcatattcatccgactttatatgaaaaagttactccctccatttcaggctataagacattttgactttggtcaaaatcaaactacttcaaatttgactaagtttatagacaaatatagtgatatttataatactaaattagtttcattaaatcaataatcaaatatattttcataataaatttgtcttgggttgaaaatattttttttctacaaacatagttaaacttgaagcagtttgactttgatcaaagtcaaaacatcttataacctgaaacggagtgagtaggtgcatatatatttttttttcaaaattttattgtgatgagacaaattgggatgaaaatgcaaatgaatataatataattgggctgaaaataatttgtaaattgctatgccttaaatgggcttggtctaaatctaactaggtttataattgggcttggctcataaataggttgcttactataaggccttcgatagtctatgatgtattttatgacgttttctaggtttgataatgacgaaaatgaacgtcataaacttaatgacgaaagaaggatcaacactagatcaatgacgaaaaaagtaagttttcatcatagaacatgattagagacgcatgataggtgacgaacgaattttcgacgtgattgtcacaaatttttaaacgtgaaaaattttgcagtttgtatgacgtaaatgaaacgtcacctatcataagatctcttatagtggtagccaccctagtagctactccctccgtcccataaaaaccaacctagtactataaatctggagatacctctatccgaatttactgtactataatgtgtcacatccagtactagattcaatttttttttggagagagggagtacaccctagcagcctagctgcatgtagaaaagtcgctagaaaacatgcaaagtgccttcgattgtgcatacagagtcgatcggacggcatagacggcgcctaatttatctctccaattgggcccctgacgggaagttgcttcataaaggcttgccttaaaaaagataattacccttggtggttcccttggaaaaccgtttgtgcaaatatatagatttccagaggtggttttctaagtacaaataagttttcacatatggtctatgaacttaaaagcgacctccgccatctttctagctggtttttcttttaggccacatgtgaaaagaaaaagtctcgtgcgttgcgaaaatcattttttaagtagtgcaggtcctccactacgagtctactccttgctgcatatagtttgtgaaggcgatggggatcagagctttgctgctttaagatttccacatgacagatgcggtgcaaattaaccaagtaaacaaacagtccactataagatcggctaattttattgtggtattcataattaattgaaggcgaattaatttcatttcaacaagttgggattgcatgtgccctacgtaccgatcgaaacgttccttgaacttgtagaggaagcggaggtagtcgtcgtcgccgacgacgtcaccgcctactggtcgccgcagctcggtgccctccggcatggccggcgccggcagcgccgccatccggcgggctgatcggccgtaggtgagcaggtcatcatcgtcgtcgtcgaccctcccagtggacggcgaccgcgagaacgcagccgccgacgccgatccctcctctcgctgccggtcgaccgcgtagatctcgccggcgtcgacgtcgtcgtccatcccgccgatcgacgtaggccctgcctcgctctccaataaggctcgatctagctagttcatgaccacgggaggaaaggaatgggctctttatatagcgcgcatatctcgaagcaaaaagcgctacgtgtagggaaaaaaaaaattctactcccttcgttttaggttataagacgtctattttaagttttaactaagtttatagacaaatatagtaatatttataatactaaattagtttcattaaataaataattaaatatattttcataataaatttatcttggattaaaaatgttactatttttttattaacttggtcaaatttaaagcagtttgactttaaccaaagtcaaatacgttttgtaatctgaaatttatttagcatgtgcagatatattcctatcaatcactacttagcacgcacgtcggagtgaaagctgttgtagtgaaaaaaaaattgaagagcacgttggtagcaaattaaatacatatatattatatataaaaaaaagatagtcgcgattgtacttaaggaaatcataattaagcattaattattttattgaaaactataaccgtgtttgtttatgattttctttgatataaaaaaagaacacatggttatcgatttgttttatttatcaaagagtgcagatactacaattatatgcttattacaaatagaagatcagaacaggatagcaagtagcagttaacgctatacgttggagttgtcgtacgtaataataataaatagcgggaattgaactagttaggaaatcaccataattctttaataggaaatctcatcgtggatattattttttttcgactgtcacgctggtaaaaaaacctattttttattataagaaatgtatgggcgccggttaagttaatcatcactcatttcttgcgcttataccccaataattaaataattaaatacagttgtatatgcctttgtttgatgtgtgtacaacaccaaagtatactatatgtagatacactagaagtgccaaaacaatgaaatttctacaactactcctttaaacagaaaaacatcgtggaagcatcaatatataaattaaggttataatacaacaattgactgacacgtatgaaatatgcctaagaaaggtagataatcaattgtcagcacatatagtatttaattaacacactatgacatgataaactaaggttatcaccatataacaacatttattaacccagtgagatgctgacgtgcaagctactcccatccattcacgcaaacatggcttaacaagtaactgaaaagactataaggggccggtaagaatgaatctcatcaatgaaagtagattcgtgttctcttaggttataaagagatggacatcctcgttagtgcaaactttgatcgtataacttccatagcaatatgcaatatgtgcatatgcaatggcaatcaggggcggatctacccattaagcagggtgggtcgatcgtcccagctacgacccgtgtcaccccacacccccaagaccctccctacctccttataatagttataggccatcaaaattaggtatatcaaggtgtgaacatccaatagattagtctgtctcttcacaacgcatgcacaccacaaacaatgatcgagacaattatacgattgaattataaatatgatatgtgttgtgttcgattgcttatcgagtaaacatcttcattctccgccccatctatattttaaaactgcgtccaccacagatggcaatgcaatgatatgtattcacaaaatacatcatattaggccaaaatacgaagttgtaccattatggtcacaaggttcacgatttaactccaaatataattcaaaagtgatgcaatataggatgaattccagcgtaataatattataaccacatacctatataagccaagtataaagttactcttgccaagggcataaaccatagtgtaataacaataaaacaatgattaaggtaagtaacatctcaatttatcacacaatattatcgtgattactgatatagaatttcaaagtgatggtgggaaaaaataacaagttaaaattgtagcaaacaacgccatgtttacttgccttcactatcgatgagacaaactctagttgcgtcctgaagttgaaccacccgaataaacatcggttcagcctcacatgatacacaaataatatttaggtgtcatgcattcacttgcaaagaacacaaaagaaataatcaacaatctgcctatagaagcaatgtagcttaacaattttatttctccaattataaaccacgtaacatatcaaaatatagcatttatgacatttacataacaaaaagtttcaggtacacatggattgatcaagcataactgacaataatcagttccaaaattaaatttattgccgtcctaatattgaaaatctagccatgtagggttttcctacttatttttcttggctactttggacctctttggatctgcattctgctttcgaattatagctctgcccactcttgttgctgtgttcagtggaggatgcacttcttcactcctattggtggcaatgaaagatgactcaagcaatgttccaggaaatgtcgtagcttgctgttgactgatgccctattgcagataaattgataaagagtttgtgcaatttaggttcggtaagaattgtttacaacacaagtgataatgatttacctctctaataaatgcatcaattacaggagagctcctttgagtgcttgtgccaaggaagcatataggatcagtcaaaagctgtcgtatcatttgcacaagttaattgttcagttgcatagttagtgtaaaatgataatctcttgtacctgagtgatgacaggttcatcaacctcttcaacttctgttgtggattagtaataatctatccccaaaaattgatttttgggttttctaaattgaaaataagaagtgaaaaactcctccctccaagagatagcctaatttcaatcccaaaaactaaatgtgggcccttccattaaactaccaacaaaaatttccgttctttttccttccacgcgtgcatcgacctaccaacagaaatttccccgctcatgcgggaaggagaggggaagcgggagagcagaaacgcacgaattagagaatgggagtcgctctctcgccgttaaatccacagaacgaaatatatggggatgagaactccaaaactagtagagggattttgaggatatgttggatctgattttttcactaaaaaaccctcaaaatcagttttgggaaggaaataggatgactattggtgatgctcttataaacctaacatttacctacggtacatctaagaaaaatcctacagtcagaaaagtttaggtgatccactgtattatactccatccattttacactataacacattttaactcatcagatcaaactttcttcggtgttaactattttattaaaaaaatagcaatatctataatatcaaattagtttcattacatctaaaattgcatatagtttgatactatatatattgtgttacagtttgatataaacttggtgaaagtttaaaaaatatatattaataaaagtcaaagcattttattttatacaatataaaatgaagagagtatatttcaccaatggtataagcgtccgattggctaatgtaagctgtaactgatgcggtgcaggaaactaatggttttagagggaagctagtgcatggaatcccatggtattatggaagtcacgggataattaaaacacccaaaaggtttaatctgtcccccacgctgtccacgcgatttcccctcctcccctgccgcttccgaacacgaaacctgagcagtacgccatcaacagcaaaacaaacggcacaccgccgtacgcaatacctcgccggcggcgctcacagccgcatcaactactcagagcaggagtgcgccatcgacagcaaggaactggcgcgcctccacatgcgataccttgccagtggtgcggaacgccaccgcatcaactactatgagcaagattcgccgtcgacagcaaggaaccagctcggtatcgcgcaccgccgcaacaactacaccaagcaggagtgtgctgtcagcagcagcagggggtcgagccaaggaaaggaagaagaggagacaaaatgttggtacttgatacttgatacttcgtaagtatcgaccctggtacctaaggtatcaggtctcatacctaagcttgatacctatcgtaccagccatgatatccgcaggtaccaggtctaatacctaggtatcagccatgataccaaaggtactaaacatggtacctacaggtattgattgcggctgatgcattgcatgacatacctgcacacactccaacgaggagcatgatagctcaccaagacatcgtagctctgtgtgacctgcctgggagaagggtgcggtcgccgcgtccacctcctgcttgggcttcaaggcagtggtgatggcggcgccatagtacgaggcgctctacgccagtgcaccgctggcgaacaactcggcggcgtcggcccggccaccaaaggagaggatggtcggcgggggagacctgctctgtgatgcacgagtcccagctggtgttgacctccgccaccttccacggccggtgctcccctgctgccgtgtgctggcgtgctgctgcagcagcaccatagttgccgctacgtccacctcgctggcctgcccaaacacgaaggcgatgacgaaggcttggatagagaaaagaaagggaagggataagatcgaacgttatccactcattttaatttatcttgtactgacggaataccgttccacagtttttctgatggttttaatatagaaagaatctattctatgtcatagtttgctttagttcagtaatttatcgtcgacttagtcatataccactgattttatcaattgattgatcgacatattaaaggttttgaaaaaatataaaattctttgtgtagccgcccagctgaacaaggaagtttgtgtatatatttcaagatttttcaatttgcatttatttttattattaaaatattatttatcttttatatgctaatagattacttttctgttgatattcttttatgtaaatcatttttcatatgctacaaaaaagtatatttttagcattttagatatttttaaaaagtatacaagcccaatgacatgttgttcaaacaattgataatgtcaatagatatgagggggggggggggaattaatgtcaaaattttaaacttgagtaaatccagagacatagaatagattatatctttaatatatcacttggtaataagttgcataaatggctaattgctatatctttttctttctaagaagatgtagagcaagttgaaaatcacaattggaagttattttacaatcaacataaagtggctactttgttgaaactcacgatagggttatttatcacctttttaaaaaaaagaatatgcgggtgtacatttgttctatttaattagaagagagtgctgacatactccaattacatatatgcttctaacaaaatgaagatcacaagtagagatagcaaacatcactggtaggatggagttgccgtaacaaaaaaaaaaaaacaatagcaggaattgtaccataaggcaatcatcataaagtttttttttatttttttaatgactcgtaccagacagtgtaaaattcatattgatagagcaggaaaaaaattacaagattacaactttgggaggtcataaccacgaaaaagaaaaaatggccaccacccacacactgatagcaccatcacacagaccgagaaggctagcaccaaaccgatcaccgctagaccaacaaatacgctacaactgggatcgcccaaagaccaccctagcaaccaatacaaaactacactctatccacatcttttttttaattgaaatctcaatggtgattatttctgattttttaaaaaatatagctgtagactatgtgttactattcatttccgattatgtttacccgaatcattattaaatacagttgttttcttaaactctgtacgtgcccttgttacatactccctccgtactcgtaaaggaagtcgtttaggacaatgtttaagtgaaaccttggaaaaataaatcattaataactcttaagttgttaagtttgaaaatataaaaattatattaatagatttgtcttgaaaaatactttcataaaagtatacatatatcacttttcaataaatatttttatagaaacaaaaggtcaaagttgtgttttgaagactgtgtcgttgtcaaaaacgacttcgtttacgagtacgagggagtatgcctaaaaagtgaggaaaatccttctgatctcagttaccaagaagaaatatctttctgttacaaattatttagagtctatcatgatgtgaaatcctcttgatccccaaataattaataattatctaaggcaccttttgcagcccaagaattttactggatatctttaggatttagtttaattgaacaacatgctcaaagtccaacggcctagttggtcagtctagttggtacatgctttttttttatttggaaattaactcatggtccacgtgcatgttgctacgtcttcccttcattaaatgcacattatagttttgttgcaaattcaaactgcaaacgatgtagtagaactttgtatttattaactgtaaagttcaaaatattattatattaaatttagatggcttaaacctaattgggcattgccaagaaaagatctgcccgttgattggttggaatatgttacaagaatgtatattgaaaataaaacatatcatcgtaaatatgctgtgctttttagtttttatttggtatcccactgagctaaaaatgccattggaattacatggaatatttagttttatttttttcttataatttcataattctagcaatacccattttatatatagatggctgagatgcagctaggtttactgtagttgcacttaacctgccattttcatgtaccgaattttggtcagttttttggatgacataacggtggttgacgtggctacgcgcgtgttctcattgtgcaacaaggtacacactatgacaattgtgtgaagcatagcgtatgtcgtctctcccggcacggcagggtgacgaaaaccctgcagggtatagttaccaaagtctcgtcacgtcgctgtatcaagagaaactctgatcagaattagagcatcagcctacaaactgatctcctcactggtctgaatttttcctttctactactttcaagacgtcctgtgcgcagagatcggtgtgcggaggtcaagtaaccacagtaggatacagtattttttttttctcaatccacccacctatctaattcctactccctccggttccatattaattaacgttttagagaaagttgaggtcaaacttttataactttgactatcaataactttaaaaatatttagtttaaaggaactagaacaacatatatagatttgtcttttaaagcgctataataaaagtaaacatgcatttatttattatatatattatagtagaaaaataaggtcaaagatatatcttgtagaccgtgttattatctaaaacgtcaattaaaatgaaatcggaggaagtaattatatggggtttagctcagtcaatccctaattaaatgggcacaacctgtttttcatactcaatccacctaccagccaatcaccagttacatgggcctgacctattgtaaagcacaggcatattactatatctttcataagggtcatccttctcctgccacacttatagttcccattcccttataaaaaaaaaccgtatgaaaattcacccaactcatgttttcgtttgaaaatcaatccgaaagacctcatacaaaaactaagccctataatttagttcctttgtaacgcatggatatggtactagtattcagaaataaccagtgtcctagttctcaatccatgcatccacctaactaattcccaattatatgggtttgtgctactaaacggaaaaaacgcccatatgccctagttctcctagcttatataacttatcttataaaaattttctttttatataagctacctggctattttttttgaaaatgggtaaaatgcacctagattctcgacccgcgatatctaattacctaaagttgacggttatgccaccagctgattggtcaatctaatgctcctcagctttgtgtgttccatatataactacctagcattctccgatttatttcgaattttctagttttttgtaatttttttgcggtctctgcagttgaagtgtggcttgatgtttgttctttatactatcgacactggtttcgtctttgtttgatgataggtaatggatgttccgatcagcactctcggtcccagcgagtttgctgattgaaggttcgattagttgggaccagaagtttcgattgaagtttaatttctttactaatgtttttcatgaacacctattctctctctttggctagacagcatcaagatcctttcaaactatattacagaagtacgtcacatataattaattgcaaagtacacaatatcattaactattcagtaatatttctgttacgcgcgttaatattgcttcataatggtcatatccctacgacttttaaaggaaatcgcattggtgcaaggaaaataagttccgcaaaccgatatatgttcacagctctcctcctcctctctcctcatccttctctttcttttctgttcatggatttttgaggaatttaaatgaattttggtggggagaaaggggtttaagggtggggtggataaaccgccctccccgctggtggcaactgctccttctacgggtgcactttttttttaatgtcttcaatatggctccatgggagaatgcactaaatataagacaacgtgactttatggttttagctcctgtacatatcaaaagtcaatatttaagaaaaaaatactcttaaaatacgaatattttccgctagacacacacccattagaatattcatttcttacttaaatatgagaaagaaacagtatgaaaagtcataaataatcgtggtcccatatgtcgattctcccatctatttttttcgctttctccatgcaagttgcggcagcatagggacagagcaagggaggagttatactgctatccgaaactctgcctccttgagctctgccacaccaaactccagactgctaactccaacttctaactccaaactcctacttcagtgggagctaattcctaatggagttggagactcgttgagaagtgtttggctagttttcagctctagatctgaaaaaaaattgaaaaaacaattaaattgaaaaaaaaattgaaagaaaaaaagaaacctagtcgccggcagcccaatcacatggcgccgcccgccgccgccaatgcgttgtggccgcgcgcgccgcccactgcctgccggccttcgcccgctagctcactgcccgccgctcgcgcgtcgtcccgccgacctgctgtggtcgtgtgcctgccgccgccgcctgctagctcgcctcccgccgccgcgcgtcgtcttgccactgccaacaccgcgggacagccccgaccagagcgccgccgccgcgccctccaccgcgacaaccgacgccatcgccccgatccctctcactcctccgctgtcgtggccgaagctacctgccgccgctgctgccgcccaccgccgcagctattggactcgggaggaagatgggggaggagagagaacgggaggagaggatgtgggtagggatagttcagtggcatttttacataattacactaaaaaattaaagggtaatgggtcttttggggtggagtggagcagcaaaaacctagctccacccccgtagtacaattttgtggagcagttctgctaactctgctccaaaaaacggaggatctagactgtttggcacaactccggctccaggtaagttgggaactggagctgtaccaaacggggcattatatgccgatctccggatccacatctaaagtctccccatgcgattcaatgtacacttcctctgccactgcatctcgtgctcactggcccgtttgcgccagccctctcatcaacaccgtgcgagtcgctcatcaatcacgtcattcgcccacacacccaagccagcagtggctcctggtagcatcaagcatgcatgcctcctcgaggtcttcttccaacaccacgttgtcaagtgagcctggctcatcggttaccctttctcaccgactgtactacacagttctcaattcgctgctatacgtgcttgagataatatgtgatagatatatggggccaagggcatttctgacccttttgctatttaattggtagtgaatattatagtagttatggtgtcaaatagcatatattcacattttgggaatatcttccctatagatcaaattttgctatatccagaagctaaatcttgtattaacggtgttgtacggaaaattcgcccaaaagaagaactcctggaggacgggagtgtatattctgtaaactttcaaaagaaatatttttataaataaaaacatatgcgtatacataaataaaaaaaaaactcatcataagaaaatgagaatgggctatgggctccagtttctagtgggcttgctggttgcccaaatggcccaagaactggcctgtgttggtccaggccgtcgtgcacagcctctctccaccggcgagaggcggcggcggcggcggcggcgtgcacagcctctccctcgagccgctccggggcttcatggcgccatggcctcctgcccacgagtaagccacactcccccccctccccccaccctgttgattgactgccgcatctgcttcccctacaagcttttgcttgattattcgcggtcattattgcgcttcgcaaccaaatcgaatgcgccattggagaggaatcagtggccgctgcctaccccaaagttcagtaggttcgtatgggtagtttcatgggctcccgattcgtttctcaaagggatgtgagttttagggattcgactaagagtctaggaggatgtggagcgcgatatatatattttcagtttctcaaggggggcagccagtgcaaaaaactcaatgaaacaacttgttaatctgagtaccatgaattccaggatacacaatgtgctttaagatgtacaattatggtgatacaaatgtgctttcaagctgtacaattacgatgtgctagtattcacatgctatacacaactcgggtatgccttcctcaatttatctcttctggaagttgaatatcttgattgagagcccgaaaaggaaggcgaagaggacggcaaatgagaccaccatcacggcaaccacccacaagaagtcacgatggtaaccaaagtagctctcgacaaagtcagatatacggacaccattatcaaacgtgtcagttacatccccgaactgtgaagttaccaacccgtagagtgtccacgcaacagggcagacccaatagtaccatctccaccatattggaattcgctgccaataaaaaaataggctgtattagaaaaggcagatgctccataagtgaaattactataagacatttgtgaaatattagtatacttacagttcttggtattataaatcctgagaaaaggttccatatggcatagaatgcagtggaaacaacagaggccacgttatagcttggagtcagacccaccgacatcatgccataaaatgtgtagtatgataaagtgaaatacatgaaaaacaggtaccaaaagaacttggcagctgtccactcaaatccaatcattgcatacactagaacaccatatattaaggactgaacaaggatgtatggaagttcaattgcaacctgcggacagaattgtatgttagcagcacatagtgtttcttttaccattttcttccaattacttcgggagttgttcaaccattgtgttatatcctggttaaaatattttatataacccttttagaagcctcatatgtacaagcttccatttgattttgatgctttacatgttaattgagctgctcttttttccccttcaaataataatcttctctttcctatcatacaaatatcaatgctattgtataataaagttaatgtaaaataactttacctgtcccaaggcgtatggcaaaggtgaatacatgtgagctgctcgttccctgtagaacacagtgcgttcaacagacacaactggctgaacggaagaagaattctgcactcccataaataaaactgacgcatacatggagcccatggcattgaacaagtcctgttgattgctcctgcaagagtggagtatcctcagtgaattgtgacagatataatctcaaggtagcctctctaaatcagtggaaaatgttgcatatacatttttacttgtttttattgaccgtatacctttttctgccaacaccccagaacattgttccaaacaacagtgcaattacaatggtgtagaagtatttgacagcagtatatggagggtttctccagtaggacagactttgcttccataggcaagccaaacattgtgtgatgaaagtttgagagtattctgttggaaaggataggtcacttgaaccatcaggaggtgagcttagctcctttatcatacttttattcctcctgtaatgcaaaagagactataatattattgaactgttaacattgactcgtttagatgcttttgaacataaattgctacagtaataatcatgttacacatatagtggcagtttgaagcatttgtgatgggccattcatgatttgagcttcatttatagtccatatttttttcacaaacaggctcatcttttccatttagtgacttaccctcttgaaaatagttaagacacactgaacatgatactgatcgttgctgccttaattttccaatataaaattgcggagcttaaaatttgcatggtctatagtcaaaattatcaaccatatggcaaccaggtacttacctgtacagttcagaattcttgtatatttcactgaagttaaccccagttatctgttcctgtacagtactagtcacttccagcatccatgttgatggattgtagccatgttttattttgctgacaccttcaatagactttagaaaatgaaagcagctcaattacatgtttttagagcaaaaagtcaaattgatggtaacatatataatttttttacctcaaaatatctgatcaattcacacgagtgctgacctactggacctacataaatctcctcacctcctcgtttcatcaggaatagctgcaaagatagtataagtatgtattgaaagagtgcatcttaaatccatgtgacaaaagaagtgggtatgatttctatcacctcatcaaaagattcaaatatgtcaatgcttggttggtgaattgtgcaaacaactgttcttcctgtgtccacagtatttcttattgccctcatgacaatggctgctgc

SEQ ID NO: 59699 - DNA, 1600 bp, Oryza sativa
atgtgtagcaactattgaattttttctgtgagttttttctgaatttctcaaaacattgctcctatactgatataaaaaatgaagtagcaagtcagcaaccagtaagttcttcattagatgatttttcacatctgtttttcctggctttgtagattggtgggctcgctgctatgctggtagcatactatctcttaggaaatggatgggctacaagaacacattcaccactatgtatcctattttgcagatctgattctgaaataacacgctgcaaaattctatcttttttgtcaattaagacttccatccaaatttcttatgaactcaagtaaatgatgttgaaaatccctcactttgtatagatagctttggaagtgaatcactggagaagggaacacaagttattggaatgaaagaaatggtggtcccacttactgctggaattttatctgctttgaggagagtattagctcggcgggtgtcccttaaggtactcttgatttcattaactttatcaataatgataaagtgttaattattttccttaagaaatactatagttacaggcagtatccatagtaaccaggatagtcattctacagaaggtaattagcatgcaacgagacagatcattttctgcagagtataaaacattgtggaacatgaacatcgatgaaatttctatcgattcaatatgcaaccacatctgatatgcactttttgcaatgtttaaagttctccctctggcacctacttactctgttgatgatatcgtggaatttgaagtattgcggcaactgtttctcaatatcagaatctacaacttaagtgtacttaaagtatggggcaaatcctccatacatctttatactatcaacttattttgagtcgtaagcatagtacaaaaactcggaccggagctcaacccggtcaaagctttcagttcaccggtacggcggtgaaaccggccggtctgccggttcatgtgctgaaccgtcagtcaataaagtgatgcgtgtttttgttctaactccctgtctgcgtgcgctattgtgttttttttgtgtaaatagcacatctgagatggtaatgggccttgatttggcccaataaggaatgtacagcccaaaatttcttgtgctgttggtcgcgacaggtgccagtttaatcccgattcatggtaaaaccgtgcatttcaggcagttcagacttcagagtaggtcaattgcatatccggtcttcccatagaaccaaaccatgggcaacactggttccctttttttccggttggatcgccggtccgatctggtttttacgctatggtcctaagttacaatatagaatttatatgtgaaattaagggaaaaagtctattttacccccctaaactttttcgctggagcacttaatcccctaaacaatttctcggctcattttactcaccgaactattgaaaatgttgtcttactccctcacgatatttatcttttttgtttatctctatataggtcaaattttgcaatgaaatttggtgggattgatatatgcattataactaagtctcaacaatttattggcatttttaatcgctgtttacggg

SEQ ID NO: 59700 - DNA, 15573 bp, Oryza sativa
tgattatttggatgattcacatgtataatgtcaattctatgcaaataaaaggaaataatatatcaatgttgggttctttaaaactcctgaaaatatagagaaaggaatatttagtgccaaaaagattggtgtcagttattaaaaaagatcatataaagagaaaaatcattttatcaattactttaaaagccctcaaatggtcatttagattgaacatatttttttcctacaaaaatcatgtagacatgaaataaatatatacatatcccattgctttagtgtcctcgctaatctcatgcgatatggagtaaaatttgactgggtcgaggctcggacttgtcatacactgaatccgctcctgaaataggccccaaagcaactgtaatgtctacctaggagaaagaggaatcgcaatcttgaaagcataaaagaaatgaagcactaattgttggaacatccattagaatagaacaagccagttttgactatataaataagtaaaggataattgagggagtacgacacaaattactcatcaagttgttgagttattactataaatttaaatttaagataggaaaggaaaatagaactgctaatgctttatccatagtccaatccttggatcactttatggaagttctaatagtgattcccagatagccacctaggttgtagagagtaagggcctgtttggcacagctccagctgtggagctagagctcagctaaacagtttcagctccacctaaaatgggagctgagctgagcggagttctctcacaaaatgaaccaaagatgtggagctgggtttaggcagctccacaacttcactccggacccaactcctggagctaaatttaggagttagagctctaccaaataggtcctaaacgaagatgaaaaatgcagagaaattgaaactaatataaacttaggcttgatccaaatgcacaactcaagaaattatgcagagagtacaaagacatgatatattgtgggaacatgaaatcctttgagaaaacaaactcaagaagtcctttcatgatttggccttagggggacattctggagaaagagcaacatatcatattaaattggatcaagcttgtgctgtgtgcaagaggactaaaactggacacaccttgattcctgggttccttcagcctctacccatttttgaaacggcttggaacccatatcattaagggatttcatagaagtctttcagagcaaattcaagatcagtttcaaaaaaaaaaaaacttctataagctttatggggtgtcctttgtgactgagtgcagtgatagggatataatttctgaatactgagaatcaaatgcactggtggtggttggaccagatctggttgtgtcgcacctacggcgattctgcaacgaattattggttaatcatggatgtctcctttgctgctttgcaagagatttttcatgcaaaagatacagtggaactatcaggacaacaccactgctgtttctttctcacaaccttctaccattggaaaaaccgcagtgcgctccttttgccttgtcatcgtagaataaaacacccatatatacatcatatgatcatataataaccttgggcaaacaaaacacagtgcattcaattcagtttagttgcttgttctgctgcgtatgcaatgtctagaatagaatctcctttcctaccttccacgagcacttagtgatatctgatcacttccatgcttgcaaagttgcaattgcatagcagcagcagaagaagaaagaaaggtatcaagataactgaacattttgggagatcaattgcgtgggatgacaacttctgaaagcttcttggcatgagggcagctcatcatgggacaggatcaaagatgcttttggcatctctgcactttttgtatatgtcctttcaggatcgccacaaaatatcctcttttgttatcttgttctcttaggttaaaagaacggtggagagaagacactctgaattgatagattggtattggtcattacaagaagcctgcgttttttgcacacgccctctcattctcatttgaagaatctgagactcagagagtgcaacctctcactgcttgcgtgcctaactcttgaggtatattcagtatctgtttcttcaggaatgtgagttagtgggagatacagacagctacaaaattttcagaccaaaaaaaaaatctccttttctgaacttgtgataggttcagaggaaacaccacgtagctatagctgaccatttttgtatgaaactttagctatagctgacctgactattcaactagctactcctttatctgtcactatcattacagactacatccttcgtcaaaaaaaaaacttttaatcagtttttttaggacgaagagagtatgaattacataacatttcagggatgtcttgtcgactaagcctaataattgagcaactatgtatgcaaagcgtgagtgagtgatccggacacgcgtgttgaccacgtagctggaggatatgttttgatcagcgagatatttggaggatgtagcgatcgagatgggcttaatctctctaaagcacaaaaaggaagaagagaagtaaagaaaagaagaaaaaaaaagcaaacgagacagggcataatgggtggtgaaatgcacggcgttgagattgattaaagctaaaatctaatcagcgagacggatcgatctgcagccagtgataatcgccggcagcaggccaggtggtccggtgccaggatgggactcgactacgcaactaaccaaaagattaaaagcgatttagagcaatctgatcttctcctgtgtgtgtcgggttacttgacctgccactgatgacggccaagtggatgatcaattgttgggctaaatcgagctgcagctaacactacgctgacaattgtcaattgggatgaactggtcatggaaggagatgtgtgtgcgtgtgttcgatcatggagaaattttgggtcgatgccagtagcgattttgatggtggtgctgggtcagctcaattattgcattgtgctgatgggtatatttgtaacgttgacatgccacggttattcgattaacatggccccagtgttgtttgtccagggtatcttctcccccattctcttccgatttcactatccgcgcttggttggctaccacactttgccatgtttatttcaccacacgaggagcgtgtgtttgcctttctcctagcgtttttagcttttttttctcttaatatatattaaccaaacggtgggaggacttatgatcggtcaacttccctcgtatatatgcgatctatctgcttatcaaaaatggaattaacttttcaatcatctaaaattgtacattgttaagcctagaattgtgccatatgatgtgcgattttatcattgtatataattttattttatttatctaagtttgaatacttttacatgtaattttgtaatcttttataaactacttcctccgttccacaatataagactttctagcattactcacattcatttagatgtatatgtttagattcattaacatctatgtatatgtgggcaatgctagaaaatcttacattgtgaaacggagggagtataaatttatgttcaggttagaataattttatctaagaaagaaagttcgtaaatagtctttcccaccctaaaagctagtcaataaggtaagagactcccccacttatatattaggtccattgaccttacacaaccaatgtgggactattcaatagaaatagcgtcacttaaaaaagtaataagaaaattgatgaaaaccattggattgtcattcaagaaatgagaaaagtgatagaaacttttgaaatcttctcaaccatttgaaatatagacactccctaagaaaattattgtcttttttactggttatcataacttctttgtgatccagtttgttcacccaattgattccgaaatccccccctcaacacaacaacaaacacaaacaggcaaggggaatattttgtatggtccatggaagcatggacacctacatcgatcatttggcagcctcaggtacatccaatgaaactcatgatctctctcccttgagcctcaactttctcacatggtatgcatctgagaagaaaacattttcagctgaaaaaagctgctgggaggagcaccatgcttcattagttatcccctttttcttctctctagctaccaacatatataatgctcagctgggtcacacacataacataattattaagtttagtgtctgaagataactgataacccttgccccactaactggtcggcacacacataccagatgatgctaaggataggagaatttaagctagaggaggagttagctgggccctgtggaataatcagaagagtcaaacatatgtcaactacactacacacaccaaatgtcaaatacaaacagcatacatgtatatacacatggacatgtgtctttcagaagtcacccttttttttttgttctgatccaagcccctgtaccaccacttggtgatttgctcttacactgatcatgacagggtggtgccatctatccacatgcacctttttattcccactccagctattgtgattagtctcccataacaagttaacaagctcatgaagcaactagccatgagcctatatgactactccttatggctggcaaattagatgtgtgttagtccatcaaatgtagctgaaaagttgctgtcaaagagaatataccattgttaatttggagggtgaaacaactttttgacaatatagccaggttattgatctcccaattattggcatcaaaagtcactagtgctggggagtgaaattctagtagtgtggtcacaagttaaccaaggtaggttggtacttgggagggcaagcatggggatgcacataacgaaatgttgtgattttttttcatgaagaaagcaaagggattgcctaatatattgatataggaaaggtaaaaatgatgtgtatgcattataaataattggcatttccaaactcatcaatctgtctaggttttacagagccatcaaggttacaaacctacggtgaaacctgtccacgcaggttaaagttctagacttagtacgggtgttcgtatttatggctatttatttattttagtcgtagatgatgtatccattgacagcaagccatcgattataacttcatcagtctcaagatatgtcagctcaatttttcagatgttctcattataattggatgtgcgtatgtgtattcataaggatgagtatgcacacgtgtatgtgagtgtctttgtgcgtgcgtgttaatagaggtgagtgtgcatacgtgtatgtgaacatttacgtttgtcttgtgtttctcaaaagaaaggtttataaaacctacagtatttatttggtaatctcagtgcatgatttgtatttatatatatgttggatttgtcttataattttatgtatctgccacccaaaataagtgtcattactgaggttttcaggaatttaaagatcaaattgtcttattagcttactagttgaaaaggggaacatgttttcgcacaagttgaaggtgaatgtgtggcgagttgtcatggtcatggtgcagtttgtcagtcatatgtccggccacttgtccatgcctccatggttcaaagaccctagccaacacttgagattttggagatgctacaaggaaaggagttgttaattttctctttttggaaaatataggaagaagtcgatgcaaaagaatggaaaattcaacaacatgaaagctgcactagccggttggttcctagctagcaatttacaagttcccttttagcttagaaaatactgtgaggtagtgtttcaattataatttatcatacttcctcaagttgcataattctcgttgttttggataaggttgtgatcaaactatcagaactttcgctatcagaaactttaggatatttaggctgtgtttagatccaggggtgtaaagttttggcgtgtcacatcggaatacaagttttggcgtgttacatcggagtacggacacacatttgaagtattaaacgtaaactaataacaaaacaaattacagaatccacgtgtaaactgcgagacaaatttattaagcctaattaatccgtcattagcaaatgtttattgtagcaccacattgtcagatcatggagcaattaggcttaaaagattcgtctcgcaatttacatgcaatatgtgtaattagttattttttcgtttatatttaatactccatgcatgtgcctaaacattcgatgtgacagggtgaaaaattttgctaagggaactaaacattcgaaagcaataaatatttatttaggttgtgttctttagtgtgagttcctaactccactttcctcgttttccgtgcacgcttttcctaaactgctaaacgttgcattttttaaaaaaaagttttataggaaagttactttaaaaaatcatattaattcattttttaaatagctaatactcaattaatcatacgttaatccgatgcttcattattcgtacagaaggtaggagttcccaactactacaaaagaactcacccttagtactttaacaaagctaaatatttatttattatatatattaaaagaaaaattatagtcaaagatatgttttagatgtttccttatccaaagtggtaggaattatcaaatgggagggagtacctgtaagaactttaaatatagctcaacttcattacacacagtggtggtcctacaagttaacattgctagcatatttttttttcatattaattaatttatatcaactagagcacacacatattattccaaaaaaaagacgtttaaacttgagcttgatcatagaatgcaaacacattattatatgtcacattagaaggtaaacgtttgtatgccttacaaggtttgtaactttcacaaacaatcagtgtattatatttggtcaattaatttttggtaggatgtgtttgtatgtctgtatggcttgctatatggtgacataatttttcattccgtgtggtttagctaaatcgcgtgtccttcacgaggaaatgcagatgagttccgagtgcttgttggatgttggagctttttagcttttcaagaggcttattgctgttggtgcatgaggactcaacatgtggcaaggctagtgtggtcacacgtgttatgcctccggagaggtcagagaaccaatagatgaaaagaaatcaagataatatttattaggagaaaatttgacatacaccactcttataagaggtaaggccggtttacctaccactcaaaaatataatgctttaatgtcattcagaagacatgcaaatctaccatttcgctttaaactcttttttttttatttctagcatggtccaacacatatcttggagtggcatctagagtgaaatgtcagattatctcatatactagtaatatgtttgtgctttataacaggtcaaacccatatgattttgtgattggtttgatgagtggattgaggataaaacacgttctaggcctatataattcaggatgggttggatgcgtggattgaattgaaaatgctattatggctatgcacacataaaaaagcacgcaatgagaaagggacggaagtgttaacaaccaaatttggtaatatcggcattgggaaagaagattagattgaagcgaagtcggaggtggagatcgagttctgaaacagagcagggatcggctggagtccagatcggctacgataagatcggctgagtctgagtcggattaggtaagccgatgtagccgatcctagcaatacaacttgatatgtgatgttgggttggattgaggtgcttcaaggtgattgccgcaaatggatagagtcctgaggaggcaattgtatctattaattaggatgttttatgtaatttccttagagatatgattgggcaaaagtctgccgcaaagacttatagtatcttagagtttgttagagatagtagtcgtgtccgttatagacatatcttgtaattctcgggtataaatagacccgagccctatgtaacttttaacacacgttcaatacaatgcgcatcgtcacctttttgctttagttttatttcgacgagttcttgctttcgggttgagctgcatcggtttcgatcttcaacaagaggtaaaacttgttatgacggcttgcattctcaggattagtgcttccatctttatgacactctaatcttgtttatgtaattcgtcgggttatcatatattttatataatctctggcaataccgctatctaatctacaatcggctaacatctgtcgaagagggcagccgattaggttagattttgacgttgactcagattatataagatatctaccactctatgaaacttccagcggcttgattgtctagatattgttcttcttttcatacttaatgttgtatcagttgagtttgatctattaagtcgtgcttagaatatcaatctctagcctgctttctggttgccgattagggtagcatcggagtttcagccgatcttatctgatttaactatatttgctctatatgctttattgacatgttaaatttgccctttatgccaagatattgctatatttgaatatattaggcttttgcttgatattctatacctgttttaatatcctgatataaagtagtatcggagtattagccgattcatgctagatctatctgatcggttatgctataaacatatatagtcctgttattaatatatatttcggtctaagtggtttatactgtctcggcatggcgaccgatctatcccaatcacttgatttaagtatatatcgatataaggagtatatatcgttaacatctacagccgatcaagtagatttagttctttcttacttattcaagattgccgatcgatacacatattacatcggctcagagataaatgatatgtcatcggcacttagccgatcggctatcatttatagatttaaccgcgatttctttgcttctacttcttgttggttacatgatcaaatcaactggcacgctagcacacccgtaggcgagctttggacctgcactggagttaagcagatctcccaggcctcgtgttttctgtcaacaggaaggaagacgactacattttttaaatagtagagataaaaatggtactgctaattaaaaaaaaatagacatacgtccccaagtcattttagattggattcatgataattaatcacatgtacagctttataacaaaagtatatttgtattattatgatttttatttactcataaatattgtactttggatattctcaatggccataacatgttcttagagataataattaaattgcaatccagtgcttcagttcattagtagtatcttttgcatatatataaatattaaataaatattgaaatcatgcttgggatttaaaactgaaggatcaaaatggggtgcatggatatagataatatcttaccatgcatacacaccctatattatatttatcaatttggctatggccccaattaattttgaacaaaggtgaccggatgtatatctcatatctatcgtttagatcccttctccaaaataatacgtaaatactttgcattctttacccttgcctttccttccactcccctcctctagtcgccgcctcttactcaacagacatccaccccttttataaagccacttcaattagcacatctcaccctctcgaggaaaataaagcatataatagtgatacccggatacagattctctgcagtactgcatgtacagtcgtagtaaactttactgatatgtgttctacagtgagctgcatataggatctcgacgcagtgataccctatagtcaatccgcccaaccatagtgcatttctgttaagcctgaacactatgcaatgtatgcatgataagttcaatattgtgcaaacaatatatcaacattacattattcctctcaagtcttccattctccaagcttctacatgtattttcattcttgagctcctttataagttaggtccaagtccaataacctatcataacccccttttattttggcaattggaaggtaagcaaatacaggtaagtgcaactgtatgttattcttgggtcccgaaatgaaatagggctagctaccgacaatttcatcacggccaccaagttgcgccagcttccactctatatgcatgactgcatgctttgctccagttagctacgtactagcacaaccattccattttgaatatctattatatactaactaaaagtccattgaattctctataaaagctctcaagctgtcacatggcgttctacaaattaacgctcctaagacgtcatacagtgcttaataaacgagaagaaaatttctaaaatttatggtaaagaaaacctaacgattgatattcctttaaataggtagagccaataattttcacccttaaatctccaaaaaaatcaggtatccccccccactctcctcccctattttctagctaacacataatatataaaaagataatagttagatagcaaaatgatcgtgattctcaagttacacatacttttcttaatttatttgatttgttgtgttatttataattaaatactccctccatccaaaagtctaagacccattctattatttggttttctctaaaaatctagtcctatttgtagtcactatgtgctaaattaaattattaatcggaaccaataagtcattttagtatttattggttgtatgtttattggttttgtcacatgatgaatgagttagttgctccttggtcttggacttttggatgaagggagtacataattcaagatccatatttctcatatttactatataaaaattagataatgcagccgttctaattacaaatatttgaacaaaatttgcactttgaaaacgatgaaagaattcaaatatgtgagtctaaagttcaggttcaatcaccaccaaggagcttagaaccatgatgcatattctaggcctgaacccgacggaggcggaactgcaagacattattggtgaggtggacaccgacggcagtagcggcagcttcgacttccacgagttcctgcgcctaatagtgcgctagatgattagatgaaggacaaggattgagaagaggggcggagagagacgttccacgtcttcgacaaggactagaaaacggctccagctctaccgccgagccacgccatatcatgtccaatgcatcaggagaggctcattgatgaggagatccacgaaataatccgtgaggccgatggtgataggcaaatcaactacaaggagtttataactaaattcagaattaaaaataaaacaagcaatttgattaaatacacattcaaaaagtaaaaaaaatattaaaactataaaaaaaataagaagatttcatgtagaatataaaatatcaagagttcatataaaagtatgagttataaatatattaaatttgaaataataaaataactattaaaaagatgagtccaaatactaaacgatacaatattaagtataatttaaatcactaaaatgacaatttagaataaaacaatagtttgatttgaatacagatttgaaattagaataactcgatcactaaatttaaaatataataaatatttttaaaagaacttttccatctttattgattcacatgcataacgaattgcatgtatatgaatttttaaagagagggcttgcagggtggtaaaaaaatacatttattaccaataaaagtttatcgagatttcttcagaaaaaaagatacgatgaacactcaattaaaaatagaaatcaccttactttaatttcaacttattttgttagaactattttcaaacaaactaataagcatgcctacgtgaatgcgtgggttatcttcctagttaagtttaaaatatatatggagttaacatgcatatatatgtccgatggattaactaattcaacatttttttgtactatctagctagatctagctagcttaatactagaattacaagcatatatatatgttctgctagtattagcaaagaaacaattgtcgttaattggtcatacaaaatattccatacttaaattatcaacacctggtggcttctgggaatttggggtgatagagaaagaaatatatagagtgcatactatgaaaatgtgtggtttttggctactgtgatatgtacatgcatggctaggatttaggattcagattggaaggcttccatttgacaacttgtcaccatcgttttgatcgatcatcagggtagataccctagccagctacaatattactgaattttgacaaaaaaatatatacttgtcgatctttttcgcgcgatacgtatataaaggttggaacagagacccatatatatataatttcatcgagatgtgtacataaaaaatcaacaaaatggaggacctggtgtaagaaggggaaaagaagaggcccctgtgcaaaaggtgtgggaggtcatggaattagaggaggagattcaaagggaggctgccttttttctccatgcttatggtgtgggatctctctctctctctctctccaaaagatggagggatggcagccagaggaggaagacgatatgatccatcatgcatctatctaggatctcaacattagctgattgatcagatcgatccaactaactgaaatatatggacacaatatatgcttccatgtgcagtagtgtataggtactgttcatggtgtgcatgaagataccaattaatggttctctttgcaaagcaaggtcgttttcctagatgtggccattggctaagaaggtgcttatcttgatcatatgcaccatgctacctagcaaaggcttatcactgtttttgttggggcaaaattaaagagatcttttaaaccgcatcaaggaaaaaaaagttgagctgtagatcgagtgcgtaatgggacagaaagggatgtattccctcaaatgttcttctaaatattcgagagatgtatgtactactacctcagctccattcttctttacttgttattcccgacattagaatggacatctcaaacactttagaattatgataacttggtatgccttttttttcacaaaatctatatgcatatatttttttagataatggaatataatatcccggtatatgcatatatatcatctattccatgtacatatgaatatatactttgtttaccaatatgtggccaaattaagttgtttaattttccatgcacgctctatacagtgtgtaaatcgtttccattatctaaaaaatgcattatacagtgacttatgttaccatttagttaatagaggtgtttacaaatgattagggcgtgcgaatggacataaataacagaattcttacaagaaacatgttgaatttctaaagaataatgatcaaacaacacaaatgataaaactagaataactaaataataaaatatagttaatgagataatggtatgaaaaaaaatgataacaggaagaatcaccttagaagttagaaccctgccaccttctcgaagggcaattgtgcaaaacgagtttggtaggaagaagggtgtcaaatgtagataaccagaacatctaataaaacaaaaaactcaaaagttcaaaaaactttaaaatatgtatatcatggtgaaactctcatatctaggaagtgggaggacactacctagctagtccttattcaaaattcagttagcgatgtgaatttaacagaaaaaaaaataatttactccccctaactatttcattttatcacttaaccccctaaactatttttaagcttattttagctcttgaaatgttaaaaatagttcaattgactggttaattacatttatcttctttatttctctttatacaagtcatattttaagcttaaattttgtaaagtcatatatgacaccattatcgaagttccaaaatagtttaaaaatttttcatgactttttgcttgaaatttaaaacctctgttcttaaattagtctcagtgcttctaacctatataagcagcgatttaaaaactcaaaaaatattgagaggtaagttataatgcatatatcaatcctatcaaatttcattgcaaaatatgacctatatagagagagaaacgaaaaagacaaatattgttagagagtaaggtgtgaaccatttttaatagtgtgggggtgtcaaaattaaatgagtcgagaaattgtctaaggggttaagtgctccaagggaaaaagttagaaagagcaaaatggacttttttttcttattaagttataatagccttcttctgatttctctctttttagagccacaactgatcgacagcattgctcaataatacaacaaacgtatactaattgtatctgctaatgatctgcacctagcaagtgcatgtgaaaaattggaaaagttggacagaacaacaagatcaaccagtgatcccctgcctctgtctatcagtatttatatatctagttttgcattattgtgagatcactagtgggcatgagatgagagggcccatgcatatgtacacaaacagaatgcagctgccgtagtagctgaagctcctggaacattccccactagagaggggaaaccccaacttcaattcctcaccaatctcatctcatctcatactagtactacactttatctcccccagttgatgctgctcacttttcttagtttccacgtcgcagtttctcttctctcctctgacccctttgtgaccgtccaacgacaacgcatggaggccgggttagcttagcttaattaagtgctcctacctgctgatctgatctgatcactttcttgtgtgtgcccttatgactgacagatcgatcatatagtctgaatatatataattaggattgttatatgcataggtttgcattattgtacccatttcctgcccccaccaccatttgcatgtgtgcagcagaaacatcctgcataaacagggattagaacgtagtgcaagtccctttcgacgctaattaatgatgagtggttaagttaatttgatggtgtttgtgcatgcccccgtcttggcgcctataaaagggtgagatcgcaagtccacgaggtcgtcgagcaaccaaggctttcactcgaccgacctcccagcttacaggagaccaggagtggacagaaatatatcgtagaattaatggttcgtgtgagatacaaatattaatttcttgttcaatcatttcatatatatatacatgtaggttatacaaattagtttcctagttaattaatttcattagcaactgcgtactctgtcatgttgtcgcatgcaatatgttatgcatggttagtaaaagacatggatatttgtgtgcatgcgtgcaggaggtggagaagaagacgtcggcgtggagcggcggcggcggcggcggggggaacatggtgcgggacgcggtggactaccggggatgcccggcggacaggtcggcgacgggggggtgggtg

SEQ ID NO: 59701 - DNA, 693 bp, Oryza sativa
  unsure (1)..(693): unsure at all n locations
ttcctgcaccccagtggcagcatcaagggcctgtgacaccacgtggagccatggaacgcacgtgaggtttcgcttttgcctgcactagcctatcactccaaagtccatggcagcagcattctttcgttttcgtgcagcattgtcacacgacttggagtatcatgaccaggtgacctggtcatcagaattcagacagggtcctttactgtctctgtccatggagtgtctgaaatttcagggaaaccttttcagccatctcacatttctcctgatcttcagatgaggtgacagcaagggaattgaactccaactacaccagtccatatctgcattatgaatgaaagatataacttgacccatgacaagcaaacgaagcagaaagtctaacaggcaatatggtctattttctcatgttcctcctgctgctctcgattcctctatgcaaaaccgatgaccagctgacactgggaaagccaatctttcccagcgagatgctcatctccaaggggccggcatcctttttgcccccttccggggccccttttttttccccttttttttttccccccccccccggggccnccccaaaaaaacccttttagcaatagcctctatgttggagtctggttccacaacatcccccagcgcaccgttgtgtgggttgccaaccgcgacaacccaatcaccacccct

SEQ ID NO: 59702 - DNA, 678 bp, Oryza sativa
  unsure (1)..(678): unsure at all n locations
cctgcaccccagccgcccgggttgccatagatgagacttgtggcgttctgtttgttgatatgtctgcaaatgggatggcttaaccaaattatggagttgtggcactttactaaagtctgaatgtacatttcatttgtattatggggtataggccaacaacttttaatatgagcttttgctgtaatcttgatttaattcgttgatatgctgagggatcgtggcattccttttcccattntnaanccctgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcaagtcttcagggaaaggttggtttttttgggacaaaggattttttttttcccctttgtggtggaagggttttaaaaaaaaaacgagtatgtaagtaggggagaagcactgcaagtagtgatttgtctatggcatatatcatcatgatctgctccttgtataaagagcttcagaat

SEQ ID NO: 59703 - DNA, 30783 bp, Oryza sativa
  unsure (1)..(30783): unsure at all n locations
tgtggtacgcctcccccatgtcgaacacgttgagctcgcgcccaggcgccgccccgtcctccgccagcggcggcggcggcggcggcggcggcctcggccgcacgtcgcacgcggcgactgtctcccggagcgggccacctccgcggcggccgcggcctcctcccccctcgacgagcgtggagtacatgacctcgtagcggccggagcacgggaggcgcgcggagacggtggcctcgtagaaggcgccgtggaagccggggtcgtccatgcgcacctcgacctcgtcccccaccccgtacagcggtgcgccgccgagctggccgccggagcccgccgcctcctccccatcatcctcccactccatgatcgatcgatggctgagacgctgggtggagatgatcgagggttttggaaatttcgaaagtcggaactcggaagagaggagagcaaccgttggaagaagaaaggacacaaacttggaaaaaaattctgtgcagaccggctgcaaaccccgcaccgtgcacacccgattcagattggcgacgcgtggacgagcgagtgatccgacagcgtgcccacacggctccatctgcaccaggagaaggcccagctcggcttgctcgcgtcgactcccacaaccagaactagaagcgcatggactggctccgcggctcactcgcgtcattttctttctgctgcggcgatccccacttccctttccaccgccgccgcgatctccttccccatcttgcctccatctgtcgggattgcctttccttggcgccatcggcttagcccacaatcccctccgttcaacaactgatgcggccacttctctcgcctgctaccgccgtcacggcctcccacctgggccctggccacgagcgccatcggtgacggcggcggcgatggctgggttggctaaggcgagcacgagccgtgttcccctcctcgtccctcctgaccacgggcatcggacgcctttggtggaggccgcagcggctgggttggcgagggcgagcaaaagccaaaaggcagtggaagaaccaggatctgcaacgcgccgccgaaagtcaatgcaagtggagcaccattcaagcaatgaagaaaaatcctggaagtgacatgtattttgtaattttgtagttgctacgtctgatcatttgcccgtgtctttctgtctttcgtcaaaatgctagctagggtgctggttggtttttctatagtttaaccagattagttcattagcctttgctaaaagtgatgcgatttatctctcacactgagtaggctgttggtgagaatatcacaaactgagtcacaggcttccatagcagcagtgctaaattagggatattcagatggtttactgcattctgacaaaaattattatgcaaagcatctgctgctcatttagctggnnnnnnnnnnnnnnnnnnnncaaaggcttacgactgggtattccaaaatctagaatgtgatggatcaatgtgtaaacaagattgtggtttgtctgtctggttcctttaaaaatgaaaaccggaaaattgtgtaatctgaaatcttgaatgtcaaatctgaaatatgatgtccagagaccagtcgttctcaaacaacatatagctgatcataagtgtaacacactgcaaatggaagtaaaacatagtactgtaacatagtaaaatagtatagttaagtaacatagtaaatggaataaaatcgaaatccattccaacttgaggaacgtgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccaccccccttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaacactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcattttattgagctcatactgatttctgggacattgcgatgccccatacttttcgcctttcattataggagcaggtgtagcactgcatctgtacatgttgaatttcttcaacaccttttctatatatgtcttttgagaaagtcccaatgcatactttgttctatctcggtgaatctctatgcccaaaacatatgaagcctcaccgaggtctttcatgtcaaagtttgaggacaagaatttctttgtttcctgcagtagactgacatcactactagccagtagaatgtcatccacatacagaattaggaaaataaatctcccattcttaaactttgaataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgctactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacggcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagggtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccaatgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattgttctaagtctgagaactccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccatttccaaagcggcaatcatatccatcaaaatccaactttgatacacttattaagttcctttgcaaagaaggaacataaaagacatctcgaagtaaaagtatgaagccattcgagagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaaatcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgcaacctgggcctgggccgggaaagccgccgccgcgcgctccccacttgggccgatttcggtccggccgccgccggccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccaccccccttttatatggcgcagtgtgacgggggcccaccagccattgggctgggcgcccccgatcagggcgcggtcaaggcccccttgagccgttgggctcaaggggagagagatctatctaacagaacgatcaaagcttgttcagctttatcattgacctgttgtgcaacttcatcatgcatgatcatggtcatcccctcgaagttctgtgtaatctataacatatatatggtcacagatcaaccagtatgaagaaatatgactatcaaataacaaggcgagcatacatatgttttctgcttctcatcggctctacaatccccggcgactacgtcgtccgcatgcacaggtgagacaaacggctgtctggccatgtgtcgttcactaaggcgggtgaagaaagtaccggaatcctggcggctgcggtgcgcatggcggcgatccaatctggcgaaggaagacgacgaagccggaaaaagatttcgcttttgctagagccgagtccgcgtacggcatccctgccgcggtgccgcctcgaagcgaagccggctgatcgcttgagcgggagccgacgcgagcgagccaagctgggccttctcctggtgcggatggagccatgcagacacgccgttggatcagtctctcgtccacgcgtcaccaatctggatcgggtatgcacggtgcggggtttgcagccggtctgcacagaatttttttcccacaaacttgggagccttccaggagaaggatcgaataaatactgtgtttttattttttttctttctcctctttggcacagtagctgtagaggacccgtttggtctggggagtttggctgtgcacgcttttcaaacggctaaacggtgttttttttataaaaaagttttcattcaaaaatttgcttgaaaaaaataatctatttttttttaaaaaaaaataactattacttaattcatcacgcaaaagttttcattcgaaaatttgcttgaaaaaaattaatccattttttttaaaaaattaactattacttaattcatcacgcactaatggaccgctctgttttccgtgcgaacggttccggatagaaaccaggaacagggctgtgttcaatgctcctagttcccaacccatattcgttttccgcgtgcacgctttttaaactgttaaatggtgtgtttttttgcaaaaagtttatatacgaaagttgctttaaaaaatcatgttgatccatttttgaaaaagaatattagcaaatacttaattaatcacacgctaatggactgctctgttttccatgagcactgtgcaggctaggaacgtaggctaacgaacgcagccttagaagggattggaagtgtaaagggatgagattgttagctgctttgtttggtttgtagacatgggaattttggtggattggagggggaattaagagcatcaccaacatcttacttattttattccttatcatcaaatttaggaattttttgtcaaaaatcgtctccaagagaatccctatcctatctttcaatagattaggttcccaaatatagatatatcgtacctcacttctggggagtgaatttctatttccaatcgcgatcaactcactctcgctcactcacagcaaaaatgtttgcgcgctcctcctcctcgtcatgacatcattcctccgcaacagcgccatcttcagcgacgagctcttccttggcagaagttacggcggcctcttcctcggcagcagcggcagctgcggcggcctcttcatcagcaacggcgccggcgacatcttccttcacagcgacgctggcgacatcttcctcggcggcgcccttttcttcgcagcaaggttggtctcagtcgttgcttccgcttagttcctcagcaatggattggtaccacgacgcagtcttggtgcttggtattgaaaaggagagaataacttaagaaaaatatcttttttcttttcttaccaccgattctacgtgaaaaatgggttaatccaaaatgctcaattattttatatatattgtagaggtaacctcacctaactatatgagaaggtaaccacacttacatccatgcaaccaaccaaacaaaatctcttctcaattgtatctatcgtataggtaaccaaacaaaacctcatgctagcgtggctagaccaatgcaacaaccaatagctgtatatgtatcttcctagccaggtcaaacttaacctagatgagagagatgagctaggctaggggaatacgggcaaccaactagaactgttgtgagagcgtgaagtctactcttcccgatttgggctgtgtttagattcaacttttttcttcaaacatccaaaaattccgtcacatcaattatttggacacatgcatggagcattaaatgtggacggaaaaaacaattgcacagtttgcatgtaaattgtgagacgaatcttttgagcctaattacgctatgatttgacaatatggtgatacagtaaatatttgctaatgatggattaattaggcttaataaattcgtctcacagttgatagacggaatttataatttgttttgttattagtctatgtttaatacttaaaatgtgtgtccgtatacgtcaaaaaaaaattgggtatctaactaaacacggccttggtatgttatgctggcgacgtgttgtcagctagtacaatcaaaatcaagtgtaggtgttggcgacgtcggcgaggtgcccggcgagctccaccggcgcggagaacatggccatgtggtcggcgccggcgatctccctcacctcctctacggggcagccggcgatcatccgccgctggtaggcctccacgatggcctggtccttcccgcagaccacgtacaccttgcgcaccgcgccgtaccggtcctcgccgaacggcggctggcggcgcatgtcgtccacgtagtaggagctcacccgcaccaggctccgcgacagcgtgatgtcctcctccgggctcagctggtacagcttccgccgcatgaactccggcccgaacagcaccgacggcggtgcgtgctcctcgtccgtcgcgcagtccacccagtccgtcaatggaagcttccccggagaagaagaagaagaagaagaagaagaagaagaagaagaagaagaagaagaagaagattgcgtcagcttgatcgagtgagaacagaggaggagtgttcttggatgtgtgttttaccttctcgatgacgtcggggcgcgggctggcgcagtctggcatgagcgcggcgacgaacacggcggcggcgaccttgtccgggagcgtgtccgcggcgagcgcgacgctcatgccgccgaagctgtggcccacgagcacggcgcgctcgccgtccgggagcgcgcggacggcgtcgagcagcgggcgcgagtagtcgtcgaacgtgggcgcgtcgtcgtcgcgcagccggcgcgcgtcggcgcccgacgcggcgaggtcgggcgcgtggacgcggtggcccgcggcgcgcagcagcgtggcgaccctgtaccagcaccacccgccgtggcccgtgccgtgcaccaggatgatgcggctgctcgcctccgccgctgccgggacgacggccgtcgacgagggcatgatggcgccggctatagctagctaactgttgctcgtgcgaatctagtaattcagcgcaccgtggcaaactggcaattaatgtggcattgatataggctcatcatgcgggtatgagttccacgggagtcgggtagtgcgtcacggctgatgcaacgggaggggaggctgggaggtgcgccgggccgccactggcactgcctgctgttgcgagtctgtgacaaggataagtttctttttctttgttactaacatgtgagctagggatcattagacccacgtgacagtgacaaagttacatgactttaactgtagaggatcctgtccctatgatgagcgtgactcattttccaagattcgacaaaaaaaatatataaaaatttatagtccagtcaaataatgtggctattggtaggggacgtttacttatagttataaaatatttatctatttctagcagctatcatatcttaaaatggagctattttttcatatatatcctttaattttttcaattagtcacgactattatccatttaattttctcatatactttctcttctcgataaatcgcaatatttcttcaatcatttccatcaaccttcttaaaacccatgctcatcttaaaaatatctgataaaactagcaggatagtatttggctgcgccggttggtggcttaaaaaaaagaacaaatctatctatctattatatactaaaaatttattaaattgtttacaaacactcctgaaacgacacgtgtcttactataaacgctcctaaaccaccacgtggcgttttaataaatcctaaaattctgataaaaaagaaaaatatctaactgttgatttacattagatctaatttttttaaaaaaaaggactccaatttttaacccaatcaagaactgcatgatcgagagataattcaagactgcacttgatccacaaattaatgcaccaaaacaatcaaggactgcatgctcgagagattattcctccctccgtttcatatttcatagtgtacgaccctttgattttgtttcgttacctaaaaagtttaaccaaatttataaaaaaaatatagcaacatctacaacattaaattagtctgattatacgagatggggggagtagattattaaaccaacaaaattaaaattaaagattgtgcatgatccacataatactacatggataaattaatgtcagaatcaaaacaggaaacttaaaaattgaaacaccacatcagatttatttaattcactcttctcctctcccatttaattcgctattctattttctaactaacaacttaatataaaaaatcttagaaatcatgagaaaaaaaacacctaacgtttattcctaaaatggtgggcatgttattttaaccattaggatctgtttggcatagctctatatctttgatccattgtagatttgaaatttacatgttaaattatagttgtttaaaaaatttaagtttcatctaaaataggaacaaaatgatttattcgaatgctatcaatgtaatcgcggatataaataaatggatttgtgaaactagaaatacacggttttaataaatcttgtatccgaacctatggcaaaaacaaccaagatctatttttaaaaatagacaactcaaatggatgaccaattggatctatgtaaagaaaacaaactatcctcccctccccctgctgctttacatttatatgtttctccttccgcaccactctcccctcctctcctcctcccatttaattcacccctcctaattttgaactaatgacataataataaaataatctaatagttacatagctaaattatagttatatttgctttttaatttgtttgaactgttttacaaatggatagctaaataactcgagatttatattactcatataaaaaaaatcaaataagtcgtttcaacatatacccctattcttttgcatggaaaccaaataacattctaattttaatttttatatagttatataaattattgaaaatcttgaacatagcccctatcttttgcacctcaaccaaataacaataaagcattgaaaataatgatgataagttttatgtcatcttaaattattctacgtaataaagaaccattaaacatcctctataatgctcttaagtctccatgtgtcattgttttaaaactagaaaaaaaacttagaaattcaaattaaaaaagtaaaacatttgatcattggtttgtgcaggcaattagagattagtaatttgagagaccaattgctcagcatgtgtggaaggactttcaactccaagtatggatcagtcttccaattctaaccatataagtgatgctaaagaccatatatataagtcttgcaattttattattcccaaccactaaatctaccttttggaaaaccataagcacccacattgccccttcttaaaagttaggaaacatattagaaatccgaggagaaaaaaaatatgatcatcggtttcacttaaattatttagaaaaaattctagggtctttctacaaatttatggaatgcaacataattatcgcaactggattggcattgtaggcttcacataaagattatataatataaatgtacttaattcatgccaagtgtaggctggattaaaaagaaatacatagttacatgatttctagcattaaaatataaattttatagaaaaatattaaaattatggaagcaatcataatacatcacattgcaaaaatagtgatgtttgtgcagctatatttattcgtctgatcatgttaatactagctaggatgcattgagcctcgcacactccacattaaacatttccaatagatcgtctcccacacttccccaatcgcattggactctacaaatgcatacatttagtgtagcctcatatcccacacaatccatctgttaattaacaataggaacctatatcagtcttaacttggtgattatttttcaaagttgacttaaaataagattagtataaaataaacaaaaaatagaaaaaaaaatgtcaatagggactaaattgaaccaattggagaaaattttatagttttttggctcttaattctcatctacattgaaacacccatttgccataaccattgcattatttttaagtagttatatattaatggccttctctgtatcatatgccatgcatcatgaattttttcacatattattgcatatataagccacactaaggtagtagtacataattgatttaaaaattatatttaagttgactaggtatttttttttatatttaagttttaaaactaatgttgactaggttttttttaaaaaagaaacaccataggtcaccaatatcatagggaagtgagttctatgatatatattttttccctgtctttattgttcatatctaagtatttaacaaatcacatcaatgtgaaccaaataaaaggagggctagcctgatggtaaaaatagaatgcatttgagaggccgtaaacactaaagtaaaaaaagaaaaaaaatcttacttttaagtgttaaatttgtttcctaaaaaactaagtctacctttctttttctttttagatgataagaatattatagaaaattatttatagggatgtattaaatattgcatagtataaaagttaacaaaattacctaggcaattctgacaaagaaaatttacggagaaatcacactttgcagatgcaacctatgacacattgcagatgcaacctatgacacatgcaatgcgcgggctacttttttagttattaattaaagtgtaaattttatattgaaccgtctctttttatcatgttgtaatttggactaggattaacttacccttttcactctgaatcagatttttgctaaacgtttcaccttatacccgttcttgtcatctctgtactcctttcctttaggcatgcaaatctgagcttgtagttgccgccatgaacagggccaaacaagctcaagctggctcctcgccgatagcaaaaaatgagaaagaggtgaagaggtcaccatgctctgcttgcttgcttgctgccgggtaagaacaagaggacatcctgccctgagctcgagctccagcactttccacgtctaaagatcgagctccaattcatctgcgaactcaaccactgtgctgcacaggctcatccaccttcaccacttcatcccaaatccagcgcgctcaacctcatcatcgtttggtggagtggggaagaagaggatggatctttcttcggcatggtgagaagaggggactgccgtggggattaacaaggctggtgagtgacatgcaccacacgggctcagggaataccgaggaggaggaagaaaatcttgctcacttacatgtgagtcaccagtccaatatgcaagtttgggtaatactaaaacatagtgtaaatgaaaagaaatgatattacctagtgcaatatgtaacttagttaataaaaaggggtccaaagtacagtttactctcaattaaatattagctattgtaaatattgaaaatggatttattttttttaaaaaaactattgtacatattaaaaatattgtaaatatttacaatatgtgtttgtaatgtcatattttcaaatagacaaatttataatggctggatccaattaaccctacttagtactaatcctatacccaaatcaagtttcaccataatgtcatccaaaagaaaacaaattaactaattctccatcaatcgcattaattttagatgtatgtgttggcgacgtcggcgaggtgcccagccagctcctccggcgcggagagcatggccatgtggtcgccggcgtccatcaccctcacctccgccacctcggcgttggcgaccatccaccgctggtgctcctggacgatggccatgtcattctcgaccaccacatacacctttctcacggcgccgtacctgtcctccctgaacgccgcccgccgccgcagctcatccacgtacaaggagctcgctcgaaccaagctcttcgcaagcgtgtaatcctgtgctgattaggttatgaactgattagatcatggttaatttaatcaggagttgtgcgattagtgattaattaacagtttagcagacgcacttccggtgagcttagctggtagagcttcttcttcaggaactccggcccgaacaggatggaaggtgggacgtggcttggatcgatcacggtgtccatccaatctgattcttgatactggcagtggcagaaattcatggcgaaaataagaggaaaagaaagcgtaattttgtcatcatggtatgagtttattaccgtgtcgatggggtgggagggtgggttggcgcagtccggcaggaaggcggcgacgaacacggcggcggcgaccttgtccgggaacgtctccgcggcgagcgcgacgctcatgccgccgaagctgtggcccaccagcacggcgcgctcgccgtcggggagcgcgcggacggcgtcgagcagcgggcgcgcgtggtccgcgaacgacgacgccggcgcgccgcccacgcccaggcctcgctgaccggccgcgccgaggtccggcgcgtccacgcggtgccccgcggcgcggagcagcgcggcgaccttgtaccagcaccacccgccgtggcacgcgccgtgcgccaggatgatgcgccccgccgcgccggcggccggaagaggagccattgctttcaagaggaacagacaattacgagcagaggtcactaactcactatagtgaatcgattgaatgattgagcctagtgcatcatgaatagcggaagcagccagtgttgacaattatttgccttttgaggaaagatggctttgagcttagggtttagggagagcaggagtaacatggcaataccaccgaggtcctcgcgttggcgattgccggaggggatcaccattcaccaaccggtgtcccatggggtttacccatgcggatatcctcacggaagtggcacgcggcccaaaagcaaaggctcgtggcgcgaagctgcagcccgtgaaggaagtttcgacagaggaatggcccgagatcggcatcaatggcgacacaagaccactagctacagtgcccacccacagtgagatcgaagccccaagcggagcaaccgagggaaagtcatgacaaaactaaggtgaggattggattggaggatattttccccaatatctctcccattgtttcgcaagagtagatctaggtaaggcgaggtgagacccaaccacacctagggttcctggcgagaggtgatgagatatggcgatttggtgacacagcgcgccggatttggaaggtcctggagaggaagtgcgaccaccgttttcgtttgcccaagtggtgatggagcgccaactggcaaatcggtcggattggcaagtcaacaaacattgtacggtggagcacggtggaggttgggagggggggacaggatgcaagggaagaggaggagctccggcggcaactgcttgcccaaaaccccagggcaaaccaaggcgccatctaggggtggaggcagagcgaggggcgggagctcctaagatcaaattcttcaagtgtaccgcgaaggtcacaaccaggcaacttgtctaaatctctttctctgttattcacgtcgcaacactagcacatctctatacactgcccaatgaatttgatgaaaagaggtatcaaactatgtggatttggaatcctagggcaaggtttctatagcctgcaagttgatatgttagaaacagagttagctagggctctagtaagaggaattttgacagtaatccatggggagacagttgtgggaaggtggttattgaattgaaacacctgtttgtggggtagaattgggagtggaaagtgaaacaacttaatgagaaagaatttctcattaatttttcttctgataaggtgagagtaagatctcaacatgtaaaagctttgactttgagacatctatgatcaaggcaattgtggttgagacaaggataacataagaggcagaagatgaaccggtagttttatgggtgaaaatttatggtgtacccaaactagccagaatagaagattcagttaaagcaattataaaattggttggggaatttgaggctattgagggagctagcttgaggaaagataagcctgtgtgagactgagagttgtatgtaaggaccctagagaattacacttctccatacacatctacatcaacaaggtgggctacatgatcatatgataaccagatggctatccaccatatgaaaataggcaaaatccccttgatgatggagattgtaaggatgacaaggacaatgagggtcaggaagaagatatgaacatggatgatgagttcaaaaccaaaaatagtccaagagggagacaaactcagaggtgaagggagccaacaagggagcagatttggaacatattatgcacctcctacttacatagggaaaacacagatgactcatagtgggaaaaccctgaagaaattggcatcaaagaaagattcattgctgaagaaagtagaaaagacagaatgttgtactactatggtgctctgggggaagaaggaggaaaatctagtcatagaacaagagtctcaggagatggtgacaccggtcgagatgcaatctcaagatgagggaggtgaaatgacaaatgagaagctattaatgcatgaatgttccccaactgatgatgattttgagagatgtcagattcccactgattctgacattgaaagacttagagaggaagaagataatgaagaggacaatttccaagaggtgtctaacaaaaagaagaacagggctaagaaaacagaacttgcagtgacttcaaggatgaatctaagacaaagggagatggctgctaacccaataaccaaaagaactaagatactcacctagaagaagaacttggagcattaagctacaacaactaattaatccatttgctatatttcagttgttagattcgattgagttgaataatattactattgcctctaacttaaacttaggtagtacctctaaagagagaaaataatatagagactctaaaagcaaggaaattgttcaggctagactaggaaagctaaactggaaaaaagagatttaaaagacaaagacacaagaggaggtggtggagtcagagacagaagggtgagatgataacaagcaagaggaagaaaaagaggagataattatatgagaaatattgtaaaattgcatttttagatcagttatgctgatttaatgtatcacaataggagaaaaacaccttggtaggtctccgctgctgacatggttgttgtcagggttatggataccacataactaatagtagttgactaaatctcagcaggacccaccacataccatgtcctatacggaaacaacctgcggatataggaggagttccagataaggaaagacaaccagagttctatatggaaacgacaaagactactcggattgtatccatattggtttccctaattctacttgaacaaggggacacctatgggtataaatacaaggccccctaggaggagaggggagacgacgatacacacccacaatcaacagacacgggtaacatagacgtcacaaagctgtgagccaatacaagccaacatacgccaagacaagacgccggatatcgacttcagggattggcacggctagtcccctacggtgtctccggatactatcaggagagacgaaagcgctatctctgatctcgccgggcacgaactcgaggaggaagactaccctgttgtcgactacgagtcagatcttcagaccgccatgtcgacaacagttagataggctaccccaaacattgtactggtgtgattatggtgaataagagcaataccggctttggccaacaggatgtagggttattacctggcaattcaggggcccgaacctgtataaaaacccctgtctccgtctcttttacctcagtctcgcgtatatcctagtaccaacgatccccatactatgcaaataccggaatcgcgacatcaaacgtcgatagttgtcaatggtggtaaaaatttaataagtagtcccctctgaaactcatcatggtaacatatttgcatttagctcctctgctgtttatctctaacctaactcctctctactccatttattatcctctttggactcagagaagggaaagtggtagcgacataagagcatctctaacagcctctccattatactttccaagccaaaatttagccattcatgccaaaaaaaaacatgctccaacagcctctccaatccactagccaaatttggcaagccaaaagccactagccaaccatgggcccctcgcacattcctcctcccatctcctctccggctcctctctcgctaacgtcctgccatcaacgacgccacaaaggagagaggcgtcgtcgccagccgcgaccaccaccgtcctccacgaccgccgttgtcccccgcgccgtcggccgccgccatcctccgtgaccgccgctgtcctccgcgccgtccttcgtgaccgtcgccctcctgacgtcgcccaccgtgacctctgccacgaccaccgccgtccgaggtagagggcgtggggaggaggcagcagtacatgaggaagaagagagatgtatgggtggggaaaaatgtggtggaagagaaggaagaaggttagcagagactgacatgggtcccatttgtcatagacttataatggagatggtagatggagaggctgttggagcgagtaactagtttgactagctaaatcagatggagagttggttatatgggtgtttggagagtttgatatggagatgttgttggagatactctaaaagtacggtgagggtaggatgatgtgaagtacagtgagagtaaggtgtgtaggaaaaaaagagaggtgtgggtcatgtggcatcttttcgtcatcatcgccatggcaagtagatcgtcttttttttttttacttaatttcagttatgtttttcctacgtgggtattctctcttatatgttatgcaagtatgtttctatctcgtatcttctcttccaagcatgtatttcctccttcatattataagactttctagcattgcccacattcatatatatatatattaataaatctagatgtatatgtgtgcctagattcattaatatctatataaatgtgggaatgctagaaaatcttataacatgaaaggaaggtagtagtaaattactttcaatcctaattcatttgtacattgtgtgttagaaaaattacaatgcaaatattgttttatagcgtaagttttgaaatttactgtctaactataacactatacaacggcaggtaatttagagtctaaaacaatttgattattcttttagaaaaacatggatctataaatatatttataaaataatcatataataatgtattaggataggaggagaaaatgtactattctgttaagttgattgagaatggtaaattccatttccttctggtgagataatcccaaatttctactctgaaccccaaacgcagaagccggcgaggcggcgagccggagaaggatgaatccgccggagctgatggacgacctcgtcgacgagatcctcctccgcctcccccccgacgagcccgcctgcctcgcccgcgcctccgccgtctgcaagcgctggcgccgcctcctctccgaccgggccttcctcctccgccgccgacgccgcgcgccgcctcccctgctgggtttcctccacaacctcgacaacgccgaccaccccgaccgcttcgtccccaccaccgccctcccgatccccccgccgccacccgagctccactgcgggatggccctcgactgccgccatggctgcgccctcctcgacgcctacccctccaggatcgacctcgtcgtgtggcaccccatgacgggccacctgctgcggcggcttccccgccccgacgtcccgtacctcttgtactacaacgccgcggtgctctgcgccgccgccgccgccggctgcgaccacctcgactgccacgagggccccttccgcgtcgtcgtggtgggcaccgaggaggacaacgaggcgtgggcgaccgtgtactcgtcggagtccgacgagtggagcccaccgacctccgctcgcctcgcccgaggacccgagttctgcgtcgagggcaagcccgccaccctcatcggagattcgctctacttcgccctcgtgtttggtatcggagtcgtcaagttcgacatgaagcgccatcgcctctccctcatcgatccgccggctgagctcgacgatggcttcgtgctcatgccgctggacaacgatggcgtgcttgggctcgcggccgtggaggatcacagcctcctctctgtgtggtcaatggatgtgagcctggatcatggacatggtgtggcaaattgggagaagtgcagggtcattgagctagacagtctgctaccaaatcttgatcactctaccccagtgctaccaattggatttgtggagggtgccaatatcatcttcctgagaacagatgcgggtgtcttcacacttgagctcagatcaatgcgtgtcaccaaggtgtgcaagaatgggttcttctacgctgtcgtgccgtacacgagcttctacattcctggtgtccatctccagcagcagcacagcggacctcagatcagtaatggccgggcatggggatcgcaggctgctaacatgaggcgtggcagcagtgagcagccgagagagcgtgctccactgcatcagcagcgacgggcaggacggccggtgaacagccaacgtcctactggtgatatggtccgttcttcaggccgtgctagcagattggcatctcaagtgcggcctccatggagaccctaatgattcgcaaggtggcaatagctgacaataatgtttaatctatcgtgcaatttacaggtggtatattgctaatcgtcggttttagtcatttgtgcgatcaagaagaatatcttatggttttgaatgcattgtcagtacagaatatctaaacatggaaagagcagattaactgagaggagtgagagctctatctcgtatccgctaactgaatttccagttataacatccaatttgtttatgggctttcccattgtcatactgcaagtctggtgaatgtttatttcaagcattgcacacacttttctttcttgactaaaaatattacattctccttatgaatcgtgctgctcgaaagggctctgaattgatccaaaaaaacgcaggttttttatggatggttgtatggaaccatgcatttaaatatgcagaatatgacaggctgaaactaacttagggaatccagtccatgtagactactgcagccaataacctaataatatttttaatttctttatcatgtatctcttggtgccttttctctcttaagttaggcatgggtgtactcttatgtccttctgtcttctcttttatacattgttatcctttttactttttttttatataaacacaaagtatatgcgcatagttcagttggactggaaaggctaactcaaaatcacttcactatgtttctgatatcaggtccacctcatcagtttacacttgaacaaaatactacttctagttctacgattgaacaaagatttagtttacacttgctgtctcatttcttctttttttctaaaattctggcaggggaattgccttttcaattagatagggataatattgagtaaaatacagttaatcttatgcaggattgttcagtgctcacccatgttttagtcgatcattactcgtaccgggtatataaattaacatatagggagtacaacaaaagtactgctaaggagataaaagattggcataatatgtccaagtatttaggctgaagttccttgtgtttttgttcctaatatgatctgctgcacagttcgtgtttctgctattaggtatcacataggagtcgtgtttccttcttggtttggctaattggcaatgaagttgactcctgaagctgcatttcgtgcaacaatgggtaccattcaggactctgatatcatcattgtggtgtttcacaacatgaagccagaagattgcttgctctctagcatcctctgttttgttcaggcttctcaaggtaaatgaaaactagttctattctgagccttacaaattaggcacatttaactcctaggcaagaacatggacagatgtttgaaaaagaaacattatttaagcattatgtttttaaaagaaaaaacttcttctgttccttacgaactgtacatttatatcaacatggaaggaaatgaacagaatgttttcatcttgataaaaggagatgccagaaaacaaaacaggagttttcagtctcaattcatagaaatggtgggttttcttaggcgtttcttttggttgtcctaatcttcttttttgttacgctgcttgaaacctcggcagttgtcacttcattatcggatcatggtgaaaaacattctagttttaagatgaaatagagaagtagagttgcagacataaacatgatctgctcttacatcatcaccctgttaggacttaggagagcatagatttgtaccgcaaatactatcttattgagagctgcatagatggaacaaatgtgctcatgtacactgggtataggattgggcacaaatatatatggatatccttattgcatccttatcctataaggattagtaacaccttgacatgcattccgtgcaacttccaatgcatcccttcaggaaactctgatgatcatgatgatctgtcttgctggcacatgaagagctaccctcccaagtgacttgacagccaaggtacattgcttgctgtcctccatgttttgttcaggagacatcttgatctgaaatttttcccatgcatcagatgcacattatggagctggaaatcttattactaatagtcttgctcatttgaaggacaaaaacctccatgttctcatatgaagataactgactggacatagttaagaattgtgcagagtacaggtggttagcttaaattaagtactattgcactacagtacagctctgctctccaagagtaaaaacactctgttccaaaaggttagtatatagtttaataccaatgaaagggattggtgtgcatcctgtcaggactacatgctattatttgatgacttgttcagacacatgcgggcatacttaagcattccaagagtccgacaaattagctactctgtcacaccagatgctggaaatcatgacaaatatatggtagtccacatagagagatacggcagtaccagaagctatacatacgtattgattttttttaagtcatcttctatcattttcttcaaaattaaagatcaatgttctatattaaatgatcacatgtctttgtattagctagaacaagattatgctagcttacccatcatgcggcctgaacactcatggaaccggttggtacatccagcaaggctccattgctgtttgcatggcctatcatgcgaaggattattgtgaatacgacttacaatcaagtgcaaaaacatgctatttttttacaaaggcaaacatacctgcaggttgtcttgcaacgaaaaaacatgcgccgatgacaatgtagcacaggaggaggagaatccccttcaggtaatgtgatgttccatcctgtaaatcaagcccattaattagttgacacattgaattgcaacatgtcacttaagatgttatcctgttatctgagtaattttcggtgactaaattccatttccacctgttcaaagtaaaaatgcatgagtcacagtgtacctgcagggtgaaggccgtcaccagcaccgccatgaacagagagccggtctctagcagcttgaagtcaagatccatttggacccccatgatccaggccacgagcacactcagtggcacctgcaaccccatcatgatttggcaatccgttcaaccggatgagagcagaacaactacaggatctgtactgggtaagttaagcagcagcactcaccacgaacatggatatctgggtggccgatcccagagctaccccaagagtgatgtcctgaatcaaacaccagattatgttacattaattagcaagttaaacattgattttgttttcaggagagacgactctgatcgtttgcatgggatgcacattgtttgtttgaattaccagcttgttcttgagcgcgaagatgatggcgccggcgtgctcggcggcgttgccgacgatggggaggaggatgatgctgatgaagctgacggagaggccccatgactgcgaggtgggctcgatggtgccgacgacgtactcggagaggacggagatgacggcggtcatgagggcgagccagaagagcgcgctggcgaacccgagcgccggctcctcgtcgtcgtccccggcgtcgccgccgtccacctcctgcggctcgaacagctggcggtgcgtcttgagctggaagaagaggtaggcgacgtaggacgccagcatgacgaagctgcaggcgcgggagaggtcgagggacgccgcggccgaggtggcggagacggagtgctcgccagcggcgacggcgtagcggaggaggagcggggcggagtggcagaggacggcgaggaagaggagggcggtgctgacgtcggactggttgcggtcgtagggctggcgggcgccgaggttgacgacgccgccgcagaagagggaggtgccgaggacgaggaggaggttggagaggacggagcccagcagggagcacttgaccacctcgatcttccccttgagcagcgcgaacagcgcgatgatcagctccgtcgcgttcccgcacgtcgcgttcagcagcccgcccactgccccccatgcatacaccatcatcaacacaccacaacagcaagttcaattacttcatatacaatgcttaggctgtgtttggtagctcatttttttcttctccgtgctcatttttttcaaactgaaaaaattttgaaaaaaattgatttaagaaatcgtattaatccatcttttaagtttgttttagttaatatttaattaatcaagagctaatagatccatccgttttgcatgtggacaaatgtagcattaattatttttggtttctctagcaaaatatgagacatttttctctgatcttttataattttaaaaaaacatttgctacaacgaatagagaaacaagtgccattttttgatgttaagaaagatgattccatccacgaataatatgaagtcttaaattactttcagtttgggactgatcgttgtgacttaccggtgggaccggtgtagagtgcaatctgcctgcaaaatttcagtagcaaaatgcaaaatttcagcattcgaattataaacagaatttttaaaaactggacataaaaattgcttctgtaacgagtagcttactctgtgaggaagctgactctctcggcgagagggatgaggcccagtaaactaagagcgaacacccacacctgtcaagataaatatttgtttcccaatgtcaacacatattggattaatgtgcaatagtagttaaaagtataagatgaagacatatcgacaaaaaaaaagggaaagtactgtaaggtaacgcattattttattttatcactaatttactagcactggatcagcaaaaatacctgcatcacaattaaataattagatgccacgtggaaggaataaaacatgtctcttccaactaatcaggaataaaacatgtctcttccaactaatcaggaaatgtgacagactgttggcctcaaccactaaaatccaacacttccaacctttactggaagcagcttcactcatcatccatgcatgatgcatgcagcagagtgtgaacttatctccaaaccaaactaaatctgttttcctttcgaaactaaaaatcaagctaaatctattagcacaacacacaatcaaaccccctgattcaccaagctccaaaacacaacggagattgatcactttctggggtagaagtacactcaaccaagaggcaaagaattaaatgggttggattcgtcatcgtcccagccgcttgtaccggcagaatcctgtcgtctactcagcaagcagcaaaacggcatgacgccgctaatttggcggatcaaagaggaatcgagtgcaatttgcaagatgacaaattaagttcagtttttgctgcaaggagacagatgggttttcttcaaagctcagggctccacggcagaatatttgtgtcccgacgaggcaaactaactggcaaagctaataggctccaccagcaagcaatacaaactactccacaaaatatgttttgcgggggaatattctactatcacagaggagggaggaaatcacaagctaacagttcataacagaaaattaaaatactgaataatgaagtgctccacattttaactcctaggcctgtatttcaggttacatctgggccatctggcagacatggatgcttattgcgtcatcaagcctaggaattttgtggaaattgaactgatgtatgagaaatttctgtaatttattgacttctttaaaagaggccataaatgtatgtactaagggtgtgtttagataatgagaaatgtgaggtgggattgagatttggaaatgaacgaagggttaggattaaatgaaagagcgaaaatgaatggttatgatttaaagatgtattctagtgagtgggaaataatttccatgtcctattagcctaacagcgcctaattttcaagtggaatcaggaagtccaccggaacgtccatggccagtttaacactagtactagtggtacaagacaacattttttgtatgtatactttttaacactgttactagtaccactttagacattgatggctaattctactacagttacgaaaattaatcctacaccataaataaaagtgtcaaagagagagagagagagaaaagaaacaggagtgcaaggacacagccctcgtgcagccgtgcagttgcccatgtggccttaccagcaaaaagctacagtactatatctcggtttatactagttaaaaaaaaacttaaaataggcgccgcagcggcctgccacctggtcaccgccgcttgcaaacgccgaactcgaaaaaaaaaagatgaaaaaaaaaaagatgcaacgaacaccaagcagacaagaggatggtcaaagcgaacatggaatggaatggaatggggaattgaattaacctggtcgaagcggaagcactgggcggcgatggcgagcgggacggcggggaagaggacggcgagcttggtggcgaggaagacctcctggaggttggcgagcagcgggcggagcggcgccacggggaccttccgcaccagcgcggcgtccgacttcttccgcagcgacgacgacgacatgttgtgcgccgtcctgctccgcccgtgcgggtgccgcgccgccagcttccgccccgcctccatcgccgccgccgcctccatcaccactagatcaaattcgatccccccctatgcgcgcagcgcgccgccagaattgcgagagatagataggcagatggatggatgtgagaatcgattgatggcgccgtgcgcgcgcgcgacgcgagagtcgagtcgcgagagctcgccgccacgaggaggttctcgtgatggtgtgtagttttgtacaggacgaggagaagcggcagcagtggcgagctcatatatagggaggagccgaggaggagaaacaaaaccacaaatgcaattatgcggtttcgtcgtgagcgaattattggatcatcaatgtaatgcaatccttcgcatcatcaaacaccagcaaattattttttttatataaaaaaaaggaacaaacacgtactaccgatctaccatacatattttacggattcagttcattaattcattcgagggtatatatgtttagtttccgcttaatctcgatatttatcgcatgtataaatgaacaatactactccagcagcagaaagagacaaaagatgagatgggtggatggatatatagagataggcaatgcactggcagagtcgcagagggagggagggagggggaaaatgggaaaacgaaacggaaggctgcagacgcagacgtacggacggggcggggggtgattgatccgtggcggtttgattgcgtggggacggcgacgtgggtggggggggggggggg

SEQ ID NO: 59704 - DNA, 629 bp, Oryza sativa
tgaaatagcaaatgcggtatggtcctgtgatttaagctggaagatccgatgctgtgttgggaggcttggacacctttcacattctgagtctctcaagtaggtttctatactacagggccatcctgtacctgttgtttcttgatgtgtagagtatgtcaaccttgcttgcttgacatgtttccttaagttctccatgttccatgcattcgacgtaatacaaactgtagaccatccttctgaaagaagggctcctagcaaaccatgtacatcccaagtgaataacccctaattaacttgctgttgtggacttgtggttctcttttgtgtcatctttgtgtatccttcatttgcggtgattgttggctgcttcccttgcttgtatgtgcttttccattcttagaattgcatgctaatacactgttaatgcacccaaatttactgaccaatgttgcgcctattgattaatcttgaaagttgaaaccaacaactgttgtgttcttttttgcttagatcaccatcagatggaatatgacatgctacctatatggtccatgtaaaacgactctatatggttggcttcttggattctttagacaatgtacggttaggcgttttgatgtgcttagcgc

SEQ ID NO: 59705 - DNA, 652 bp, Oryza sativa
ccaaagaaatctatgatgcaagattccctgtacaaatgccatcgccaaattggaagataatctggaactgtcgggcgcctttgaaggtaaaattgttcgcttggctactggtccgaaacagactgtcgacaaggatgaatctatcaaaaaagaaaattgttcaatcagcttcatgtgcaatctgtagtagcggggacgaaacaacaaaccacttattcctgacttgcccgtttgcgataaacttctggtcaaaagtgcgaattcagccagctatccaagatgtgcaactctttcatcggctgagcaattcaccgttactgccgtcgaaacacctccatgtcttctacatcttatgcttttgggcgctttggaaccataggcatgatgtggtcttcagagggcagcaaccatctttagctgcttgtttacaccgagcgataagtgaagcaaccctttgggcagaaacactagctgtgcaagatcgacatgtaatagatgtctggaaacatcttttctcttccgcacttcaaactctgaatctgttgtaacaaaacctttcaatctattatgcaatgacaattcaggtggggaatctctcccccccccggtgagttagtaaaaaaaaacaatttggtatcagacccagcctggt

SEQ ID NO: 59706 - DNA, 1472 bp, Oryza sativa
tcatggtaccactagtatgattttaggtagatgcttcgctggttaattaggtaacattaggtggttttacaactctagaccttgggatattcatatcacctggacactatggaattgttggattattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaattgaaggctacacgagctgcggcccagtagtcgagatgtcatggcacagggccggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtagaatctattcgaatagccgcgccctcggttatgggcaagccgagcaatgtacccaagttagtgttttaattcttaaaacctgcttaacaactaaaatatggaatggttggcctgggttggcttgggacgagctgggacccagggtcgggttgccagttcggtctgaatcatcgtaggccttgggttaaggcaggttcgtgtgggttcacggccttgattaataatattgtatagctctagaatcgtgtttacaaaatagcttcgagcaactaagtgtcttttaatgctatttactgcaaaccctaaccctttatattataacccccttgtacttccctgcatttattctgcacttgtgggtgtgtcttgttgagtacggtggttgtactcagtcttgctcaatttttcccaaacccagaagaggagtccctagaagatgaaggctttggtgtctagctcgtgcctgccgtcaagcgcctgtggtcgtcgccctagtcttccgctgtttcccgtttgtctttgtgtgtgctgggccttcgccgcccatgtaataaattaactatttacgcttccgcttgttgaactctgaactgtatcaactcttggtgtaccttgcctcctgggacaaggaataatgcacgcacgtaaggaacgcccgttgggttatttccggtcgtgacatccatgctatagaaaaacatcgggtcttctgcttgcaattcttggaagtacttgatggtttcagccatgtcaccattgcatgtagtccggttcctcattgatgtccttatgttactaacatctttcttcgtgaacggtatgttgcgaatg

SEQ ID NO: 59707 - DNA, 23327 bp, Oryza sativa
  unsure (1)..(23327): unsure at all n locations
gatgtcattctgctcacagtatcctgatacacgagcaaaagtttcttgcttctttggatagccagagatggtaatgttaccctctatgtatccactggtcttcctcccaccaacacatccatcaatgttgtttttccagcaccactgacacccataagagctgtaagtactcctggcctaaatgaaccactgatgcccttcaatagctccaaccggctctctgtcacaccttgtgctttaattacctacaagtttcattggatattaaagccagttagagttgctcttaagtattatagatataggagaatcttcatactgagcatgcacatttcagatatatttatatttcagtaattctctaccaaatacctctggcatgtcaacactgtatcttatatcttcaaacgtgatggagagaggtacaaaagggagaaccattcctttcttgcctggactagaattcactgttgcatggttggaaattgcttcatcattactatcatccgcagtgtctggtaggcatatcacatatccgaggttgttgttagatggaaactcattatgttaaatcatatttagacagctaaatacaaaagcgaacagtacttgtgttggtggtaattcgtcctctcgaggatgcttctataacatcaccggtcagattagcttgttttatcttcaacgtctcctcagatattgttggctgattgctgtcaaatgctgcagtgaaagaatgcataaaaatgagaaattataaaaatgagaatttataagctctggcattccaaatataatttatttctgactcacgattgaggaatgtgaggcagattgtgtagaggatattgaatagcaggacgtatccgagcaatgcaccaacaccaatccaataccatttggcctcagggaaaactccacgggattcaagaactagttttccaagtggctccctgaaaccaggtattgtctgcagtacagcaagaacagaacactttagccagacattcatataatggctgttaatcgatttccatgagtattttttttaccttgttccagctgtgacctagaaattcgtttactgatatggcattttgtgcatacatcaggggtgatatccagtatccccatatccaccatttcttcacgttctctgttcaatcaaatcagcgtccattcattatttttttgatgtggaaattatagaggaacataagcaatctgattgaagaatatagataatttctgccttacctcttgacaggataaatcctcccaaaagcataaaaatgagtatacagaatgaacccatagtgcttgcaacaacctgatgccttgcaaacccagcaatgaagcgaaacagtccagatgatgtctcattcattactaaaagcagcaggaactgtctaaaaagcctgaagcattgaattatttcattagtttctgcaatacattcataccnnnncncaatgcaatgtggaattttgttttctttacctctctacattgggatcaaatccaatgacataatatgttatgaagacccatattgttacattgagcaaggagagtggagtcttaatgatccatgatggtaaggagtatgtccatgctggatagaagaggagatccctttgcttgaagaaaacagggagttttgcaatagttagaccaacttctgccaatccgttgaacatgatcatcaggatcccaaagaagagtgcgcccatgtatattcccccatttgttattgagtcatgatgcatattggtgcggataaagacagtcatcgcaatgaatgtcatgagtgttaactgaataagagagaaacaacacaaattaaatttgttatcggcttccatgttttttcttaatagaaacctgtattgaaaagtttcggtttcaagaataacctgagttgccttgaatatatacacaaaggagttccttttcatgagcaatatctctctgtcaatgttcgctttaagcagttctttcatgctagcaccatattttgatgttttcagggcagcagggtggctcctgctcttgtcaaatgggattgccaactcacttcttattgcctgaccaacatggaaagactgaaatgcctctgcaaactccttaacaggaacatatcggtatgtctcatcaccatgcatccagtattgccgctgatctttccttgaagtaacctataacatatcatttatattaattcaaactcaaaagttgcactaaattatgattgtagcatttaaaaattctctagaaagttttctacattgtcctcttcttttaatttctattttttcttaagcgagaaagcccagtgtaagaaatattttcaagtccagtataagaaatattttcaagtaatgctacttctatatccatttcatttgaaacaatattatatttgcatagtttactttgtcatatatgtccagtcttgttctgtaacaagatactgcattttttccatgagatgtgtcactagaaaaaagcttgataaaacatgttgagagaactcaattactcacttcctgcaagaagtctgctacgccttttctctcaggacatttgaagccaactgattcaaagaattctagcacatgttcacgaggaccattgtagacgacctgaccgtctgagaggaggattatatcatcaaacaattcatatgtctctggtgcaggttgtaacaaagcaatgactgctgttccaccaacaatgtggatggtctgccggatggagtccacaatattgtatgttgtggagctgtcaagtccagttgatatctcatccatgaaaagggctcgtcctggggtgacaatcatctcagctgcaacaccaatttcagggtccgggtaagcagtgaaccttgtatgtctgcaatatgtaagcatctagtactttatttgtaccaaagatacattacctgtggttactctctttttctgcccccctgatatgcctctcaacatattgttgcctacgattgtgtcagcgcaaatatccaatcccaagaccttcaatagttgaataaaaacaagaattgaagaattagtatcataaacacctttcattttgtataccccctgagaacatgggagaaacatttgttgccattgaagtttgaatggtgatagctaacgtaaattatattagaactgtatataagtagttattgttcatgcacctttagtatgtgatttgtgacacctcggctttctgctctcctgttgcagcagcctacacaagccaaataggaagttcatatgaatgaagctattctctgaaacaattgtagatgacaaaaactaaaaatcaacaaaatggaacaacttgtgaattaaatgaattgtgatataagaactgcattgaaccttcaagtatatatctacttctggatctggtttaatattttcttccttttctctccttgatagttccattagcagatctgagcattttttcagaaaattgttagctattccatgtgacatgccattgtccagattttttttttcatttttctgtttcttaccgtaacggtggccaattccttgacattttgcagagaaattgactgtctcacgaaccgtcaattcacccatatgtagatcatgttgactaacataagctgctgatctccggggctcgaattcatccatggtatggccattgtatgttatttgtccagataccttgtgcggttgcaatgttacatttatactagtacttccaagggtatgataaactgacaaagcaatgtactcaagtaaataaaaagaataattgagtacctttagacctgaagggacatttccagccaaggccaaaagaagtgtggtttttccagcgccaggaggacccaaaagcaaggtcattctgaaaacagaggtataagttaacatactgaacaaaatgaatattatctggaaactggcaatatgctgggaagttacctgtgaggcttgattatcccactgacattgtgaaggatcgatattttctgcttcctatttggtgttatgtgaagagtgtttgccagaccctgtttgtatggaggtgattaacaccttgtcagtgcacatgcgtggacagtacaagaagggagtctgatgtcatctggtagatgaatgcaaacaaaaagtgtactgtacattcatgttttacattcacagttccttctgttaaactaaaaataaatttaatttaacttgatatccttgtttatgtgttatttacatccttgctgtagatattgtttaggaggtctactgatgatgaattctgtatttgcagagccctatgtttggagtaccaatcaggcaagtctgctgtttatcaagatgtccaagagaagtcgtgttaccaactccaaccagagaacctaatctcgttgctcttcaggatcaccggtttgactgtcttaacagtggcccagaattttgctgcactacaggaagctctctagctaacacgggcgattgtcgtaatcaaaattaatgacaagcactgaatttgtttttgccaactaagtttcacaaaaccacagatatattgactaaattaacacaaaactacagattgatacatcactttaattctgtagttttatgatatatcaccttaaatctgtagttttgtgataatttgaacaaagtatttgtagttttgtgaaatttactaattttctcctatcggtggatgtaccagtttgagttacgtttctattattgcaatagaaagaaaactctgactagaagtaccctctctgaaaatagtcaacgagaccaatttattttgacgtctcgtagcatattttattgagtattgactgtgacactttggcattactatgcaaagctcaagcacgtaaacacatcagggtaggtaccctgtacaccaatgaaaagcgggcaaagtgttcagtttattcagaaaactgcctactgctgaactgtgagtactctaaaaccccaaaactaatctgaaaaactgaacaatctctgtaccaactctcatcatcagccagattagttggcgaaactactcaattgtttgtgattagttaccacaacacatgatgattattattatagactgatgatatagtacctccagcacattggcgtaggtgttgaggatggtgggcaaacctctgctaccaacgtacgcctccgcttccacattcaggttctcgtaccgcacctcgatcgtcggcagctcgatcccaaccctgcatgcgcgcatccatcaatccaaaaccatcaaaatcactctacacttatcatgatgtgacactaatttggaatcacgcgagagaactttttcgaatttttggaaatagttttttcttcgtctgaactctaaactgaactgaggagggcggaatttgaaaaagaagaaaagaaaaattcgaatctggtacctgtcgacgcggtccttgaacttggagaggaagcgggcgtggtcgtcgccgacccaggcgaggcgctgcagcagcgcgtgccgctcctgggggccgaggcgctgcacgttcacctcccggagctcgccctccggcatggccagcaccgccgtccgcgccctgtcgtaggtggggagcttctccagcgccgcccaccgcagcgcctcctcgtcgtcctcatccctcgacgacgaccgcgagaagaacacggcggcgtcgcccgaccgcgccgacgacgcctcccgccgcaggctgcccccgagcgcgtgtatctcgccggcgtcgtccatcgatcccgccgccgcccgccgccggtgagagtgtgagtgctcaccggcgcgacgcgtcgaagaagatgagatgagacggcgcgagaaaggagatggcggatttatactgatgatggtgatgatggtgatgagagggagagagagagttaaaaggttaaaacggtatgatgatgacgtgggccgtgacgtacgacacagcgtgttcatagtttttcaggacaaattttgatttgatttccggtttttggagataaacctctgcagcgacgacaaccttagccttctagaaacaaaacattatatatacgtactccaaaacctataaatagatccccgtttgtttcttctatcagcagaggatataattttggatactcatgatacgcttttcaaactgctaaacggtgtgttttgtgtgaaaattttctatatgaaagttgctctaaaatatcatattaatctattttctaagtttgtaataattaaaactcaattaatcatacgttattaccacctcgtttttttgaaacacttaatctttattttatcttcatctttagaagattcaaacaccaccatatattctcccgctgcaaactctatattattttccttgcaaaggattgaaaatgaggatacaattatcccaaatatcacatacaattggtttttttattacaggaaagaagcaaacgtacacatatcaccgtacataaaatacctctaaacacatactcaaaataacgaattaacagcggcaacttagccttaataaaatcttattaaaagctcacgcatatgtttagcattggtagccaccagattttaaattttgatgggtctagtttatatactagtgacttaccgtaacatatgaacgtctccggtacatatcaattgcaactatagcactataagtaaaattgaactattatcacaggcaaggtttaagcgctactagcttgtagtagtagctcctgccttatttataccttttctataaaaaaaacgaattcctttttagtacctaaaaaaatattgtagtaccttaaagtgtttgatttttcttgcattacttaaagaggttctaattatgatgaaaaaaaataaaaaggttcgaataagctgtgtagtttgtctaacaacttccccttgaaaactaggataaggtcgtaactcaaagctggccatgtttccgtgtttatttgaaccacacgtatttgtaggaaaggatatgaatcatgtcactgcaccttaaacctcagcggctttaatttgcacttactatatgaattgcatacatagtaggaaaaacatataaagccatataaaccctgatcgaacaactttatttagttctaaatatcattttaatgatgcctcttttttgtactgaacaaaatgttcaataaagattcctttacacctaaaacaaaaatcaacaccgacacttatatatatataagtcgttttatcttctcaacaggcccccaccactactatactcatccaactaaaatgtagttgaaaaacacatgtacagtaaaaatgagttgtgcaacatatataatagttcaacaaaactgaggtccattccaattatagtccacaaaaatgcttttctctttcatgcattatagatgaaaatttgtatatatccctgcatctttttaatctttttaagtgggggcagattctgtttgtctcaaaatgaaagaaaaaaaaacaaagaagaaacttttgttccttaattattggagtcactgggtgtctctgatcttgatccccacttcccatgttaattgcttcccttgcttgtagggaagtgtgttgtccaattagaaagggaaagcatcagcaccttcattgatggataaggccaaattgtgcagatttttaatggctgctccactgctccttagcagccggccactgtccaacgagatcaggacacgtggcttaaaatcacaatcgacgcacgaccttcagtcacgtaatatcacacttcgcatttgttactttctattataagattttttgattttttttctaagttaaactttttataattcgattaagtacataacagacatagcaacatttttaaaaaattctattaaaatatatctagtgttagatttaatgattattattatagacgttgctagatttttctataaatttgatgaaacttataaaaggtttgaaataaaaagttaaaatgtcttataatataaatgtaaacggagggagtaggtagcctttcgcataaaaaaaacagtattatatataatggcactggataaccggttttctggtggagtttgtgcacccgtcgttttcgtgccgttagctgcaatcacatcatcactgatgcaactgccactgaatttctttttcataggcttccattcgaatctgcaggccaagagtttgcaatttcgttgagatttcggatagagggtttgaaacatgcaaatcacagggatctgtgtcacgaactgaaaacgcgcgtacgtgaacgctcgcgcaagctgaggtcgcgtgaatgctcacatgtgtaaagctatggctacttaagaatcgacagttgtatggcttcatacggtttcttaagctcgatatgagcatgcacataaggtcccacgtgtagaataaatttttgtgcttgctcaaattattttatatcaaagtaaaatcgcccgtacagtgagtatagtgagccgatacggccgactaattatttattttatcaaaataaaatcggcagtataatttgctcaaattatttatttgtgcttgctcaaattatcatctaatctaaataaaatcataatgagaattgtataatcggccgtatagtgagtatagtgagccgatacggccgactttttctacatgtacatttctacgtggtggaactgcggagttaggaaaagatagctaagttgttgttcacgtttcacttactcaatgcatgtgggatacccaatccatctaatatgtacactagtccaaaaggattttgtaagtatggataaaagtgcagacacaagatatggaccagagtattcttattacacaaaatcactcatatgctctctttatccagccaattcttatacgtacatggaaagtagggtgagattcaattattgtattgggctgatcttcatgggccaaaacccaagtttctcaacatgaacaacacgaatcgtatcatcatatattcatacattctcccgaagctagattttttttcccaaggcaaacaaacagacaaaaggcccatctgtttccttatatcttgttctttccctctcaaatcattttttatcatgtagggaaaaatataattaactgcaatattccccggctgctaagaacttattatatcatattttggaggatgatctggtgttgagtgcacggttgacactgacagtttgttgtaaccttcttcctgttttcaatagataatcttattgacgttttgacacaagttttgattattcatcttattcaaaaatttagtacaaataaaaatatataagttgtgcttaaagtatttttaatgataaatcaagtaaaaataataattacatactttttaaacaaaataaatggttaaaaagtgtgaaaaagtcaatgacgttatcattgaaaaccaagtaacatgtaagatcatctgcatggctagctctgatccagcagtgtactcaataaagcatcttaatatctgtccatatcagtgacgtctctttctgctcaagttcaataccaaagtattgcaatcttcacgtgtctccggacaactataggcgcaattttttttcgttttctttttgaagggaaaccatatatagatgcaaagcatgacgatgagagatcgatttggttgcttgacttcttgcaatattgatgtagtggatttggatttttcgatttaccccacaaattaatcatggtgaatgcatgcgtggaacaaaacttgagatcggcctttcagcgcgcaaatctttggttgatatatgtccatcgaaattgtccagagaggaaaatataaatataaattcttagctaaaataccaatgcgtgagacaacttgcagtttgtgtagctatctaatattttgtcaaaatattacatcatatatttaatttttcaacaatcaaataatttgttcaaattgtacaaatagtcttccttcttgccaaaaaacattctaaaaacaacgcaacacaaatattccccattcatatcgctatcagtccttgtagtagtattttaggtatgttctataccactgcaccgcatcgtacttcacctcccaacaaaacactttttcccctattttaccacccccaaataattactagctaggttacttagttcactatcaaatgatatttcttgcagtggtagtataatttgaaatctaaaatccagtgaaatgaaaaataaaattacatgccccttagtttagtagaacatctgtgacctagttatcgaatataaggaagaatctgttcttaatgaacactgtttatgaaaatttaggcaaacaaatataaataactactaaaaatttgataaattgacccttaacccgtaccaaaacaaatggcaaaaatgaaccgtcggctgatggtgctgagttataacatctcagcgtcaccgtttttggcactgagatccttgctgacctgttcggaactccacgtggaggggggggggtcatataattagagtattgcgcaataatttgtaaacaatgtactggtgttgcaatgttacgttcttttgctggtgtacggtgtaccctagaaccagggttcgaatccccatcaagtcaggcatttttgttcttttttttcttcaaatgttcaatctacgcgcatacaaataaatgattaataatggtctctgcttttgaaaaaaaatatatatacgatactgttcaatctacacgcgtatatattcaaatgttcaatctacgcgcatacatataaatgattaacgatggtctgcttttgaaaaagaaaatgtatacgatactaatcactctgttagccaccaaactgaaagaaaacataggccaatgaacaaaattaatggaaaaatattgttgctatgtcgagggctcgaacccataagtgctgcacacacgattgggcatcacaccaccaagctacgttcgcataatgaatttgatgttccttgcatcacaccaccaggctacgtttgtatcatgaatttgatgttcattttgtattaattagcttgtaaaggggtcagtgccaaatgcattggcgctgacacctagtccacgtggaattccggttagctcagcaaggatctcgacgccaaagatgatggcgctgagatgttatagctcagcgacgtcatcggggttggtattgtgccaacggttcatttttgtcattagattttggtatgggttattttcaaataatttcactaaagcggttaatttgtcaaaatttcggaaaaaaactacgtgtgagatcacccaaggtcaaatattatgtaaactacttgaaatgataggttaatttgtcaaaatttcagaaaaaaactacatgtgagatcatccagggtcaaatattatgtaaattacttgaattgatagcacgaaatatttagttggatagggtctcaataaaacaataaccattcaacctctcgttgccatatcaagtagcaaacatattatgaaaaccgaagcatcgagtagagagcataggagatattgataggactccgcgtgctagtcaatttcagcctgagacatgcccatcaagccacacaaaggtggtgaccagatggttacacatttcaagagacttgacaaattgttggaggtctataacatctcaaatgctctaaacttatactcatgtgaataaactagttcgtagaataagcactagtttcacattttcatttaagcaatgataaacagaaataaggcatgaatagaaattagaacccagattattacaagatgtaatttcctaagccgatcggccaaatatatataatgattcatggaagcttgtatacccattcccacaagcagctgactagaggtagacccataatgaatcaaatcctagaagaagcagtcgaatcccgaatcactcaattcaatttaaacctaatacctgcaatatatattatatacgagtgacaagagtcagtacatcaatcaaattaatatactggtaagcacaaatcaaacctaacattctatatgcaaagccataattcaatggaaggttgtctttagctcaattacagcacaaaggcaaattttggttcacaaacatttgtaaagagagttgacaattcaattcacaaaacatgaacataaatataacataatagtcatcataatatcatcatataatcattattgatgcctaaaccgacatcaagtctcacattcatcatcaatataccataaaccatataattcaacacaagttaccattttcaaacccatgtttcacaaacacaatttgaaaatataaatctataatattgacatttcactaagccgctcatgaccgcgagcatgactaaacgattagttttgagaactctgcatagtttgtacaactttacccacatgacatgaatcgttctagtttgaccggtttccgtcggtaccaccacactctacaccttgattgtggtctagaggtcataacatagccattacatcataggatttcatttgtacaatcggggaaaaagtaaatcaaagatccatctgctccaagcttcagaatatgcccttgcactagataagcctcatcaatacgcgaacgagcggctgagttaaaagcaatttggttgctaaccacccctagcccttttgctatccgagtaatcagagaagtgcactcctgtagcgcccgttccgtcgtggcgcctagcgggaaaattatctcttaaaaaccctaattgcgaaatttgtttccttgcttgttgtctagtgtccgtgccatctcaagatctcaatccccgatctatcgtcgagttcaattccgaatccaatccttccaaatcaaatccctccgcaaaagtctattttgcctcccccgaggtcgatgggccgaatcccgctcggcccatctctcccccggccccctctctcccgggcgccctcgctctctctctctctctctctctctctctctcgccctctcccctccccggcgcgctccgcttctccccccgctcagctccgctccgcctcgcccgcgtgccgcgcgcgcgagcgcgtgagccgcgccgcccgcgccgagccaagccctcctttccgctccctcgctgccgctccccgcgcgttgatcgcgcgcacgcccgcgtggtcctcgcccgcgtcgcgtctgcgccgcccggccccgctgccctgccgcgcctgcagccgctcggccccgcagccagcgcgcgtgccgagccgcgccgctccatccgccgcgcctcccgttgcaagccgcacgcgcgtgccgtggtggccgaccgcctggtcgccgccgtcgtcagcgtctgccgcgtctgtcgcccgtgtcgtcgcgccgctccaaaccgcctgccgtcatcgccgtcgtcaccgcccggcccccgccactccgcgcgcaagccgccaagggacggaggcaacgcccctcctctctctgccacgtcgcccccgctcccctcctcctttttcccaaatcggcaaaggggcaagccccctttctccccctccttttccccttttcctcctcgccggcgtcatcctccctgtcgccgctttggccgcgaccgccgagcgccagctcgcgcccttgaccgcgcaagtcggttcccaaaccgacattgccgcccatttaaaccccagcctccccttttgtcacaccccgaagttttcctcccaagccaaaattgtaatttataaatgatcccaagaaaatgcaggtgaaatcaggagaaaaccctaaggaagtaatgcaaataataatcggatttgacatgtggaatttttcttgagttctacatgtcgaaattcattaacaggatttttagtgaaattttcagagctctagaaataattttaaccaattaaaatggagcaggcaatattgttaattccagggaaaatcctttttcctttttctttttcttttccctcccttttcctccctttttttcgaatgggccgccggcccattcccctccttccttccctcctccttgctgggccggccgcaggacgaagcccacccaggccgccccgctgcctcctctctcggggtcgccgacaggtggggcccacctgtcgggcccgtctccctcctcccgccgatcccggcgcgccgccgcgcccgcaaccgtcgccgcgcccacgtctccgccttccccgggccacgtcgaccacgcccgcgcgtgcgccgcgtctcccgcgccctttcccctctctctcccgctcgcgcccgcgcccgagatggccgggattcgaaaatcgaatcccgcctctctctcctccccactccccacgtcggccggcgattcccgcctctcccggccacgtccggttctctctccccctatttaagcatcgccgtcgtcctctctcactttttccccatttcgccgacccctcccgagctcccattgctcccgcgccgtgcaaccacccgccgccgccgcttccgctactccggtcgccgctagccgccgctaggctcgccgccgcaccgcgccgtcgccgccgtcgggttcgcgtggccgagatccatcccgtccacccctctttcgtcgaggtccatcgccggagagccgttcccgtcgtgcgacggtgagggtcgccatgtccgccgccttcggccggcatccccgcctcctatggcccctctcttcctctctagtccctttcgtttcgttctttaggtcgtcccggtcgccgtccgccgcgtgtcgactgccctccgtcgctcctcgtcgccggacgccgtcgtccccttcggtgaggactccttccccttttctctacttcctcgattctccgtgcgtcgccgccgccgcgcttgccgtcgcctttggtcgttgccgccgtccactgccgccgctttcgcgtcgcttttgcgccgtcgcctccgcagccggatgccgtcgccggcaacgcgacgtgcgcgtgccgccgccgtcagccccgggtcggccggtcggctttgatgccgagccgagcccggcggctgcctccaccgccgccgtccgatcggcccgagggcgatctgggccgtcggtcccgtggaccggcggtggaccacccgcgtggtcccggtccacggtgaaccgctcacccttgagtcgctgaccagtgggccccgcatgtcggcgccgcgcccccccgtgctgacgtcagccctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatggttttgttccctgtttcagtagtcttatagcctgtttgcaatgtttgccttgtatgtcgctagattccggttcctccgacgctccggtgtacttcgagatagtcgccgaggtccctccagtagcagagcaaggcaagtcatgcttgtcacttgatcatattgatcctatattgcaaatgtcctaatgttttctttcaaataccgcatttgttttgcaatgttaatatgggatggttacctattgttacagccatgctattttgataccatgctcctttgttagcttgggttataacatgattagagttaggactagggtttgcttagccatgcttagttcaactagttcacaatggggaaaatcatattaatgtttagactgttagttctaatggtaatgttggtttagtgacaccgctttggtgttggttaattaaaatgaatcacatggtgggctgtgggtgcatggttttgctggtcgcacccatggcagttaaggaccggttcgcgggatgccctggaaaaatttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacaattgtacacctctgatcagagtaaaactattcgaatagccgcgcccgcggttatgggcggtcaaccagattcaccgtgattagactcacattagtttagtctaatgaatttggatggtataggggttggttgggcctgttgcaacgtggtgtagcgttggacagtggatgcttaatactgcttaattattacaactgttttcgcattcaactcctgtttataaatgccagtatttatgcaaatgaacctgcttagctatcccttgttgaatccatgcatcatacccccattccggtatgacttgctgagtacagtgggtagtactcagtcttgctctatttttcccccgatccccagagttcgagtttgggtcagatgaaggtttctccgaggaataggcttcgtccgtgccgtcgaggatgcctgtggagtggtgttcccgctgcagtttagtcaaggcttagctccagttatcttttgttttccgctgcatttctgtaagacttttatgatgtttgtaagacgtggatctgaatgtcaacattgtcgtttgtgtaccccggctggtcctggacggggattttaatgcacactctgcttggaattctattcgggaatttctgggcgtgacaagttggtatcagagccaggttgaccgtaggacaagccaaatggaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactattgggatttattcgtcagtcagttggggtttgatgggtgaaatgcattaggtcctagctcaggaacatgggttgcaaggtatttatgctttatttgttattattaatatgtatctaatttctcattattttatcgttatgtgagtctgtcttgtttattcgctctcatgcaaaatgatctatgcataaaaatttcgctcttattcctttcccttatttgagtcttttattgctttatttaaatttggatttgagcatgcattgatcctactcctttgtcttctctagatggccggtcacccacccaaccaccgcggagaaggcatgatcgactttgtggcagagctggcacgcatgacactggtggtgggctaccccaacgcgccagagtacacgacgattccgccgctcagtggcgagcttcctcaccgtgtccgcttggaggtccatggctacgtggggacttgcctcgctaacatggcggtcgaggcatgtggaggcacagcagatcatgcctgtcaggaggcagcctacttgatgatggccagactacgggagcgccacaactacatcttccacgacacggcgtaccgctaccacccccgtcgagccaacggtgatggcgtcagctccttccgtccgacagccggcgagaacgacaccacatttggtcacatgtgtgctgtgatgaggggattggacaggatgcactcggacctgcacaaggcgaccaaggccttgaacgatgggaagctcatgaggatcgtcgctctgaaggacgagatagcgcgcctgaagaaggagaacgctcagctaaagggtcttccagcgccaggaggagtccggatccgcactacgccccgcaagacgacgacggcacccgtgcgcatccagcttgcgcccaggaacccacctccaccagcagctcccgcagcacctccagttccgcccgcagctccggcagttcctgcagctccagctccagctccagctccagctcccgcgttcgctctctccttcgctccagcatcagccgccagaggtccagccagtggcaccggaggttggttgtctgctactcccagtggctcagagtcaggcagtggcgagacttatctgccaggttccaggagtcgctcagagggacctggtgacgagcaggaggacgccttcgactccaccgaccgcaggagccgttccgagcattaggctcgttttccattagtttatcgactgtctagcttttgcttgttagtttgtgtgtttaggttgcttgtttgggtcagtcgacggtcgatatcatgtgcctatgatatggctgtcttaataaggatttttgtttgctcttttaagtgttttaattcagatcagaacaattgcagtttaaattcctttgtaataaagcttagttcctgagcatctgtttttcttcttttcccccatctgcttttccctccagatggtctacaccaggactggtagccgcgcaacaggcgaggacagcaacggcgaagaacgcgctgatggtgtgcaccctagcagtgattccggcaatggtccgcccccgcttcccgagaatccgacgctagcccaagttatggcacatcagactcagatgatggcggccatgatgcagcagatgcagcagcagcaccagcagatgcaccagaggatgctgcagcacgccgaacagcagcaccagcagcttggtccccctccccctcagtccaagttgccagagtttctacgcgtcaggccacccaccttctccagcaccaccaaccctatggaggcaaatgactggctccatgcgatagagaagaagctgaatctcctgcagtgcaatgatcaggagaaggtcgctttcgccacgcaccagcttcagggtcctgcgtcagcttggtgggacaaccacatggccacccgcccaccgggtactgaagtcacatgggcagagttctgccgtagcttcaggaaggcacaggtgccagatggggtcgtggcgcaaaagaagagggaatttcgtgcactccatcagggcaaccggactgtgacagagtacctccacgagttcaatcgcctcgcgcgatatgcaccagaggatgtccgcaccgacgccgagaagcaggagaagttcatggcgggtctggatgatgagctgaccaaccaactgatatctggggactacgccgactttgagaggctagttgacaaggcaattcgtcaggaggaccaacgcaacaagatggacaggaagaggaaggccgctcagttcagggcacatcagggaagtcaccagaggccgcgcttcacttccggacagcagggtggacctaccaccatgatcgtccgccagcaccgcccgttcaaccctagcaacttcccccagggcgccagtggcagtcagaaccaccatggaggtcagcccaaccgcggtgcagctccacgcccaccaatggcaccggcacagtcaggccagcccgcgcaagccaagaaggagacgggagcaaaaccagggtcctgcttcaactgtggcgagcttggccatttcgctgacaaatgcccgaagcccaggcgtgccgggccaaggtttatccaggctcgtgtcaaccacgcatctgcggaggaggcacaagcagcaccagaggtcgtactgggtacgttccctgttaactcaatccctgcaacagtactttttgattctggtgcgacgcattctttcatttcaaagaaatttgtcgggatgcatgggttaattagagaggaacttagcacaccaatgcgggttcataccccaggaaatagctctacttcggttcaattcagcccttctataacaatagaaattcaaaggtcactatttctagccaacctcattcttctcgaatccaaagacctagatgtcattcttgggatggattggctgaccaagtttaagggggtcatcgattgtgcgaatcgcaccgtcaccttgaccaacgagaagagagaaaccgtggtgtacaaatctctagtctcgccaaagaaaggggtctcgttgaatcagattgagacggaaatcccagtggacaccgtagagaagaacttgagaaaattggaagatatacccataatctgcgagtatccagaagtgttccccgaagacctcactaccatgccacccaagagagagattgaattccggattgacttggcaccgggaactgctccaatctataagagaccgtacagaatggcggccaacgaattagcagaggttaagaagcaagttgatgagcagctgcagaaagggtacatacgaccaagcacttcaccttggggcgctccggtcatttttgtggagaaaaaggataagacgaagaggatgtgcgtcgattattgcgcacttaacgaggtcacaatcaagaataaatatcctttaccgcggatcgatgatttgtttgatcaactgaaaggagctagagtgttttctaagatagacctgcgatcaggctaccaccagttgagaattcgggaagaggatatcccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccgaagaagaacatgaacaacatctccgtctagtactcgagaagttgaaggaacaccagctatatgccaagttcagcaagtgtgacttctggttgacggaagtcaaatttctgggccatgtcattacagctcagggtgtggcagttgatccatcgaacgtggagtcagttaccaaatggaccccacctaagaccgtgtcgcagattcggagttttcttggacttgcgggttattaccgccgattcattgaaaatttctccaggatcgcccgacccatgactcagttgcttaagaaggatgagaagtttaaatggacagctgagtgcgataagagcttcgaggagctcaagcagaaattagtatccgcaccagttttgattctgcccgacccgatgaaagacttccaagtctattgtgatgcatcccatcacggacttggatgtgtcctaatgcaagagggcagagtggttgcgtatgcctcgcggcagttgcgtccacacgaaggaaattatcccactcatgacttggaattggcagcagtggttcatgctttgaagatctggaggcactatctgattggaaaccgctgcgaagtatatacggaccataagagtctgaaatacatcttcacccaaccggacctaaaccttcgacaacgaagatggttggagctaatcaaagactatgacatgagtattcactaccacccgggtaaagccaatgtggtggcagacgctttaagccggaaaagttactgcactgccctatgcgtcgagggcatgtgtgaggaattgcggcaggagtttgaacatctcaacgtgggaattgttgaacacgggttcgtagccgctctggaggcacggcctacgctcgtggatcaagttagagccgctcaagtaaatgatccggaaatagcagagctgaaaaagaacatgagagtcggaaaggctcgggatttccttgaggatgagcatggcacaatctggattggagaaagattgtgtgtacctgacgacaaggaattgaaggatctgatactcaccgaggctcattagacccagtactccattcacccaggcagcactaaaatgtatcaagacctcaaagaaaagttttggtgggtcagcatgaggagagaaatagcggaattcgtcgcactctgtgacgtttgccaacgagtgaaggcagagcaccaaagacccgcaggtttactccaacctcttcaaatcccggaatggaaatgggaggagattggaatggactttataacgggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagtatccgaccgaggtagtcagttcacctcaaagttttggcagaaactgcaggaagaaatggggacccgtttaaatttcagcacggcctatcacccgcaaactgatggtcagaccgagcgagtcaatcaaatcttggaagatatgttgagagcttgcgctcttgattttgttggagcttgggacaaaagcttgccatatgcagaattctcgtacaacaacagctaccaggccagtctacagatggcaccgtttgaagctttatacggccggaagtgccgcacacctctcttctgggatcagacaggcgaacgtcaactgttcggaacagaagtattagcggaagcagaagagaaagtcagaatcatcagggaaaggttgaggattgctcagtctcgacagaagagctacgcggataaccgtcgaagggagctcacttttgaggcaggagattacgtgtatcttcgtgtcactccgctccggggagtacaccattttcagacgaaaggcaagttggcaccacgcttcgtaggaccatacaaaattttggaacgaaggggagaagttgcttatcagctagaacttccatccaacatgatcggcatccatgacgtgttccatgtgtcccaattaaagaagtgcttaagggtacctgaagaacaggctgattcggagcacattgatatccaagaggacctaacatatgtggagaagccggttcgtatacttgataccagcgaaaggagaaccagaaacaaggtcacccggttttgccgagttcagtggagtcatcattcagaagaggaagcaacctgggaaagggaagatgagttgaaagccgcccatccgcacctcttcaccagctcctccgaatctcggggccgagattccgtttaaggggggtaggtttgtcacaccccgaagttttcctcccaagccaaaattgtaatttataaatgatcccaagaaaatgcaggtgaaatcaggagaaaaccctaaggaagtaatgcaaataataatcggatttgacatgtggaatttttcttgagttctacatgtcgaaattcattaacaggatttttagtgaaattttcagagctctagaaataattttaaccaattaaaatggagcaggcaatattgttaattccag

SEQ ID NO: 59708 - DNA, 1867 bp, Oryza sativa
catgcatgcgcaataaagtaggagatcaatctttgacttaaacaggaaactcggatactttttttttcttttctcaaaccaatctacaaactctaccgggatgaccgcaacaaaactaaccgatgagacaaccagatgcatacccaaaccaagatgaaactagggctaagaccagatcttgacacgacagtagaccaaaactcaataaagcaaaattgaatgaaaattgcaaggttcaaaactaatgtttggtgaaggaaaaagtgatgcagcaatttgtagataatgggtagggaaaataaatctataaaactaaaatcctcaccaggcaaccgatgctctgataccaactgatgacgctctctctcgtggcccgatgttctggtgaggggataactctcactttgatcgagtgcgacgtttgcgacgtggctaccaaccagaacaagtccaggacgccgtgcaatcgctacaccacaaaagatgtcgcgcgcggttgatgatccctacaatgcaaacgagagaacactgcaagaacaagataagatgcaatctaaatattgcgaataggtaattaagcacaaagaaatagttgcgattgaagtggtagatctaatcgacccggcaaataacacaccaactattggggcctctgaatctatagtcgccaactaatcgagcgaggactagagacaaggtgaatggcagttggcaaaattcaactaaacaaaacccaattgtttttgagaatgtacaaagctatttatagaggaaaataaagctagggttaagtgctaattcgtggaggtggagggagacacttccgagatgggtctagtctattacaaggcccaaggcccaagttcggtttcagcaatagcactatcttattttggcgattcccgttgactcgagatgaatttgaacatgagaccggatgcgtttgtaagatagcgagataagctttccacgaagtccaagatcacccaaatcggagttggcataaaggcgttaggtctgtttgaactcagtgctatctccggaggccgaactggacttggacttggaattatcattggaacgtgtgaagttatgtgcgtatccgacgaagtgatgtcctcatcagcctctatcctcttgctcccgccgtctccaaggaagctctcagtgtcatgccatcctttgcaagatggcacaatcgtctcggtcatccatctacctccattgttgcaagaataattagccacaataagttaccttgtcattccgagtctagaaatgagtcggtttgtgatgcttgacaaaaagctaaaagtcatcaattaccctattcaaggtcatctagtgtgtctagtcatcctttggaactagtcttttctgatgtttggggtcctgcccctgattttgttggtaataagaagtattacgttagctttattgatgactacagcaaatttacttcggtttattttcttaagcacaagtcagaagtatttcagaagtttcatgaatatcaagctcttgttgaacgactcactggtcaaaaaatcattgctatgcaaaccaactggggtggagaatatgaaaaactccatccattatttgaaaaaattggcatatcttatcatgtgtcttgtccccatacacatcaacaaaatggatcaacagagcgtaagcatcaccatgtaatagaagttgggcttgcactcctagccaatgcttatatgcctcttaagttttgggataaagcattcctcactgccgcttatctcataaataggacacctagcaaggcgatcaaccttgaaatgccactagagctcctatttcaccaaacacccaattatcaattccttcgaatttttgg

SEQ ID NO: 59709 - DNA, 4626 bp, Oryza sativa
  unsure (1)..(4626): unsure at all n locations
gagtggtgttcccgctgcagtttagtcaaggcttagctccagttatcttttgttttccgctgcatttctgtaagactttcatgatgtttgtaagacgtggatctgaatgtcaacattgttgtttgtgtaccccggctggtcctggacggggattttaatgcacagtctgcttggaattctattcgggaatttctgggcgtgacacctttcccttcctcttcctttcgtctccgcgccattgccgccgcccccgtgctctgtctcgcctccgccgtccttcgccgagcgccgggagagccggtgcgttcgaggacgcggaaggggacttcggccgcgccctcttcttcctcttccccggcccgaggccggagagattactcccgcgccgtcggcctctcgtcacagcgccccgtcccgcacggtagtgcctccctccgttcttcctcctcgctccatcttccccccttagatttcggtagtagctcgagtagcctccccgtagttagccggcgccgccgcgaccgttgccgtcgctcgccgtgtgctcgccgccgtcgccgctcgagctccgtagcacctgcacgtcgccagcctcgctcggcgtagctccgtccaatccgacgctagcgtcgagttcccgaagccgcgtagatgctctcaccgccgggaatcgacccctcgtggcctcgtcgccgtttccctcttccctccccgccggttgtcgccgcgcgattcgccgccgtnnngnctgtccggtgaatccgagccgttggctcgtctcccctcatcacgaacaactgcccggtgtgctcgcttttgcccgtatcgccgtggttcactccgccgctcgccgccgccgcccgccgtccattcgcgaccgggtcgtcgtctacctcccgccagcccacgtggccgccacgtaggcgccacgtcggcgccagctcagcctagaccggtcgagctgaccccggtcagtccctccccgtgcgcgcgttccaccgcgagccgtgaggctgcgcgtgggcccgccgcatccgcgtccaccgcgagccgcgcgcgtgcaccgcgtccctcccccgcccgcgcgcatgagccgcgtactccctccgcacggtgagccgagccgctgacaagcgggtcccacccggggccgcgcgtggtgagcccggtccaccggactctctctctccttcctccgcgcgcgcgcgtcttgggccgctctgggccgccttcttgggccggccggcccgtttagatcggccggtccgctccaattcccttgggccgcgccttagccgcccgaggaaaagtctaatttccatccctcttttctttcttttcttttctttttcaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagatccacagcgcgaggatttcgaggatcaagctccagatctcgagcaaggcaagccacctttgaacatcttgagcctatatttgaaatttaattatattgcttgcaaaatattatgcattgataggatcgcacttaatctgtttgtcccgtctgcaaggcagattggcggacctacctaatttgtcgcatttgattcttcctttgttaattgctataccatgtccccttgtaaccacccagttacgcctcgatattcgtgcactctgtgcgagtatcgacggtcgccttcaaacttaaaaattcgtttaacaacttgggtaaaacttgggttttacaaaagacttggaaaacccgacacctgggtcggtgcttgtgaactaaatgaatttccaaaaccgcggaccggggaacgtaccgggtgtacggtttcccgctcttgcacctaaggaccgtttccttggaatttcatccaaacataagataagtacgaccacatgggtggaataggacacccctggctgagtaactagcttatcaggggagccatgatgccgagagacatgtggattcgccggggcggtgtcggagaggacccccctgggcttcctggcacagtatggtttgggacctaacctgttgttggtctgggaccccactcgtcggcatatggtaaacttgtgtcggctttggaaatgccttgtcatgaaagcttggaggtctcccgacgtggctgatccccacgggctgagtgatccgggttagtaatgtcgtgtgggtaaagtgtaccccctctacagaggttaacaaactgttcgaacagccgtgcccacggtcatgggcggatgtgaggtgattcctagcgtagttttgtttgactactgcttgtgaaattgctattgtgaaaagaggttcgatgtttgaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagacgcactgtctcatccgtgtcgtttgagaaacactcacttagttgtttttagaaaagagttcaaataaaaccaattgcaaaaacaacagcctttccttgaagcctgcattaaacacttatttcccctggcttgctgagtactcccgtactcacccttgctctatataaataatcccccccccagttgctgaagaagatgaagcggatcctgctgatgaggagtttttccaggagcaagccggctatgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgatattctgtctccctgtgataccagcactgtttcctgggactggtatcgattaacaggttaatttggagcgtcacgggctagttccggtcgggactagttcggggcgtgacaactccacaggagcagagaactttatactttctaaccattgccttatcatacatttcacaggagcaattttgatctttctaaccatggcaaacatgataatcaattcatctcccctaatgagtctcagatcatctctaggaaacaaagtcatagcaatctatttgtgcatgagcctaagtgtaggattatggatatcattcgttctaggtttcttgcatattggagcaccagaaatgtcttcccaaaatctatttttctcgaacccagaaattcctttctggagatcgattttacaggaatcttgaaaaccaagaagtgtacttaagcctttccatgtaagtgtgaactcctcacggaaaaagcgaaaggaaataccatcttctatttctttcaaagtgcacaaaaattgtaaagtaagcaaacgagaaccaggctcatctaccacatcaaatctctgccaaccaacagctttccaaatagaacgaaattcaacatccatacctatcttttttagtaggtctggtgagtattctcgcgtgtgagcatactcccggtcgctcagcatgtagtaggcttgtctctcccgatcactgacaaggtcgaggtcggtgtcgttcaggagtcatcgcggagcttcggcgtcttccatcgagacatcagctgatgaacgagtactagactcgtcatgatgacttgatgaagagccggaccccttgaatagacgagacaatcgcctcctcattctgcacaatggagcaagaacggactaactcggcgggggttaggaatgacaagaatttcactaggctgtccgttttgggtggctccacttcgacctcttgaatattctatgggttcggcccgtactttattctgaccatggagcattgttccgttctcggttgaaactcaaacttctcttccttgccgttgatgtggaaacggatactccccgttcccacgtcaatgttggctcctacggtgctaaggaacggacgctccaggatgagcggcgtctcttttcccgtgtccatgtccagcaccacgaagtctaccgggataaagaaatcctgtatcttgattggcacatcctccgctatccctgccgggtaacggactgacgagtcagccagatgaaggcgcatcagtgttggtgccaacaccgtgaagttgagcttgtcgaagacgtcttttggcatgacgctgacactggctcgaaggtcgcacaaggcctggtcgaactgttgtgccccgatcgagctggtgatcgtaggacaccctggatctttcttcttctccgggagcttgtggagtatcaggttgctgcatttttccgtcagcttgaccacatccgttgttgggagcggtttcttgttgttgagtatgtccttgagataacgggcgtatgttggcacttgcgtagcgtccaacaatggcacgttgatgtggatcttttggattac

SEQ ID NO: 59710 - DNA, 568 bp, Oryza sativa
  unsure (1)..(568): unsure at all n locations
atatgtagatctttattttatacaacttttgcaatttgaaccacattaaactgagttacaatgaattagttatgaattttcaaagattaaatcggattaaaacacttgtgtggattttaattgaattatgacgcaataaagaattatttttgaaaaggaaaagggaattattgcgtcatcaaagcggtnccaggtgcacggggcggtctaagaaaacgaacggccgtgatcgattctatccaaacggggcggccgagatcactttgatctaccgcggttcacggacaagccgacgatgacgtcagcggtgacgtcagcgatgacgtcatcaccggcgacggctcggcctcgcgcgctcgccagcgaacgacggcgcaacgacgcaaacggaggacaccaacgggtagaggacaacacggcgaactcaccggtgaccaaaaccacggcggaagagcaacggacggcgccggcgacgaggaagaagcggcgacggtcttcgggtcgacggtgacggcggtgctccggcggtcttctgcggcggcgaagaggtggacggggacggtgacga

SEQ ID NO: 59711 - DNA, 526 bp, Oryza sativa
cccgatttcgccggccgacgtggggaggtggaggtggagagagaggtgggatttgaatttcgaatcccggccgtctcgggtgcgggcacgggcgagagggatggggagtgggtgcgggagacgcggcgcatgcgcgggcgtggccgacgtggcccggaggaggcgggagcgtggatgcggcggcggttgcgggcgcggtggcggtggctggaggttgggggaggacccgacaggtaggccccacctgtcagtgaccccgggagagagagggaggccgccggctcagctgggcctcggcctgtcggccggcccagcgggagaaaggggtgggaagagagaatgggccggcgacctattccgaaaagaaaaaggagggaaaaagaaagaaaaaggaggaaaagaattttccagggaattaaatattgcatgtgctcaattttaattggtaaaattatttctagggctctgaaaattcaactaaaaatcttgttagcaaatttcgacatgtagaactcaagaaaaattc

SEQ ID NO: 59712 - DNA, 632 bp, Oryza sativa
ttatcataccgatcatatcaattccccaacctctgaacggccacggcttaataataggattcatagccgacgccggtgcttgctgaatagctgcgacaatggagttgcagttctgatggttcagttggtagcttattttgggtggatggagcctccaaagaagcctacaaaaaatttggtgattgtatcgtcttcgacacaacatactgcaccaataggtataaccttccttttgctccaatcattggtgtaagcaaccatggccaaactgtgttgtttgggtgtgtattcttaaaagatgaaaaagttcagacttttgaatgggtgttcgaaaccttcttgagagtaatggatggaaaagtgccacaatgcatcatgactgatcaggacaaagcaatggagactgcaattgcaaaaatactaccaaataccgttcataggcgctgtatgtggcacttgcacaggaatgctagctcaaaccttggtgtgctattgaaccagaaagaggggtttgaatttgatttgaagtcatgtattgagacctcgttgaatgaacaagaatttgatgaaagttgggatgctatgatcaatagatatgagttgcaggggaacaaatacatgcagcacctata

SEQ ID NO: 59713 - DNA, 891 bp, Oryza sativa
tttgtaacaatcagaaatcacaatgaatcagtgcagtcaatcatgatatggaagaaaataatctcattgtaaaccagagcctgtgcacctaacaagaagtatagtagtaggcgatataagatccacttggcaattttttgatgagcaatctaagagaggggacgagagagacgagaagcgggtgactaattagttgctagcctccacgctcatccactgcactcttcgcatccgtccaccgccgtcatcctcatttatcatttagtcgcggctatcatcgatgccctctgctgccaccgccgtggtcctcgtccacctcggctacggtcctcatccaaggctgccgctgccgccatcgtgttcgtcgctacagcttgtccactatgctcgccacgtcgcgtccgccgccgttgccctcatccatcaggcgccgccatcgccataaccctgttccgctgcagctccgtcctcatccaccctagccgccgcgagcgctgccatcgtccaacgcatccgtgtgcagtcatcgtcgttctgaagagaagagatgagtagaagagatggtactatttgtgttcatagtactatttgtgttatattatttattcatacttttgacattagatacgctatttattatttcttatagatgacagatattttctgaactaacaacatgctctcttattgaccttgctatgaaggtccgagagttggtgccattatgctaacaagatcactgccaaatcggtgtcatagtgcagccttgcctctatcccaattcacagaggaaaatttactatttgctatcctcctaaaatacacatggccaaatatcactctcctaaatttttattcccaaatacacgtgtactagcttcgatggagtac

SEQ ID NO: 59714 - DNA, 54439 bp, Oryza sativa
atcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataatattgtatagctctaggatcgtgtttacaaaatagctttgggcaactaagtgacttttaaatgctgtttactgcaaaacttaacccctattattatccccttgtacccccttgcattaattatgcatctctggtgtggcttgctgagtactgtggttgtactcattcttgctctatctttctccccccttcagtaagagaacctttggagaagaagtcttaggtggagtcttggcttataccccagttgagcgcctgtgaagatggagccgtaggcccgctagtccgctgctgtttatttttgattgccaggcctgaaatgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacatttttgttcgagtttcttctcaaactttgtgattatgggtttgaggctttatatagcagcaatagcatatcgccaaaggtagatttaatgtatgacaagtagggccttggccccagtaaaatcctatcttactataaagttatcccccactaactccttgagcttgacatgcaaagatgccacatcatcatccactaacaagatgccacatcatcatccactaattaacaagatgtcacatcatcatccactaacaatcatcacatttaaacattatgcaaacatgctatatctttagagtttttataatttaagagcttttcaaatacaaacatgttaaattatcatccaacataattcacataatgtttcaatgtacatctttattatgttttatgatatcctatatacttttatagttcatcctcacttagttagtacttaaatgattaatctatggtccaaattatctttctcctttttttcatctaattaattcatatcacatcacctgtttttagcctttagatgattaatctacagtccaaactatctccctacttttcttcttccataaagtcataccagcttactttttatgtttgaatcaccattctacatactatttaaatttaaattatcataaaccacattaatttatttaatctgatgttatctagctatcttacacgttatttttttattattatcatactaaattcccgcagcaatgcgcggggtttcacctagttttactttgtattgtacccccacgtgtgtccatcatatacttactccggtttagctaacacatcacccccactcctcgggtacttttcttttcttcgcgagcttcgtccttcacgtcggtgattcagcactgcgcatccactctaatcttctctccaattgaaatgggaattagttaaccaaattaagagaggtgaaattataccctacctaaatttgaggatctcaattcccaaatcctcatagcaaacaaagtgaaaagtaaaaggatattcatgtcgcctagagatagggtgaatatgcattcctaaaagcactcgcaactgaatatacactcccgtcagagtatctgaccacaaacactagatactccgatcaacatgttctgattgacaaatttggtcaactggatagtctggctaagtaccagatattccgatcccctaacaacacctcctaaggagcttgtgtcgagaacaatctcacacaatgatttgtgaaggttttccctcaacaccacaagggaagaggtaattgagtgtaaactgagctagattgttacatcttggtggttgcttagaggctaaagtttcttgttggtttgctagcttggtgagatctacaatcgaaagagatctggcttggctccttggagtgttctaccacaagcgatgacaaatcagagatttaggaacccaatgagaaacatactaattaatgtcttatgtactgatgtttgtgatgcagaagtattatcgttctaccctcatagatttcttttttgctatataaatatgatcagaaatttgaatgccgatagcatgtatcattatactctttcataccagaagaaaccagatcttctaatttttatgtacttcaatttagaacttgtttggcaagactccaactctagctctacctcttctagaactggagcccaactaaaaaaagagagtggactggactagaatgatctgaaaaagaactagagaggtggagcaaggtctgggacgttccacaactcaactccaaactccgctccaagagttagattgaggagttagagctctcccaaacatgtccttaattggtctatcagatatattcagaattagggaggtatgaaaaaagaggttacgattttgcaacttccatttgaattttttttaaatctttacattctttaatcctttcattttaggtactgttcctgcttgatgggaggatttagattgaaacatgtgtaaactccctctattttcttaatagatggcattgttgactttaacatgatatttgaccatttgtcttattaaaataatatgtctcatttttttcttttataacttgttttctcatttaaaaaaactttaagtatggcttatattttttaaatttataatatgtttttaattaagacgaatggtcaaacattataccgatagtccattgcgtcatctatttaaaacggaggtggtaacatgaaccaacctaccagcccttattatgctatttctagctcttttaacagcatttaggatagctacatgcagttctattcatatgctataagatctatgcaaaaatattttccttccaggtcattcatgttttggctaggtttgggtatccgtgaagcactggttgttttctatttctatgtttgaaagcactatttaacggatctcctaagatttgttttgacaaaaaaaacaacaagagggcaaactttacaagagagattacataatttgaatttacaagaagtttatgctaaagtgtgtgtccatattgccaaatgggtatgtgttccttctttaccatgaacatatgcagggtaaaataattcctgaagttggtcttccataggttccatgaaggatttacatagttaaaatttttattatccatatgttccaagtgacgatgacatgacttcaataaaaagggctttccaaactaatttgctgcaagtacaatcatattaataaagttcatatgcaaagtcacaggtgaaaaaaagatgcatcacatcctccagggcagcactatacattgcataatacacactctggtcctccttggacgttgtattgtcttcttttcaacatatctctagtgtttaatctatccattaaaagaatatagagaaatacctttagattcattgtacattttcttttccatatcaattttatcggcagaggtggttgcaagtgttcataaaaaagattgtaaacttttttggtgctatactgaccagtgaccagtactccatatattgtgttctgagattattgtatcttgaattgtactttccatttattgaagctgttgtaaagactaaactgataaaggaagagtgaaattgtcgtctatgtttgcacttagaaaaaaaatcccttgttgattgatcttcatttctaacaaaaccaaaagatcagggaatttttcttccaacatatgaccattcctgttgtctttctagcaaactattgtatccctattccgaatgttattttcgatatagctctatagagtggcaataatcagaagatgtctttccgccaaaggaacctttttcagagcaagcatgcggaggttgctgagattggtagttttctgtccaaactaacttgacccagcgaagatctcttctattataaagtttatccagttatttcatgagcagcgctatattatggtgttccaaattaatgattcttaacttcccttttgtttaggttttttaccctatcctaagctgccaaagaaccactccctccgtcctaaaaataaaccaatctaagatgtgatatgatattacatagtacaattaatctggacatgctatcctagattcatttatttttgaatggagggaatagacttgagttgcataccattttctcggtaaacaacacctccttgctctgtctttatgttacatgatttttttggaaccttcaatgtacacatgtggtaggttggtaatgatgaaaaaaatagaattaccactgttaactttgaccatgtgataaataaatttctatggaagatagcctcctgtcagttctatctataagtggaccacagtcaacaactctggactttgttgtgcaacccagaattcctgctatatgatttattgaaattaattttaaggcctgttgactggacatgagtatgaagaagggacttaagaagaaaaaaaagcttatttttaatatacttttgttataataatagtatcatctacacattgaataactggaaaataaccatcttctcctaagattgttgtgcaggttcaatggtcaatgtacttctttccgaagcttctattcttttgagcgctaatggtgtagagtaatagcggttgaggtaggggagtttccccgtaggatctgatgtcaaggtctctgcacatcacccgtgagccatctctgtgcttccttgaggttgccactgccacggacgaaggcagaaaaatctcaagcctagggctggtctgattggacttaagtattttcacaaatcgtgtggtattttcacatgatttgcatggaatttcagagctaggtctagggctcaatctttaagcccacccccagaattttaaattaagttgtgtattcaaaataaaaaatgggtcaaaagtatgatatttggcatgtataatattacatagtattgatggtataatacatagcatacgtattatgtgttggatacaacctcttgggttaaatacaacaactcattttttatacgcacgcatcacatattatatatatatatatatatatatattgtaattaaaaatatgggtattcatcctaatacccttgaattgtgttggggcctcccccgagcagcagaggccaaggaggtgagggatgtctgtcgcattatttgtgtttatatgctctcggctcacaatgttctcttacatgggccttatccaatgacatgggcagccttcaactgatctgagttacaccctcacagagaagcactaactgatatttgtgatggcaatgacatccacctccctcaactgcctttcacatcgcaaagatgtcctcacaacacaactttaaagcaaaactggcaacaaagaacaacaatgacccgaattgtttgaatattcttttgcactatatttgaaaaaaattaggtactaaatatatttattgtaatttttgttttcctgttgtaacgcacagacattgtgctagtaataaataattcttggtaaattatatgatatatagatggtacagattgtaatatctttgaatacattcagagatatgccaaattatgtgacgcgtggaatggatggtacagattgtttcgacaagatgtgttttattaatgatttattcaaagatatatgacttgtttattgatttgcctggctagattaagccaaattctgatgatgtttttctgatggcgaactcaaacggcgtgtctgaagtggtcttgagaaatgaaagtgacgttttcctggggcagccgtccacttttaccctttactgtgtgatgctacaatggcagaagcgttggcatgtccttgagctatgcagttagcatctgaattgggtgtttcaaaatcaatccttgagaccaaacagtctggaggttcagaagatggtagctgatgagaaagtcagcagatcaatatatgtagtaataatccaagatttgaagcaacggctaagtttgcttcatgatttcaggatcaaatggatttgtcggtcagccaatatggcgtcccattttttagcaaagaaatagtgtgctacgaatttacttcgacctatttctctgtctcaccagagtgtttaaggtcccagattgttaaaaactgtaatcaaaccggttccgctgaaaggaaaaaaaaaaagaaacctaagctgtgatgatgcatgaacatcacttagagttagatttgaaatctatttgctgtttgattcactaaatctttttaaataaatatcaaaccttaaagagtaacgtaattgatttgatattaattttggcacagattttgtgaattgcggccatgaatttcagacctgaggctaaaatccatcaaatcctccaaaacatcatttcacaatatactgatgcacacatggcacatcaccagtagtttcagtgctactttaattgcaacatgtataggcgtctctatgatgaacaagatataaagttgcagacccatttttttcattgtcaactatgatgtctgttaagtcaggtattctccgaaaacttgagataaaaacgacatagatatgcttcgtatacatacacatgattgcatattgatcaatcccctatggaacttgatgaattacatatccatttaagtagctaccgtttgaggcgcctcaacactatcaggaaagtatcaaggcagagtgtgtagtcatcgaaggcacttattccacaaaatttaccacgagtcaaaactaatttgtcccctccaatttgaagcctatcaaaggagcaagcgttggaaacctttacaccatggccaaagttcttgtgtgcctgccaatgtacaacaagtgtcaaaaggatttaacacaatcaattaatggccaataatgttgcgagattagttaaaaggcacagtagtatatttatatatactgtaccatataataaaactatgcgaaaactataaagtattccccacctccccacttttttccaatctgtaaggatattcaagaaacagaacaaaattagtgatagtttccggatggcttaagtggataacatagtaattagcaattaccattttattcacttcaatttccatttccatttaccaccttattaacaccacgtgcgatgcatgtacatgcttaagactgactagtgagtgtcaactatggtcattgccaccaaattattgggacataacagtaaacaatggttcaaaaagagcatgagctgaagggaagatctaagtcagatggtaacaattgatgagtttagaacagatgaagcatgaggaatcctgctttgtttggcctatttgatgcatatccaactgacaacgggtaaggatcagggtagagcaatgttgagcacttttgttctacatctgtacaaactatgaatgaattcaacatacatcaactgccctcatcactatataccatcaaaatacgagcgcatttctctatgaaaattctgtactacagcttaagttcatgatcaaacatcaaatattcaagcatgaaacaatcaacatccgcataaagaaaagaaaataacaaatagcaataagtatggactaagaaaatggagtacatgggaatcaatgataactaatttcaagctgtaatgttgcaagatgctttcaaactaaattaaacttacaaacgatatgcccactattttagcatcggagttgctcatttgttgtgcaatttgataggcacaagataaactgcctgatagaactcctctgataaccccattctaggtctaggagtgccaaagaaccatatagatcttcatattacatagctaagatcaaccaagtggaaagtgcacaacagtaaacatcatattacgtagttactgacaaccaatgaaccagaacctgtcagcccataccttagaatgtatgaacaatttttcatatttcaaactactgtactctagaatttcattaatctgataggaaatgaagagggtggcattcagtcaagtctcgtgatgttaagtggaaaaaaattgctagatactacagcataccattgtgatttccagcatgactaaccaagaggtcaaaagttcccttgagaaaatacaattccttagttcactaattaaactcgacagagagttaaatgcgggtacaagaagtgaacaagatagaaaacaaccttcctacaaattgagttatttaggttctcttaagacaatggcaccaatagcaaccactggagcaatttttatcaaatatgaaatatctacttgcctaatcatatgacgacaagttaaattacagatgaaatacaaaagacttacttgccaaggctttatcattgccatatttgggttattggtttgaattggtaaggcatcgatacataaactctcagtacgaaattcaggtgagaaggcaagacaagtagacaactcaaactccatatggtaattgtataaaccaagcaaaggatttcaagaaaaaaaacaaaaatgtttgattgatctagccatgaatattacagaagactctggagaacaacggtgtttcttcaaaatcagtaatcaataccagatattatcaatgagactcagcatagaatgccatgaaaacttcatccttgaaaatacaaacaaacaggatgactgttgataaagatgtcggtgtaacagcaaaaaatttcatgatcagatcattagaataaagtaggataactttggttctgtttattctacacaaactggaagctgctaattgtaaaagagttgttattactcattctgcagccaactggtatgtccaacatcattgtgcgtgcttggcaccaaatataattagtgtgtccagcatgcaaatctccccaaaaaggtaaaatagttcttttgccccatagtttagtgtttgctcatttgccagtttccacattcccagtgaatgacaaccagaactagggaccacatgtcatacacacatatggggcaaaagagcaaatgccatcaacttattgtgggacagaagagcaaatctccccttggaaaattggtttaccagccacaacggcaactgatattaagatggtcccagtccagaagggaaaaaaaaaagtcttgcatggtgcaccattcgtcgaaacaatgtttaggtatcaactcaataatctcattgcgtagcataactacaaataatgggatgttttacttctggtgcgccattcatcaaacaatgtttacgcagcataacaaaatagaccaatattctagtggagcgcttagcttgcttgacatacatagctcctaaagcgtaataagagttaaacaaaagtaggatataaaacttaaaagcacggttgcataagaaagtaaagaaactcatgacacagggcaaaaaaggttgcaaatcactaaataaataaataatgcgtgtatattgctacagaaaaactatgtgcacagaaagttgaatcgcacctagctcctctggacatattactgtgctgttgcctcaaatttccggagcatgtcgcagtgcggcgtctcgtaggaaagcccccagtggcgacgctgcacctcaaccctacaattctgtgagagtattgagaagtaatcccgctcaacatgccgttcgagtgttgcacgctcagtgctctggtgtggatactgctcctcaaagttaggcaacttgacatagtatgtgactccacgtgtggtttggaatttgtgctcataagggtaagagcgggacagcgagtagaccggttcagaagatggcaggaagttgagcaacagcagcaatagaacaggcaacagctgaataagcatccggagagtggagccaccggaattttgcgccccatggccatggtgcatgccgccagtcctgaaatgaaacgtcccaaactgcccaaactgtctggtggtggcaggcgccatcccgccaaagaagaagtttctgaatatctcatccggatcaaattcatcctcataaaacccattatacgcacgggcagtggaggcagccctcctgttgtaagtcaccggctcgtccgagccaacaaggtcatagcgcttgcggctctcggcatcgctgaggcactggaaggccttggagacggccttgaacgcatcctcggcaccgggggccttgttcttgtcgggatgcaccttgagggagagcttgcggtaggccttgcgcacgtcctccacagtgcagtccttctcgaggccgaggatctggtagtagtccctggtgtgcttcttgacctggcgcacaacctccagctgctcagacgtgtatgacctctcaccggcgctctcgtcctcctccttcttcttacccttctgcttcctctctctcagaccatcgctcccggttgcttcctccgcggatgctgccgctgctgacgaccgaggtggcggcggcggcggggcctgtggggacgacgacgaggcggaggacgagggcgggtcgtcctggttgaggagaggatcgagcaggtggtcgatggggagggaggggtcgaggcgcttggccttggagaggaacttgacggcgcgggcgctgtcgccggcgtccgccgcggccttcccgatgcggaggcacttgaccgcgtcgtccttgttgccctccatggcgcctccccccgcgcagccgccgcagatctggccgcgcgacggcgagtcaccccctcctcctcctcctccgtgcgatggaccccgatcggatcggctccgcccccaaatccaatctgagaagcgatcgattcgcacaacaaggtggggggaatcagattccgatttccgaacgagccgtggaaatcggccgcatcggatgattgggaggcgcgaccgtgttgggagatgcttacctcgccggagttggagcggagaccggatcggcgtcggcgtcggcggcggcggcgagtcgccgtgggaggggaggaagaagagaggaggggggggagatgtgatgagacggcgacgcgacgaccaccgcgggcggagtcgatatttcccacgactccgtctcgctttgcttcactttcctcaattttctcaggattccttttttttttttttagttttccctctgtttgttcgttctctctgcgagactgcaaatacgcgtgaagaaaagggtgtgggcctgtggtaattgggccaattagaaacctatgtgaggccgtttgtgggtaattagtttaggtttaggaaaccgtaatgatggctccatcgtttgcatatttgcaaacgagtactccaaccatcccaaaaataggtaaacattggtttccgtgtcgatctttgactgtccgtcttatataaaaattttttataattcgtattttcattgttgtgagatgataaaacatgattaatattttatgcgtgacttgtcttttttatttttttttcataatttttttaaataagacggaaggtcaaacgttgggcatggaaaccagggtttctcttttttttgggatggagggagtaataatttgtgaataaaaattttatttgtgtgttcctagcgatcttaaaaaataaagtttaaaaaaaattcaaaatcaactctgaatttaaggttgaaattttaaattttggttgataagtataagtataagagaaaagatgaggcctatagtttcccagttgcttaaaaaaaattctcactcaactcaattggtaaccgtgagaagcacgcggtcacgtaaaaatttttatttccgtcaatagagatatgttatgtgacgatgtatatatgagtacgatgttaatagcctaaaagctcaaagtttagaggagtgacttaaattaaattaaagctaccttgaaataaccatgataccatcgaagattcaaatgggaatattgtgggatactcctattttggtgacaaggatgaagaaaaacaagtggtatcaaaagacactgaaaaacaattggatatatgccaaacgcatgggaaaatgagtgttgaattgtgtcagaattataaatgcgaacacctaaaacttaatctagatcgtaagacaacttatggcctgtttggattggggccaattcttgccctacctatcatttgatagttttgaatagtactagtaatcgtgcacgtgcaatgcacgtctatgttaaaattattggtccaattccactaataagtgaaaaacaatatatttattctaaaccactgatattaacatgaaacttaagtgacaaataatcaaaagccatctgtagtccttttgttatccactgcatttcaaacaaaataaataaaaaatacaaaagcttcacttctcactacatttataacaaagttttacaggtgccatcacaagttaaacttttgcaactaatttggtctaaaataagcaactatagaaccatactctcaccgtaacaatatgcaacctggagattaaaaacaataatccaattaagctaatcaacctgacagactgtcacttctgtcacttctgtccaaggatgaatatctcaatactatacaatcaccactattttttcctttcaaaaaaaaatcacccctattttgcatctgatatacggataagcaaaacattgtggccttgatcggcagcaatggctgctgccgcagctgccctataggtgtaaataccatgtgaaagaagacatgcatagcactcttatgtcacttggccatataaagttttcaactccacaattatatatatacatccctcctgtcctcaacataccagagcacagcagaggtgcatatgaatccatccagattatatatagagaaacaaaccctcttgtaatcaagccgaatttgaagagaaaatgtataacatatgcatacattaattcctttaatatccaaactgaaaattaagaatcaatagtatcagccatggaaaagaactgagttagatcacaaaatcttctgacgaaactaaagatattgaagccaattttctatcaaccactaattgcatgcacaattgagttgtttatatattcatacaacacaaaattgtaaagtgccaacccgaagaagtacatctcgatgtgtcatgcacctatgtttaactgcatgtccatgcatgaaagtcaaggaactccagtagaaagtgatgtttctaccttcacggagtgacagtaacatcaaatgcaaaggttataagtataatacaaaaagaaacactgatctgttcattttgaaagcaacaaactattagcctgaagcacatgtattcacagtaagaaaaaactattgactgagagatcaacttggttcacaggagaaaaaagtatgcttagagctccaactgagacacgaaggagtagctaaaaaaatatgcatcatgagcttaggacttagagcctcctttgcttcttagagcaagtttaatagtatagccaactactagctccaattcatctatagccaatctaatagttcattcatacaatagttacatactacactattaatacctggtcccacctgtcatacacacactgcatcttagagtccgtgctacagctggctataaatctgtagcccgctactcttctctcttctcatttatctacttaaaatatgtttgcagttggcttatagcctgctattgtacctgctcttaggtcctttgcttcttcggttcctcctaactactgaagccaacacatggatgtcacagcattcacattgccatctcccaactcccaagaaacttgcttcattctcatccaccaaggaatcaacctatatgagcataaccttatatgtcacctgaaaagaaaaatgaaacgttcaagtctcaattaatcaagctactactgatcatgggattgcaaccagcgagcatgtatatccatctgaaccatgttgcagtgttttcgttatacatagtgtagctgcagaacacatgcaagaatatgaccccaaggatccataatcatatcttcttggctgttccactgaacaattaatactgaattcattatatgaaaatcctgaaaaaaaaaaggaaaaatgatggttaattggatctcttgagaaaatgacagtataatttatgctcataagaggcaccatctatgaaaaatatataatttagcatagtcgtgacacaacgcaacatgaattctaattgcaccggacctcattcttagtaacatataaattaagcagaaaatcactggacaatgggccataccttatcaccagaagtcatatctcggtaaaacaaatatcattatgttgagacttgagatgatcagcacccaaggaattaacacttatcatttgcacagttgtaaagtaaaacctagaaatgtcttagcaggcattctgatatgggagttgtttagagaaaacatttagagatgtaagttgtcagttgcacaccaatagtgatctgcatctcccatttgtaccattacaccaaaaataacttttagatcacaagcatttgcaattttcccatctataataaatgcacacattcatatggaagcataaaaacatacacaattttaattgccggagtacccaaagtcataagcaagagtaaccgggacaagggaagtagtgttgttgaacctgacagcgccgcaacgggatatatttatttatttgcttgtgatgatgaacacccatcggtgttattattggtggagaaggaggacgatgccccggagctgtcacagcctgattttcgttttaggatttaaaattatttaatcaattattaatagaatttatattaaatgttcattaatttttaagtgaagttaaatgtgggaaataaaattttctaaatataaagcatggctggatttaatttttattaaattctccatgattaattatactatctgaaattttctcggatttttcggagctcaattcctaattttaataatacaaagaatatttcagtaattattcacatattaaattaatcattaaatgagctggtttcaattttgttaaatattttgagtgtccaagtatgttcaagattgttcttggaattatttgagcattggaagtatttttaacaattgaaagatcatttcagtgattaatttaattgggaaaagtaattagaataccgatttttttatttataataactaatccttcacaaattaaataagtagtaattatctgtagggatttaccaaagtagtaaggacgctattgtcatcagcgtccaggtgtggacactgttataatacatgtccagctcgagacgcacttcttaacagcgtccacagtctggtgcaacccaatgtgccttactgccttatcacaccggccgccttatcacaccggccactgtaagcgcttgttgacatctcctgctagcgagccttcgtgttgtcctaagcaacgttagctcgatcactttgttggcgattgagcatgtttaattacttaattatatgctatcactctataatttttgcctttgaagtgcccacgcatgcgttagcttttcctttatctggtccggttgcctctaaaacagatatatagctcgttgttggatcaatcaatttgtagttatatataggtatgtcgattcattttaatatcgctgcatatcgtatcaacatattatggttctagataaattatactcatatatttcaataatccagccaactgtgtcaattacaaatacaggacaaacaatctgggtaggtgttgacgaaaaaatcgaatacaccggcctgggagatctgcttaactccagtgcaggtccaaatcttggtgaaatgcgagcgtgccagtcagtttgatcttgcaactgacaagatatgcaaatagtatatcaaaacagccgatcggctgacaagccgatagagtagttccagccgatagcgataatagccgatgccgataccagccgatagcgatagggtttaagcaatcggctatatgtccaatgtagataataatataaaggcaatcggctgatgatgatgtaataaaataacaatataatccagtataaaccaatcggctagcattgatatgatagaataagcactgatctgaaggttaaagcatacatcggctggaggcccgatgtcatgaaatctacaagattagattaaacagtgaaacctttgttgtcatcggctaaatccaacttatatgtatatgcaatccttatgagccgatgcaacgtccagataactcatcagctgaaaccccgatgaaacccttattggcaatcaagaagcaggctagaaattatggttctaagcacgacttagtagatcaaacttaactgatgcagcactaagtatgaaaagaaatataatatctagacaatcaagccgttgactgagttttcagggtggtagatgtctaagctaatctaatctagcaacgcgatttagccgataccggcagaaaccctaaaatgagaagcagccgatagagctaaattgatatgctaaaactagattaacagagacatatgataaataggtaggcaaatatatcatccaaaccaaagcaatccaagaggtcgaatgtactgatgcagccttgaacgacgccaacgtagacgatacaattgcctggatcggcggaacattggacttatcccttcgccggagatcgaagacgatgcaactccgcatcgggtgccaagttccgccggaacgtaaaaacaaaagtagaagtaaaaagggtggcgatgcgccgaattgtattgatcgtagcgattgatagattacaatgaccccgggtgtacatatttatacccataggttgatacaagtccttgtcggacaagaaagaaactttcctaaagataaaaggaaaagataaagtccttataggacactaaacacactttcctaaagataaaaggaaactaacaaactattcctaattaatagatacaactgccttcttcggactcgatccgtacgtggcaatcatcatgaagcacgtcaactcaatctgacaatgattccaatatcatcttgccggaattggctacatcggcttgccttgtcctattcggtaactgccgatgcacactgtagccgatgcggttccgaagccgattcataccctgtttccgttatcgatttcctcccaaatccgcttcggccttaactccaaatccgatgcatgatttaccaaatttcatcgttaacagtaggtacaatacgttcttgcattaactaggcaaacaaaacgattcaaaccaagtatatatccggacactagataagttcttatacatacgaagaaacgtccacaatctaaaaaagctcacttaaatatataagctagttgcaatgtgcttcttgaaacttttcttagcacttaactacttgtgttgaacttcccgaaaacctaaatcaaacgaaaatgttagtttcaccaagataaaataaggcagctagctgattctcacagagttactgtttgttgagtcactagcttggcctccaccatcttctgtgtgggcactcctatctccatgctctatactgcaaccttttcctgagtatacccaatagtcaaatacttcattgtattgatacttttggataacttgacggaaccatggcaccacaaacaacaatagtaaatctatcaggatgaaacaatcttattgctgaaacaatcaaccgcacaaaaaacctgactagggtccgcatagaggacgtcgctgtcgagcggtcactggtggcggcggcctctagcgcaaggaggtctggacattgttacgaagatgttgacgggatgctggacgtcgttcaatacagcgtccaggtctggacattgttacgaagagcgtccattcctggacgctatagcgtttagcatccatcctacaattaaaatttccctctatcatttactagatatttaattaataggttgttaattattatatataaaaaaatcggaattaaaattcccttttccttttcgggccgaaacaggaaaagttcacatttaatcctccgcccattcttccttctattcggccggccttatcccttcccaaagtctagtttgcatccctccttctatcgggctgtgcaatggaagcccatccaaaagtctgttttgcgtcccctcgctacagtgcatcttcaacctccagccagagccgagctcctgtgcccgtgtcctgttgccgccgcctcctccttccaaatccgacctccccgttgctcctctttccaaattagttgcggaatggaatcctctcaatctcctatacaatttccccacgaaatcctcaaatgtttctatggaaatcctttccaatttcgcggatcaatctttccttttcccggcgaggatcctaaactttcccggagtttctcccgtcgatttgggcccggacccgagctcccgtgcctatataaaggaccctctagtcgtcctccacctatcccctcaagtcccgtcttccaccgtcgctggaaacgctctccccgcgagcaccttctctctccaccgccggccgccgctccagccgcgccgttcgtcgtcgtccatcgtcgccttaggtcgccgctgccaccgttgggttcgcgaggaggagaagaagatcgtcctccacttccccgaagccgaaatccaccggagctccatcgtcgccgtcaacccgaagttcgccgtcgtgttttgatctccaacgaggccctgctgctccttctgtcatcaccaatcttcaccgccacatccattggattcgcagctgcaagcagaagaccgtccaccacctcttctccgccaaagatcgccggaaagtcatcgccaccgtcgatcagtaccccgtcgccactccaacctcgccgccgtcgtcatctgtcgtcgtttgccgtcattcaagtcatcggtgagctcccctcgtcgtgctctttcctccggttcagatcaatttaagtcatccaatcttggtcgactcgatcgagattaatctcagccgtccaaaatcgatataaatctgttcgctcttttcaatgacatattattcctttttaatatatgtcatctatcaaatataatctaatctttttcggaggttgttttaatcttttgtcttaattataaatcatttgtaaatggtttaattaatttggaatagtctttttctttaataggctttaattggaattaattttgtaaattcataattaaatcatatgaaattggaataaggccgttcaagtctcattcatctaaaatcatgatctacatgtttgtttactttatatgttttgtttatttggagtttcttagtctttttctttgttttgcgtgttagcttgtcgtttctgtcgttgcaaaggttcgcgagtgcgccggaagtgttcaagaagattaattgaagaccgttgcaaggcaagtcacacaggtcccaaacacaattcctttgagcatgttgatcctatatttaattctctattaatttcaactatgcatttattttcgaatgtcactggtggtgtgtcacgcccggaaattcactagtaatttccgaacttatttgtgcataaaatcctcgtccagaaatcagccgaggtacacaaactgacaatttaatatacaaatccatcataataataacgttacacttacaaaagaaaagaaaacagcagcggaataacggtctagcgatggcttcagctccactcccacaggcagcttaactggggtataagccaaacatcttctccttctggatcatttttcttcaactgaggttgattgattattgcaagaatgagcatatgacatactcaacaagccacacagcaaatatgcgagtgcacaaggataccaaaggatggcataatataggctcatttgcaaaagcagcatttagcaaaacatttaagagaagtaaaacagtggagtaattaattagaaattttaatcaacactgaacagcacacccatgctgcacaggcccaaccatcctgaacaaccatacccggctgtacagatctaactccaaaccaggagctaaacaaattattaccaggtataacatccataattattgtgagaggtgtgagactaatcacgaaaaacattgctcaacccgcccataaccacgggcacggctattcgaatagttttactctggccagaggtgtaccactgtacccacaagacacagcctcaacatcatgtctaccatgcgtcgcgatactggaaagtacccgaatagaggctgtgacaataccatctgcacaacacaactcaccacagtgcaccattcctggatcataatcacccccttataaaacaaggcatggactccccagcgacccccgtgggcttatctccgccacttctcagtctggtgctccgcaatgaatcatgttatacaaaaggtaaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatatttctaatcatgactaagcaatcatatctaatatctagctgaaccaatatataaagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttctgaacactcccgacgcactcacgaaccttcgcaacgacggaaacgacaagctaacacgcaaaacgaagaaaaagactaataaaaaccaaataaacagtatatataaagtaaacaaacatgtagatgtcgattttagatgaatttagcaacttgaaccactcaaaaccgagttacgatgatttagttatgaatttcctaagatttaatctattagaaaaacaggaaaaagaaaaaacgatgatgacgtcatgatgacctcatcaatggccggaccaagatggcgacctcgccggagattggatggtcggctgcgactttggaggacatgtacacgtagaggacgacgagacgaacccaacggtactcaccctcgaaccaaacgacgaacgacgacggccggcgacgaggtctagcggcggcgcggcttcggtcgacggtggcgacggggctgcggtggtcagcggcttcgggggtcaggcggccgggcttctccaccctcccgcgcacctaacggtggtgacgacgaccggtggcgacgacggaggcgacggcgcgacgcggatggagctcggccggcgacgacggcggggtggagcacgtggcggcggcgctacgaggcacgggagatcacgggagagggggcaaacgaaagaggaggactaggggatcctatttaaagccttggattgaagagatcggactcctccagcaagaaatcgatccgggaaatcaaaaactcggttttggagataaactcgaaaacgagttcgattcggataagatactcaaagattagctccgatttttgggggtaaagatataggaggataagaggaatatttcccctcaactaattttagaaaaacacaaggggaaaggtcagatttggaggagaaaaaccgagccaaatcggtctcagttcggctgctagaggtagaagataaacagtgtcgagggaggcaaattagacttttcgtcttgggctggctgaaaacaaagcaaagaaagaaagagaaggggggagctcggctgggccgacttgggttgcacggccgtgcacacaaaagagggagatgggctggaaagggcccaagactaggaagaggattattattacttttccaattaaattaatcaatgaaatgatctttgaattgttaaaaatacttcctatgctcaaataattccaagaaaatcttgaacatacttggacacccaaagtttttaacaatattaaaaccagaccatttaatgattaatttaatatgtgggtaattactgaaatgctctttgtaagattaaaattaggaattgagctccgaaaaatccgagaatattccagagagtataattaaccatggagaatttaataaaaaattaaatccatccatgctttatatttaggaaattttatttcccacatttaacttcacttgtaaattaatgaacatttaatataaattctaataataatttattaaataatttataaatcctgaaacaaaaatcaggatgtgacatggtgtgaacctattcctttgttatggccaatttgcattgattaccctatgtcttgattacctcgggttataatttgactagctggatttatatattggttcagctagatgtattagatattgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttccaaactggacttttcttctctttatggacggagattggtatggttgctgtccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagtagcccccggcgttatgccagagcaatttcccttcccaagggaagcggtcaggtgtgacgccacccctaaagcctggtgacaggtgggaccggtctccgtagttgggcaaaatacccaacggtctcaatccatgcacattggtattggtaactttggttgtccataatgggcggtctattcaagactgccacaccacttgagcagcgcgcgaatctgggcgagcagattcgtctcgcccggagatacggcaacgccgcttcggtcggcgagcgtaattaacgcgcgcacgatacaatccgtttcgatcgccacaaccgcatatccacttcatgcgccgtaagcgggcgaatgggattagtggaagcgtgggcacgggaaacgagggagcgagatagcgagatatgagggagcgaggtagtgggcgcgagaaacgaggagccaggcccagcgatggcaagggtataaaagcatcgagaaaaggatttgcttccttcctttcgccattgttcctcttgccttcaccgcctgagctctaactctttctctgctacgccctactttcgccacacgcgctcgttctcaatcatctcttcctccaccgccatggcacggggctctgctctgctcgacggcagtgtactaccgccttcccgcatcgtgaacgagaggcacgccggactgccgcgccgcttcatgcctgagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcgcacctgtgcgagatgttcattggggtgcgcccctctcttcagctgttccggtggttcttcaccgtgcagtcggtgtcaccgccgtcggtggtcggcggctgctacttccagccgcgggggccggtgttgaaccgctacatcccctgcgtcctccgcaagaagtgggacgactggaagagcgactggttctacacccccctcgccaacgaagcgcgcctccgacttccaagccagcccccggcgcaggtctccagctggcgggcgtcggtagatctgggggaggactacgacgccgtcctcgaccgcctggcgggcctgcgatcccaggggctcaccggggccatggtgtacggcgattacctccgccgccggattgcgccgctccaacggcgcgcccggagcgcctgggagtacactgggcctgaagactacatgcggacccaccagggagccagatgggactgggctcccgaggacttcaagatcgtagttcaaagggtgctgaatcttagctccgcggaggcgtctcgcattcctcaggagatcctccccctctgcagcgatcccgaccgcgcctccattctaaccattatgatgggggtcggggcctcagaggagagagcccctaagggccacgacggcgcgggcgagcgccgccggggggaaccatctgccccaggagggggtcgtgcttctgggccccgcgtcgggggctcggggagcagccgccctgccgacgcccaggggaagaggaagctgggaggaacacctcccacatctcctccccgagggggcggggcggcgcgtgccagcagtcggcgcccggaggggggcgcgccgacgtcgcagcccgagggggagcgcaagaagaagcggctccgcaagatgggggagacggaaccatcccggggaaacctgatttcccctccaaagtggtcatttaaccgaccccctcgcaggttcgccccattcttattgcgaccgtctttcttctatcccattaagcaagttttctcttacccatcttgtttgtcttctggttttttattctgcttcagcgatgccccgtcacattcctcccgccaccccaagtccggccagtccgaggccgaagatccggcggccgcagaggagcggaggcgagaagctgaccggcgtgaagccgcagatcgccttcgggaagctgaagaggccgcccgggaggccgcccgggctcgccaagccgaagaagctgctcgggaggaggccgcccgggctcgccaagccgaagaagctgcccgggaggaggccgcccgggctcgccaggctgaggcgacagctgctgctggcgcgtcacttgggcccactccctcgggcggccctcaggcgacatcctccgaggcggctcgcgacgaggccgcgggcgcatcgcctgggcctacctcaccgggcgacgcccaggaccaaacgggcccgggggacatccccgagcccagcgcatcctccggggggccaagccgcgtcgcattttctccaaggcggctcttttcctcatcttctgtcgccccgctgagcgccgagccccttctgcaggccctggccgccgcaaacaccgcagtgctggatgggttcaacgcccaagtggaggccctgcgtgcggaacgagcggagctcgaggccgcatgggcgcgcgttgaggaggggcggcgctcggtggacgccatggtggaggtgggccgtaaggctcaccgccgtcacatctcggagcttgaagcccgcaaggcggcgctggcggaggtcgcccgagaggtggaggaggagcgagaggccgcccttatcgccaccaccgcgatgatcgaggcgcaagacaccctccgccttcagcacgcaagctgggaggcggagctgaagaaaaagctcgacgccgcccaaggggtccttgactccgccgctgcccgagagcggcgggtaacggagactgaagcggcgtctcggcggcgcaaggaggcccttgagtcccgtgccatggcgctggaagaacacgccggcaccgtggagaggggcttgacggaccgcgaggccgccgctgctctccgggaggcgacgctggcggcgcacgaggccgcctgcgccgaggaggagtgcgcgctccgcctccgcgaggacgcactcgctgagcgggagcgagctctcgaggaggctgaggccacgaccaaacggctggcggacagcctgtcccttcgcgaggcggcgcaagaggagcaggcgcgccgcaatcttgaatgcgtccgcgccgagagagccgcactggagcagcgggctgctgacctcgaggcgcgggaaaaggagctggacgcgagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccacatgaagcgcgccggtcggcaagcgggcctctggagaggccagacgtcggtgccccccaccaatctggaaggcctcgctccgcacctcaccaggatggcctgggttctcgaacaactccccgaggagcttgagaagaccatcaagtcatcctcgagggacctcgcgcagggagcggtcgaactcgtgctggcgagctaccaggcccgggaccccaacttctctccatggatggcgctggaggagttccctcccgggaccgaggacgacgcgcgcgcgcgcgtccgggatgccgccgaccacatcgtcaacggcttcgagggctcggcccctcggctcgcgttcgcccctagctccgacgaggagggcgatgccagcggtgaggacgacggtggcgacgaggccggcgacccgggcgcgtcggaatgagcccccgagcccccgtcaatcttcacttttttctttttctttcttctaaggccttcgtgcctcttttgtatagatcaacttaatctgcaatcaaaaatgatgaaaaatttctatgttaactttattttgctatacttatgagttgaggatgatttgtgccgtggtccttttgcattttagcttgatttaagagctcgtgctcaagtcccaatcctcagatggctcgggtcggggctagtgcctggggagatccacatgccgagactggccaggccgggaacatggtgaccgagggttatgggtgacccgattgtgggtttttgccgattcccccccggagttcaccatgccccggggcacggctcggttctgggccccgcttggcgattttagctgaccgaaccgagcccccgagggcaaggttgagcacgagtgaccttatttcaagttaagattcttcagaaggaaaaacggcacagacacaacctttaggaaattgaaacttcttttattgaaatgctgaaataagaaaagtaagactgtgcatgtgtggtagcccccggccaaccctgcacacccgaggggggtgcggggttggcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccatattggtgagagcttgctcaatccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataggcctcgggccacttagtgaacttgtcgatcgcaacatacagatactcaaacccgcccagggcccgtttgaacggtcccaggatatcaagcccccagacagcaaatggccatgacagtggtatgatctgcagggcctgggccggctgatggatttgcttggcgtggaactgacacgctctgcatcgccggaccagatcgactgcatcattgagagctgtcggccaataaaatccttgacgaaaggccttgccaaccagggtgcgtgaggcggaatgcgctccgcactcgccctcatggatgtcagcaagaagctcaacgccttgttcctgaggaatgcacttcaggaggatcccgttagccgcgcgccgatagagggtcccttctaccagcacgtagcgtttggaaatgcgttgtacgcgttcactcccttggcggtcctcaggtagagtcttatctgtgaggtatgtttggatctcagagatccaagcaatcaatctaagggagtttggagcactcccttcgagtcccgaggcctggactccgacggccctcgggggccggtcaggcgcatccgtctcccctaagggattgggtcgcgccgacggctgggtaagcctttcttcaaaggcgcccggtggggtctgggctcgcgaggacgcgagccgtgagagttcgtcggctatcatgttatcccgcctgggcacatgccgaagctctattccatcgaaatggcgctccatacgccgcacttggcgtacgtaggcgttcatctgtgggtcagagcaccggtactccttacagacctggttaacgactagctgggagtcgcctaataccaagaggcggcggatccccagtccagctgccactctgagtccggcaaggagtccctcgtactctgccatattgttagtcgctcgaaagtcgagacggaccaagtatctgaggacgtctccgttcggagaggtcaacgtgacccctgcaccggcgccctggagagacagagaaccgtcgaactgcatcacccagtgggcggtttgaggcagctgtgagaggttcgtgctggcctcgggcattgagacagtctctggagccggggtccactctgccacaaaatcggcgagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggtctcactaataaagtagacaggcctctgcacctttcggcggggccgatcctcttcgctaggggccgtatccccggggtgctcttcgtccaagtggcctctcggggcacactcgtctcctgcgctgatgacctcggggtccgaagatgacaggtgcggccttcccacagtggcctcggggccgtcccgggggtcgggggctcctggcgttgtcagacaagcgggcaaagggccagctccggtcgtcaggggcctcaggcctccgttcggctcgggggcctcttctccctgctctctcccgggtcgaatcagcacagggttagcctcggggtcaaagggtggtagatgcggccttcccgcagtggcctcggggccttcctgagggtcgggggcacccggcaccgtctgacaagcgggcagagggccgactccggtcgtcgggggccttaggccaccgttcgactcgggggcctctcctccctgcctgctcccgggccaagtcagcacagagtgggggtgcgcagaatgaggattgtcctcatcgcgctccacaaccaacgctgcactaactacttggggggtcgccgctaagtaaagtagcaggggctcatttggctccggggcgactagaaccgggggagagctgagatatacctttaactgagtaagggcatgttcagcttcctccgtccaagtgaacggcccggagcgcttgaggagcttaaacaagggtagcgccttctctcccagccttgatatgaaacgacttagggcggccatgcaaccggtgacgcattgcacatccctaagtttgctgggggggcgcatccgctcgatagctcgaatcttctcggggttggcctcaatgcctcgggcagagaccaaaaacccgagaagcttgcccgcaggtacaccaaacacgcacttatcggggttcagttttatgcgggcagagcggaggttttcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagaatatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagtctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaagaaggagacgagcgcgtcttcctatttgtcatccagaagaccaccgatccgtgtggtcttggatgggccgtcgcccaaggcaacctccttgaccgggacctcgtcgcatgtggcaatccgctgcctcggggcggtgggggcagaggggccaagcctctcgtcaccaccctcgggcttggacgcagcagcgaggcggtcggcgcgctgctccatgcaagcaagcgcgactttaagatcgccatggacagagatggggccaccggggcccggcatcttcatctggaggtaggcgtagtggaccgccgccatgaacttcaccaacgcgggcctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgataattggctgggacggtcggagcaccatccccggggccttgatagcatcaaaggccgcgggggaaaggatgttgagagccgctcctccatctatgaggacacgtcccaacttcacgttgcagatggtgggggaaactaccatcgcaacctgccctccccgggcaatgcacggtgggtggtcggtctggtcgaaagtgagagcaacctctgaccaccgcgcccgacgcatcgcctcatgagtaggggccatggccagaagctctcgcttcatagccttgaagctccggcgagagacgtgagcacacgctcctccatcgacggtggcaatggtggccccaggttcttggaaacctaggccatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaatttttgactgcgcgacagtccgcgagatcgtggagggaggtgttgtggacggagcaccacttgctgactgggcgctcccggctgggagtaccagcctctttctttttgtcgctcgcaggcctcccctttcgggtggcccgcggagcgctctcgacggcgaggacgtgcccctcgtcgccggaatgggccgaccttttcttcctcctcctgtcacgccgccctgtctgagcggcggatccgggggcggccgaagctgccacaccggaaccggaggggttccaggtccaggcctcctccttacgagccactcggtctgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgtcctccgttgcgcggggagtacgccggctattacgccggcgctcgatgttgaggcgggcatccggctccccatgctgatcctcccgagtcgaaggtgtcgacgagggagtggcagccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcggcgctccccatcttgccgtcctcctgcaccacctgcaactggtgatgccacggatttgtcgaccttctcaagcgcctccccctgcttagggctttggcgcagaggaggtgggggagtacgagctcgacggcgtggattcggctccccgtcgtcgccgctcacactcggagagaggtcgtgcgcttctccttgctcggccattaggctgaacaagaaaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaagcgtaataccctactcctgtgttttggtgaatttgtgtgtggaagagctacaaaatgtgggccgacctctcccttgttctaggctctgaatctggaaagaatccccctccctctatgggcaaggtcctccttttatacttcaaggggataccacacgcaccctcctctttccaaactggacttttcttctctttatggacggagattggtatggttgctgtccgaatgacacttcgatgggacagcccacacctacctccactcccggcggagacgggcgcaacgtgggatcgtggctgcccgttgctgacgcgaccagtgtcagactggtcattcttgtccaccatgtgtcagtttaacaagatgcatgtttgcccttcttcgtgtaacaccttgcctgtaatggttaggatgaagcctggtataaatctaaccagggctaacgtgccatctctaagagataacacgctagctccggcttgagacgagttgcctagaggctttcgtcttgacgggatggggcaaggcgtgcgtcagaccgccagtcgccacctaacccttgatctgaccggtctgtgactggtcacagaccggataaaagagcgtgctgtactgcgttacatgcagcgtgacacgcttgaccagactgtaataaatgctgttaggtgagcacagctgtgctcacttatcccatatatgtggcgcagacttctttaaggggtcggggtgcctcggccctcggggccggggcaagcgcaacccgacccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacagatataattgcttagctatgcttagaaacattagcacacgattgggataactaatgttttactattacttattgatggatatttaattgtagctcacgatggtcaatcgtgattgattaattaatttgccaactaaaacttgataatggtgggttgtgagcatatggttttgatggtcgtgctcatgacaattaaggaccggttcacgagtttcggttgtgaaacattaaccgtgctaaccacaagccagcatgggcaacggctttaccttttgtatagcatagttcattgcagggtaccagactgagaagtggcggagataagcccacgggggtcgctggggagtccatgccttgtttataagggattgattatgatctaggaacggtgcgctgtggtggattgtgttatgcgaggggtactgtcacagctcctttccgaggtaccgtggtggtattgaggcgcatggtgacatgtcgtggggctgtgtcttgtgggtacagtggtacacttctggccagagtaaaactattcgaatagccgtgcacgtggtcatgggcgggtctaacaatgtctttcgtgattagtcccacgctactcattaataataatgtggtaattgatggtaattaatttagctcctggtttggaatgctatattcctggtttggagatagatctgtacagccgggtatggttgtccaggatggttgggcctgtgcagcatgggtgtgttgttcagtgttgattaatattgatgattaattactctactgttttacgattctcaaatatttgctaaatactgcttttacaaatgaaccctatattataccattctttggtatccttgtgcacttgcatatttgctatgtggcttgcggagtattccatgtactcaccttgcaataatcaatcaaacctcagttgaagacaagttgcgaaggagaagacgtttggcttataccccagttgagctgcctgtgggagtggagccggagcttcgctagaccataattctgctgctattttctcttttcttttgtaagtatttacgttattagtatgatgaatctgtatattaaattgtcagtttgtgtacctcggctgattcctgaacgaggatttaatgcacaaataagttcagaaattactagtgaattaccagccggataggctaaatctaccgcaggggtgtggtggcaggggatgctggtagcggcgagcgtcagcctcgtggacatcgagcaacctctgagtttcgatggcgcggggacgacgtgcgttgtggtgggcgtcaacgcagccgaggaggctcaacaggacttgggccaaacctctgtagctttgcccatgccgccatccccaccctctcccctcctcaactgctcccctctccggtgtcatcatcgaggctgagactggtggtggtgccggtggctagatccgaagccttcgcatggcttggtccggcgcctcagattcgatgctgccatggctggtcagggaggaagaagagagctcacatcaagggcacataagggatgagtaggagaggacatatcacgggcaatgccagcagtagcaggaggatatgatggatatgcgatgcgggtgaggaggtgattgaggggagcactctcgcccctgcccctcaatggcgtgagctgcacatcaatcgcagggagagaaagagcgcgtggatagtgcaacggataccgcgggcgcggggcgtggatggcgcgcgacagcggtggcgatgaaggcgcgcgctagcgcggtggggatggggatggggatggggagggttccgaattggtgattccagctgcccacttttatctctttcacccgttagatttgatttcaccggttggattgcaagcggtgaactcatcctttttatattagtatagatatttgtttactatttggactgaggctaaggccgtgtttagttctcaaaataaaaacttttcacccatcacatcgaatgtttggacatatgaatagagtattaaatgtggggaaaagaacaattacacagtttgcgtgtaaattgtgagacgaatcttttaagcctaattgcgccatgatttgacaacgtgatgctatagtaaacatttgctaatgacagattaattaggctaataaattcgtctcgtagttttctaacggaacatgcaatttgttttgttattaaactacatttaatacttcaaatgtgtgtctgtatatccaatgtgacaaccaatcctaaattttttcccccactaaatctacctaattcaataggacttcaaaccgaaacagccatcgttagctctcagttcgtcaagtagtcgtgactatgagtcaattctataaagattatagttttcggtgaagtacggatgtgactatgaagatcatttgctacagtaaacgcagcgctctttgccacgctaccaggctactgttccactgttcatcttatttctagccgtccgatcagtcctttcgaggcgtgctggccatccgtagcattaggatagcttttctcctcatccatcgggggaaaagtgttggaatgtaaatcatgtctcctctatcaccggctccctttccttctcccgatcatggtttccggtcatgtttccataaatcggtagagtgagtatggaagatagaggcctatgcatgtaatgctccatgatcaatacaccatcgcgttgagtcattctgtctatcaaaaagaaaacgcggtcttctgcttccctgcgtccgccgcccgacgccctcctgttaacttcgtcggcggctacccctgtcgctgccttcatgtgtgctttcatctccttctcgatctcttgcgtctactgccagtctgccgcgcagccatgtatttctctgccatccttgccatcctcacctgctgccgtgccagaccggcatgtacccgttcgctatggttggcgacggtctccggccaccggccatatctgtccaccgtatacggcctccatttaagctgaatcggagtcgtatcgcgcgcaattgctatcctcctccgtcaccttgcctgtttcctcccaaagacccaaaccccgtcgattcgtgccttgctactgtttctaagtcctgtgttgttcttgctgttccactgtccctgaaggtactccctccttatttatgacgccgttgacttttcgatcaatgtttgaccattcgttttatttaaaaattttatgtaaatatgaaaatatttatgtcatgtttaaaaaacatttgatgacgaatcaagttataataaaataaatgataattacataaattttttgaataaattttttgaataagatgaatggtcaaacgttggataaaaagtcaacggcgtcatgcattaaaatatggaggtagtatttgtttgctgtcttaattaaaatacttgatatgagtgaacataaatgtgttgtatatataggctaagcgcattgccattgcaatgatggtattccgtaaatatttgaggaggtagcagctacttcgcccggcgaaaaaaaatagcagcagctttttttggagggccgccttgattagccttatgtacctaatttctgaatttaggggtgcttttatagttattgatatgagatctgtgaacatagaggttgttcattttgatgttagtttcaaccataccattttttttcaaagttacctaaaaatggctatgtttagtttgttgccaaatttgatcaatacataagaaataataccaaaattttggcaatattgccatcttgccaaaattttgacattgccaaaacttggtaatgtttattttggctacaatttgaacaagcccataattataaatgtggtggacttgggttaaaaaaagcttttatactaacttaaggtattaatccaaaaatcgccactcaaagctaacagttagaggcactgaactgactctgtatcaacattttgctttccagtttaatctaacgtttgcatctttccttttgttttccttcaaaatttttggctttcattgatcataattttcactcatggaaaaagaacaaaaaaaaattgtgatgtgctggtatcagtggcatttgatagccgtttattttggataaaaggaaagatcatgcatccttctctattatcatgtacttccttttgtttcacaatataggtcattctaacattttctatattcatgttaatattaaatgtaacatcaatataaatatggaaaatgctagaatgacctgcattgtgaaacgctgtttttcaccgtgattgagaagtcctatattcattttggatattcacgggatggtatcaaatcatgtttcccacatatgcattgtaatttttcttaatgcagtacccgttagacatgtacagtgatcttctgttgttattctttagtagattttatcgaaagcagggaactttctctaggaaaatccattacccactccccagtggagagagatttgatgccctgatgtatgctgcactctttctccaatgggttttttaattttcatggttggttctgatttactgcttgctatgctcatcgtcccttttctcctttgtttcacagctttacgcaatatatatttttaggttcttttatgtttattttgcctaaacttatgccttttgggtaccttttctctaaatagcatcgaattcaaccaaatgttcgatgctatttacgccaagtttagttccaaaatttttcttcaaacttttaaactttgctatcacatcaaaacttttctgcacacataaacttccaacttttccgtcatatcattccaatttcaaccaaactaccaattttggtgtgaaaaacacacccttagtatatactacactacatggacagttgtcctacattcgatcaccggtacggtgttgttttttctttttggttatatatgcatcagggaactaattagccattttgtccagatcaatcttcatttccacattttataaatattgcgtgcatgcttaccattatagtactcttcacgatgttcccgcggggtacagcctagtaaataggatgactgaaataaggttcgagtaaatgagacatgttaggttagctatacgtatagatttggaaagaggtaaccaaaaccaaattcaaaattttcaaatccctcaaatttgtaggcccccaaacctgctgcctactgcctaggtttccaatttgaaaggaaaaagtacacgaaaggtcccttaacttatcatcgagttacaaaatcgtcccccaaccacaaaaccagatatataaaatccctcaacttacaaaaaccgttcactttaggttctccggtggttttgaccctggtttagtccgacgtagcggctgagtcaacgtgatacccacgtgagccctacatgtcaggatgccactttcccctcctttcccttcctcctcctctccccctctcacttttctcctctgggcagggcggccggcaggtgaggaggaggtcaccgggacgaggcgagagaggaggtccgactgccggcgatgcggtgatggcgcccgccggtacaaatcccacctctgcggcgccatgtcctcctcccgcgggccgtcgtctcctctgtcccacccgaaccctatcgatcccttcgccgcggtagcggcggcgacagcggaggcgccaccgctccgaaaccctatcatcccccatgaccctccctcgccggagatggaggccaccgcggaggcgctcacctgggaggggtgctgtgttggcggaggtgccgcgccaagcatctcgttgatgtgtactggcggttctattggacgctcgggtggagctgcgggcgtggcatgggcgaagcctgctcgaggcagagcagctgccgctgctgccctccgcgtccaaggtggtcaggccggtgtccgcgatggtgccgaggcggaagaaatgcagcttcggcgggtgcaaggtgcggaccatggctatggccaggttctgccactcccacatcctctccgatgaccatggtgatggcatgtcccttccgccgcgctcttgacagacggtgtgggtgatgatgtggcatcctgacatgtgggtcccacgctgacttagccgccacatcggataaaaccggggtcaaaacaaccgaaagacctaaagttaacgatattataagttgaaggatgtcatgtatcaggttttgcggttgggggacgattttgtaactcgatgaaaagttgagggacattcggtatactttttccaatttgaaattgctttcttccaaggccacaaaaaacaagtaataagttcaccggaggtccctcaacttaacagcgagattttttgaggtccctcaaccacaaaaccagaaattttcgcccctaaactcattcaaaccgttcacaggaggtcccttggcagtataggtgggtggtttcgcttacgtggcatcctagtcagaaaaaaaaaattaaaaaatttcgtggggcccacatgtcagctgcactttattttttcttctcttttctctcctcttctctttcctctcctctctctttgccggcggcgggcggcgatgggcgagcgcgcgactggagtaggtggaggggcggcgtcagcgcgctagagcaggcggagcgcgcggtgtctccgggcgagcgcgactacggcgacggcaagcggtgggcgagcgcgacggcgggcaagcggcggctccgagggtgggcggtgcgcggccggagcaggtggagcggcggtgtctccgagcgcgggcggagcaaaggggcgggggcgcgacgggcgagcggcggcgacgcgtcacctctttccccctctcccgccggcctcatctcccccaactccgtccgctcccgccgctgcggcgcgccaccacgttgggctcctccgatgagtgcgacggcggcggcgggaaccagcagcaagaacgatgtgctcgttcgctctgtccgctttgcgcgccgctctcgccgccgccaccgacgcgactggcggagtaggccgccacgctcctcctttggccacctccgccgttgcggcctcctcatccgcctgcagtgctcattcgctcgctcgacgcccgtcgtccgctctgctcgcagcccgccgcgcttgccttccgctcgccctccgccgtccaacgccgctccgcgtgccgccgcgccacccgcctccattctgcccacaggccgcgctcggtggactgcgggctcaaggatgacctcgtgttcggggaccctaacgcgccgcggttccgccgccacctcccggatcccgcccccacctcccgccgcggtcgtccgcagtccgccgctgctctcaccggctgtcgccccgctcctgcatgcttcacctgccgcggccgcgctcgcgctccgccgccgccgccgctctcgtcggccgttgccccgctcctgcctgcttcgcttgccgcggccgcgctcgccctccgccgccgccgccgctctcgccggccgtcatcccgcccatctcgtctcgtcgaagaaaacgagagaagagaagaaaggggaaaaggaagggatgtggggcccgcaccattttctctcacttacatgtggtccccacgtactttatttatttatttttgctgactagaatgcaacgtcagcgaaaccacccacctatactgccaagggacctcctgggaacggtttcaatgagtttaggggcgaacatctctggttttgtagttgagggaccttaaaaaaaactcgctgttaagttgagggacctccggtgaacttagtctcaaaaaacaatcgtaattagcaggccgccagcccagcccacctacttctcctacacggcccaactgccacgtcagctaaccacctcattcaatccactccactccacggagccaacccgagctcgcgagatggaagctcacctccggccgctctccgccgcggcgctcctcctttcccccgctgcgccgcttcccaccgccgttgctgcttctgcgaggagagcatcccccggtggcaggaggtggagcagcgtgagggccagcgcgggcggcgggggctggctgtcgggcctgctcggaggcaagggcggcggcggcgcgccgacggcgatgacggtgacgccggggaccgtgaaggcgggggaccccgtcctgcacgagccggctcaggacgttgcccccggggacatcccctcggagaaggtccagggcgtcatcgaccggatggtcgccgtcatgcgcaaggcccccggcgtcggcctcgccgccccgcagatcggcgtccccttgaaggtaacccgcaaccgaggacacgattcgtgcgatcgctcctgcattattccattgcattaattgctccaaattactccactaagtcgtctactgttcaactgtttaattacctgcttatgtttgttcctgattgacacatggctgaattgctcgacctgttaaaatttcatagattatcgtcctggaggatacccaagaatacatcagctatgctcccaagaaggacattgaagcgcaggatcgccgtcctttcgatcttcttgtgagtagtagtacatttgtcctatgtagttgccttcaccaacaattatcattaggcaatattgccgccttctcatgccgttttattttccttgtgtcccttggataccaggttatcatcaatcctaagcttaagacgacgagtaaaagaactgcattgttcttcgaggggtgtttgaggtactcgctagaatgcttctttgtgatgttattactagtttctcattatgcattgtactggattacattgtgcttgttctcatgtgtcttctggggatggcagtgtagatggatacagggcacttgtcgagcgacacctggatgttgaggtttcaggtttggacaggaatggacgccccatcaaggtagaagcttcaggatggcaggcacgtatcctgcagcacgaatgtgatcatcttgaaggtacattgtatgttgacacgatggtccctaggacattcagaattgttgataacttggatcttccgcttcctgttggatgccctccaataggtgcacgctgaggtggagagcattccacattttaaaatttccaagtagagataattgcactctatagtatacataaaatttatcccaagtataatatttgcattgctgcttatttctgtgattgccaattttccatgaattgatttttcaatgtctgttgtggtcatacacatgcggagaatcactgccttgtatgttgaattgacatcatgtggtaacattcgttgttggttgtaagatgttcgctcaatgttttttgtatggtgtccatggactctgggagaacaggaattttacacttcaatagaactgtaccttttcctccagtttttgtctcttcaacataatttgcaataccatacacttaatagtgtatactgattatttttatcatatttctgatattcttgaacttctctatatttcgtacaacttgaattttctttcatctgttttgagatttgaagctagttgagattcttccaagtttatgtaaactaatgtggttggttaaattatacaaattgcttttggtggtatggttgtgtctctgtctctcaaagcagcatgtgttgttttcctaaactagagtagcaaaaggaaacatatccatgatgggtgtaacatgattatgttgtctgatcatgtctcagaaccagtttgtttatgcagtatattatgatataatattccttctaacatattaaattcaatacctttctgtattaattttaggatagcttgatgggtggtggaaggtaagccatatataatttaaacccttttgaaaatgcaagttcgcaaagagccttgaacgcaaggaagtgaacattatgtacaaagatagaataagaaaaatgagcactaatagaagttcacaagaataaatgaacagtttgtcattatgatgtatcatttaatatgtaagtatttctccaagtgtcttaaaataatattttaaaacacccttacaatcagttgtctggataatggagtgcatctgttacttcctactgtaggaaggaattatgagacaaaaagctaacaagtatgtacttataagataaattgaacctgaaggaaacagagttcatcagttacgacagaataatgaggaacttcacacatggaccttataacttgagcatcagcatttaacaatcatgacaagtacaaagtgagtcatggtgcagatggaggacataaatgttgcaatcaagtggccacacatgacacattagaaatcaacttaatccttcgaaaccaaaatgttacatcttcgtagtcccaagtatattgtagtctacttaaagccccaagctctgaagaatggaatgcttgactttaaaggcatgcatacatttggaacagtgttttgaagataccaattttctgattctgggagatgaaggttcacttgtttcagaggcaccaaattgtagaccactgtaaagaaaaataaaacaggagaattttcagatggtatgacaatcatatactgtaggcatagacatagccatgaaattaacacataaatcatgtttgaatcagtgttcatgccctcaatattcgttcaatttcgaaacaggcaactcccaaagcattcacctactgcaactgtgcaaaaccaaaggattgagttttatacgaagtagcagttgagattttctttgttacacataccttcaaacaatgaaaactacaataatgtgagaattagatataactacgaaacttttaacatgttaaataactaatctacaggagtgttatgatttcagtctacctaccatcacagcaagccacaagaaagagatgcctttattttttaatatttgcctcttttatgtattttgtcctatgatataggggctacgggttcaataatttgttctcattgttcattggtctatatactacagtcctatcattgagctttgtaaaagataggctggactacatgaaattgagtgctacagcctactggtatgaaactgttgccaagtgtcttaacattatctccaatcctgttgattaagagaactcctgtgggtaacaaaagcaatcatcacatccaggcttgttacaaacttagacaaagtttccagtccattacctgggctgaaggagcttgtcatggaaaatggaacatttgtcagaactctcacataggctggtcctactgacatccaaaatatagaacctgagctgcacagtgaggtggtcgagtacttgagaacttccttttggtcataaagattggtcattgggatccttcaaatctggcctgaatgcaccaactagcctattgcactagcttttttccatcatacagggcaccatgccgcacaacaaggcgacctgcacatggtctgcggttctccatatgtttattctccctttttaaagtagaggaaattgtcctttgcctcacccgctcattgcagagaatccaaactcataatccatcagtttagttaattggtgttggactatagactatagagattctggttgcttgtgccattctccaactctgctatatagatggctttaggaagacccatactgattcagaactaatcatctttgggagaggagagatactagctacacattcagattcagagctaacatccgcagtcaccattgcttcattggaggagagatcattgggtagcaatggcagcccaccatggtagcagcaggaagacaaaggcagagcagtggctattcggtggaagatggaggagaactgtgaaggagacaaagcatcctgttgcctctgaagccaagcctccagctccaacatttcctacagccattcagaaggatggcgacatctgccttgagaagtccagagttcatcttcctggcctgggacagagggagatcatcgatatcgcgcccgggaggaagtcaatgccggaggtggagatcaacatgaaggaggtcagggagatcatcgatatcgtgcccgggaggaagtcgatgccggaggtggagatcaacatgaaggaggtcgtctctgtgcttggtgtgaaggtgatggctgcagacatgtcgccatttatgcagctgcatgctttccggtgtgctaagcggtcccatgatagcttggacaagttcagctcaaggcagctggcccatgatgtgaagaaggtgagcttatttttttttctttcaatttgtgatctttcgcttgtttgtttacttttgttttgtattctgaaagggattgcactgattccgttcattgtatacgctccttccctttgtcttttggacgggttctttgtgaaatcaaattttagaaacttatcatttatgttgtcaattatgagatgcacttctagcatcttctgtatcatgcaatgcacatagccttaatgctgaaacacgtagtaaaatcattatctgatatattagaacctaaatagtgttgctgcttcactttttaatacttgtttttgaaggaaaatgtaatctggcttggcttctaacatcttgtccttgatatccaacaggagtttgataaagtttatggacctacatggcattgcatcgtcggcacaagctacggctctttcgtgacgcatgcgagaggctgtttcctctacttctccatggataagatcatcgtgatgctgttcaagaccaagatcaggaaagtgttagcatcatcttgagctccatagggaccaaccatgacatatctcttgtctcaatggtcaatacacttccatcatgagaaaaaaaaagggtaattaattagtctagctctgtgagagtgaagaaacaggggaagaaaaccacctcaaataattgttttgtccgtgagttgcaagttgcagctgaacaagtactgtggttggatggtgctgatgaatactaagcaccaataggaaagcaggttgtatatgtaaattaattaattaccacttggaaagtgatgtgatgatgaactgttgtttgggtgtagtagttgttgttctccttggggacagctctgacagaggctatacaacaatcgctgtcaggatcacgttgtgagattcctgattagtagagataatcacgggctaatacggttgatcaaataccacctctcgctgtgatgatgaggtagctggttgacaattgtgtctagctcttgtagtagtggagtaaacaatacctggatggatgatggatctcgtcatcaccaccgctcactgtttccaggttctagtccaagctccatggttagtccaagctctgggtttacaagccaagaagacttgttctaccacgtgatggccatcagctcctctggctgtgcaaccatggatgcatatgatgcccggattggttgagtgataagctgtaaaaatataaagaaaccaattaaaaatatttatagctaaaattctattttacccaccattccaaaatgatcatcagattacacaggtataccaaggccctatgtagttcacaccaaacttctccccaactcctaactttccatcacatcatatcacatccaaaactttcctacatacataaactcccaactttttttccgagtaaaatgcaccagcggtccttaaacttgtcaggaggtttcacctaggtccacgaacttgcaaagcgcacatcgagatccctaaacttggtttattgtatcatcccggtccaaaaccgcgtttgaccgtggtcttacctacgtggcataccacgtggatgatgacatggaattttttaatatttttttctcccttcttctttttcctcccttccttttctttctctcctctcccgtgcctccgccagtcgacgcgggagcgggggcgaagaggggggcatcggcgagctcggcgtgagcggggcggacacgagctcggtgtgagcggcagggtggcagggcgagctcgacttgagcagcgatgactgggggaggaggacgacagcgctgcgtgcgtgcggggggaggggtgtcaccggccgcggcccgggggaggtgtcgccgaccgcggttgcgcgtgaggggggaggcgtcggcgagcaagacgcgagcggggcgggcgcgagctcgacggcggcagcggggcggcagggcgagctcgagctcggcagcacgagcttgatggcgtcagcggccatatcgagctccgtgtggcggaggacgacgagctcgagctctctcccccctccatcggcgagctcacccccaactatcccaaacttccaactttctatcacatcatatcacatccaaaattttcctatatacataaactttcaactttttttccaaacctccaactttccccaaacttccaacttttttttaagaaataaacacacagccctactctttggccggcccggcaaaaaactgagcagcagccgccatgaactccccaccctcatttctcattactgcaagagaaattatttattttttagaccttttaatttttagattttaaaaatagtccttttcaaaaataaatttttttggccacgccagtcgaatgggccaacgtcgactgttgataggaattccttcaaccctatctcaaaaccaaccttgtccttgtcgtcaaatgtctcctgataaagctattaaaagctaatttgttagtctgctgtactagtagcagtgacaatcattcgaagtactgattttgtatatctatggcgtgccacacaaatactgcggacaaaattttttgtcatcggattcttttaggctcgtgctgattttaacgagagattgggaatttaaagagatgggattgctaacttctttgtttgatatgtgtttgggagagcacagaaaatgtggtggtttattaatgtataattaattaattaattaatagctaaaaataacttgaaaaatgaattaatatatttttaaaacaactttcgtatagaaattttttgtaaaaaaacacaccatttagtagataaaaagtgtgtacgcgaaaagcgagaggaagaactcagagttttagttggatggggatcaaaaattaagggataaactattgcttttaatacagttaaggggtaaaagttgaggtatttcctctttgcattgtctaatcaaatatcaacctatcgatgatatgggcctaggggtctcaagactagagggaggaggctgcccccaataccacgtggccctcccccgaggggagtcaggcccgaggtgaggcggaggccactccctcatgtgactaggggtcgggctcccccgacccccttagcgggtcaccacgtgcggtaggttaggtggccaccttcgagcgctcacctacccgcattaatggtgacttgagcaggcgcgccacgccgcattttatatggcgtgtaccgcgcgctaaattggtctgtgactggtcaaatgaccgacgggactcgaggtgttaggcgtactactgcatgggtcagggggcgtgcaccttgtcttgtcccatcggtcatgatgacgagaggtcttaacctctcatcccggccagagttggtccatccgccctggtcaattggggattccgtttcccggtgcaaacagtgacccagaagtctccacccattaatagcagctgacatgggagcccctcgtgtcaggcggcaagatttgacaggccctatcatcaagatgacgtgcgcttgctttccaagtcaagagacaagacagacacttaatgcaaaacacttctccaccggagctaggtttttgggcccatgtggtaaccccttgaggtataaaagaaggttcaggcctagtaaaaagggggatggatctgggacgatccatttgacgctctagagcagtctctagccccggatgatcaacaccacattttactccaacaagaagatcttgtaatccttcactcaaggagcatagaacaggagtagggtattacgcttcttagcggcccgaacctgtataaacccttttggtctcatcgtctttgaggggcttgaccccctcaagatcacactgctttgctcaccgaatccttgaatctcacccgctgcccccggtcgaactcacaaaggagggcctcacggcctcccgctatagaaggtcactcctcgacacaaccctttatcttaatataaaatcttatcacaatataaactcccacagcttctaccaaacaatggattgataaaaagaaaatcatgatatcctcactactaattccctacctaaactcctaatgctctctcctaaaatttccaaaacatgctatggtattaaaaacaagagtttgaacgggaaccattggcaggtgtggtgaagttacatgagtatactcatagaatttaaatcttggtacccacaaataagttgcacaccagaccgagatggcacatgcggaattggcatgatcctttgagattgttatggatcctcgattttttcagcatgtcgttccatcgatttataaagtggtgctttgaagacggaacttatggcttgtgttgagggaatctatcatgccatgcaatgggcaatggacgatgcttcctatagttgtggaaacatattgtagtgggatgatcaatatgcggttttctaaggagttagaccgaccaatgccttttttttaaaagaggttgagttccttatggtcggaaataaaaaatttgtattaaaaaaggttcaagctagcaaattatgttagttgtgaagcaagctcaaagtttttgtgggtaactcttgtaaactcatctcacatgttgtgagggaggatttatcttccgattaataaatttcccgtttcaaaaaaaaattatggtataagttgcataaaatctcataaccccaggtattatgacacaaaatttcgcaaaacaacaactatttatcatttgagtttgatctgcgaaactcacaatcatatctcaaatttatgagttatttatccatcatataaatgttacatctatgtaagattttaatagagcatgtcaatttggttaacggcataactgctaagctttaagactataatacatatgattatgtgccacatcaaaatctaagtggttttgtgtaagttgaatcataatagactatgttttataaaatttactctcaatataaatttagtaaatcgcacttctgaatatatgaatgcggtgggtatgtcttgtgtaatcggataaaaaaatttcctaatctgtttggcacagctccagcttcagctcctctcctcctggagctggagctcagccaaacagttttagctctaccaaaaatgggagcggagctgagtggagctctatcacaaaataaactagagttatgaagctggatttagacagcttcacaactccactccagacctaactcttaaagctaaatctagcagttggaactgtaacaaacaggctgtaacggcaccgtaataaacccaacgtcctagctggaacaaatttcttatttgtcaatagaaaagttgaggtcgcgactcgcgagtatatgaggtggaaggataggtttatttatcattaatccttttaatttcacttaagtcaaaaagaaaaaaatctatactccgtagtgcttagctcagcaagacgacgaatttagaaagcagagactcctgcgccgctacagcaaagcaaagcatctcgcgccctagccaagccagccatggcgccgtcgtcgaggaaagagagggcggcggaggcgagggcgagcacctccaagccgtctcctgcgccggccccggcgccggcggtccaggtgcagcggcggccggtgggcgggggccggtggacgagccgccggatatcgttctacgcctcccgcgccttcttcctcctcatcatcctccagatcccgctcttcaggtcgcccccttctcccctcccccaatcccctctgatttacctctgtttccgtgtcgatcgtgcgctgaatcttagctaactcaagaacgcctgattaatctcgtggacgctggtgctgcttggcgacttggggcgtgattaccagatcaagaacggctgggacgcagcacacattcgtgtaggggatgcagggtacgggccttagataggcataattgtggtagaattccatcgaattcctcgattccatgcaaagcctactgccctaaatgttgtgttgatggggaaaggtaggcggtgtactcacatctcgtcagttacccttgttggacaagaagctgttaaagcctccatagtttcaagcggttaaaagcagccatagtttctcgatgtgcagggtttcagtcctcgggccgaaaagcatgattcaggttgcaaaatttggtagaaggcgagttcaaattaggcaaaatttgccacaggacactcaaaaaatgtgtaattggctgagagacaccgcaaaaacgtgacacggctaatggacactacaaaaaaaatttgtgtaattagctataggacaccagagacaatattttataatttttggtcaaaagaggtgagcaatttttcgaaatggcgagattgcccttggcgccatcttcctccacctgaaatcacaaaattagctgggagcagccgccgcgcaaggttgtcgacggcgaggcaggaggaggccgcggcggcgtggagcgcgtagaggaggcggctgcgcgcgaggccggcgacggcggcggccgcgcgcgaggcctgcgatggcgaggcagttggcggccgcgcgcgaggctggcgatggcggcggccgcgcgtgaggcctgcgatggcg

SEQ ID NO: 59715 - DNA, 692 bp, Oryza sativa
ccaaagctttacaattgaacatagtttccaaatgactttttctctgatatgttaccttcattcttaaacagatgacatttttgaacatatgcaagctgtcaaatattaaaggaaaaggtttattctacaaccttgcgcttttaaccatggtttagaaattcaccctgtaactttctaaaccgttcatcctaccgtcataaactgaggtagtgatgtggttttggcttattcagtatagtcccccatccccatgccgttcccctattttcttcttgctcctctcctcactccccttccccactctgcttcagacccccaaccaaagtacccaatcactgtgtctcagatcatccaatggaggcaacagcggaaaatagtccatatgccacatctttgttcggagttgtatttcgcctatggcttaaggtacgggagaaatttcggtactatatatttaagaaggttgggtaagttttggtgaaatggtggtgaagaagttgtggcattatccaattattggttatgagtaaacctccttttgtatattattttagtgctcttggttgataatatagtttattatgccttgtgcaccaataaccctctatgtagcttggttatcgaccgttgaataaatggttcttcagtttatttgtagaattttagctccttggataaaattgatgggggcc

SEQ ID NO: 59716 - DNA, 2588 bp, Oryza sativa
caaaattggatctatagcaaagttatcttttttttgttttgtagcatcgaaagttcattgttcactttagtagaacataaattcctgccttttccctacatagcatttccatcgctccaactccctttctagttttctttgactgaaatcgacaaaaatggcaagacaattgacactatagggccaatttattcttgtccctattttgatgttcaatattaattttgcctctgctttttagggtttttgtttatgcccctggtttcttgaagcgaagccaagttttatctctactttagaaggagatgttagctgtgttaaatttttagcaaaaagacatccatacccttgcttgctactgtacattccgaactttggcagattcaaatcatcaaagaaaatctgacagattctagcgcagcaagaagtggcataagcaataaagcaagcaccagctccacatcttttcttcagctagcaagcaaccagcaactcctcacctcttcagcaagacagttgggcgttggcagcgatgccgcgaggccgtgagagacaacagcatgacgcctcaccgacgttgtgccgccaagcaggaaaggccacgccgaagccatccacaccacgatggttggacgtaggggtgaaaatggagcggattcgaacggatagtagttataccatatcctaaaccatattttttaagcagattcggagcgggtgcggatagtgtacggatgtggagcggattgtttcggatgtcggaaatggtgcaaagtcggtgcggaatcggtctggaaacagattaaatttatcggatgttacgtgtgtatgcaatcaatacaacatcgagttagcaatccaaggaacattaatacaataatcaataaatgacccatcgtaataattatatgattaagtgctaaacatcatgaatacatgatgtccataatataaaaactagtaatcgtgcacgtgcaaggcacatcatgcaaatataaattaacttgagatcagcatatcaccgatatgacaacaataataagtttattaaatttaaagtgtacgattcatttcacatcaaataaagaataaataaacatatattcaagccatgtttcattgaaatacaaaagcataagataaaataatacaaggtcctacgttgtatgaattaaggattagacagaaaaaaaaaacctcaaggttcaagagaatgtggaaaatggagataaaaggcactttgatcatccgatgctatgggtcataaaaacattgtgcttacaattgtataagaaatggccacttttatgtgaatgtgtgatcctcaacttctcctagaagttttaaataaattagagttgcagatatatattatgatcatttgaacctgacaaaacagcacaacatggtcaatcagctttgttagaaaatacaaaaaccctgcaatatttctagaaaatgaacagctaacttgtaactccaagtagcatatattgcaacctgctcttagaatagctttcttttttaaaaaaaaaaaacttacacttaatgatacttagacaatgtaatcccaagcttactgacagtgaatcgataagccaatatctgattgaacatagagagattttaacgaacaattgtgcagaatatgaagaatgagaagaactgaagatacaactaactcgtttgttttgaaacaaaccattccctcaagctagctagcaacattgaaaaactaacacaacttgcactgtacttatgaagtgcatgcatcgtatcgatcaccagattatgctaaagagatccatcaagcaaggatgcatttagaaaacattcagattaaaatcagttatgatatatagttcagctgctaaaacttttattgaggtcaacaggttacaggtagcgaatgactcagaaccaatccaatgggccaatccgtgataaaagaaaaggtggaacccgtagatctttatattagatgaggttttatactggtgtgatactggaatatcagttcaagctattttctgctagctatgtcataataaggtgtgagatttgggtacctgttacactttttttaatagcagcctaaaatctttttatcatcagcaaattgatccatgtacacataaggaccacttaggtaccacgaacctgcagcacaatgataatattcttcaacacatcattgatttgcttgctcagggatggaagaaaaagtcaagggggacaacataagagcaatcagacaacaatatcaagaaaaacagtagttacctttttgtatttgtgaaatttaaagaactactactatgctggaccatgccaatcaaggttgaaaataacaagccaatataaaggcaaaattaattagattcatggaatgcaatttggttgcacgctcctagcgcagaggtcgggaacacaacccaccttgtgcttcaataaaatgtctctaaagaaagatgcatcatttcttttaatatatctgtctttggatccactcaaaccaaattttaagagattggtccttggacaggttcattgtgaggcaatctaagccttggtaatgaaaagataaa

SEQ ID NO: 59717 - DNA, 904 bp, Oryza sativa
tttcattattatggcttctagatggatactatacgtatgtaatactattgtgtgctactaatgagacaaattggagataacttggtctcggaatatggtttctttgtttatttcatgtgtaggtgactcgatgcactagagggtttcctaagggttttaggacttctagtatgagtttggttcgttactttaggctgcctacctcgggtataaatagagggggagcgtgaggcttccggtattgctttagagagcaattgagttgagttttgagttagggttttgagtttagtcgaatttttttgtaaggagtgctgttggtgcattttgtaaacacagagagaatcaataaagtcgttatccactttaagagttcttcgatttgtgtttaccgggttttggcggtgtaaccgacgatataccggcggcatacgggcgatcagaccggcggcggcaacagtaagcggcagctgatctcggcggtcagaccggagatctaatcgcggtcagaccgatagcaaccaggcggtcagaccggcagagcaacttcggtcagactgcgatctgtcgaattcgagggtaacttttatttccgctaaaagtttttggttttttggatatatcaaccattcacccccctccgggtggcttagttattgtgattcgatcctacaagtggtatcagagccctgttttctgctttggatttttatcgatttagagtttttgccatggctactcctgctaggttttgaactaagcctcatgttttcgatggaacggatttttctcaatggtgtagtaagatgcaattttatatttggagaaaagtttctcattcttatgtgattcctgaagctattaatactgctgctgaaaaaactgcgtttgaacaaaattgtga

SEQ ID NO: 59718 - DNA, 1055 bp, Oryza sativa
tacctcaaagtatggctaatccatgtttttagcaataatcacattacttgatgtggtacagagttttttttggcaattattgataacaaaaaataatcatcaatgagaaatcattctgctaaactattacatttcaaacatcaccatttttagggctgtgctttgttaagatatacttcattggccaatatttcccaatctttttatactatttcagggctcagccgttttattgccaaaattaatattagcctttgttgtttatcttgtcattcattcttgtatatctcaccatttattgtttccatatcaaacaagaactcaaacatatctgccaagataatatctattaatagcctaaaaaaattttctatttcccttggctttatcctcatcgtttcctccacctacatgtacatctcaccatattctccccaatttccacaaaacaatttagagagaaaaatacagatcagaagaatgcttcaggttcaaggctctcttcgtgtccacactttctcctctgctgccatcgtccatgccgttgaaacctctgatgaagattctgatccatcccacttctgcgccgtgccgcagaacggtaagaaggcatcgaggaaggagatcaagaggaggataaagaagcttctgtcatcgctggggcagaaacaccacatctctaaggtgttcttcagatcacgttctgaagctgccaatagcaatgctgtcattgacaacagaggtggtggtcagagtgacatggagacttttgtgtccgcgaagagctccgagttgtgttcattccgtaccgatgatgacgactccgagtcacgatcgtttcgtctcagcccgttgccaatcttcccaaccggaggtattgaattccagccacccgcctctccagtgaagataatcaagaagctcccatttgggtatatcatcggccgtcagctcgacggcgcccccgcagcagcggcgccatcaacgaagctctcattgagcttcaaaaagttgatgcataggttggttgataagtcaaagtcgaagatgatcaa

SEQ ID NO: 59719 - DNA, 559 bp, Oryza sativa
ttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctct

SEQ ID NO: 59720 - DNA, 623 bp, Oryza sativa
catgcatcatgtgttttctttctgttgtagctgatttgagcaatattaactgcattgcaatgtattttctggagtaactttgtatgcaaccgtgggttccaaaatggtgtactacttttgcccggcagaacttcgctgctggctcctgcatcaaaatgatggttatgccacgaaatgtgtatcggttcgtgccatatgatttgtaactctgtatttccctgcgttttagttctgtcatggaatgcgtattcattctccgtcgatgcatccactgaactgcagtgcaaatgcagtcagtgctcatgaagtttttcagttgcaaacttggaatatattccacagaaccacagaacttgcggtggacgaagattaactgcaggtacatgattaattgagggttattacctcaaatattaaaaaataatttatctaataatttaaaacaacttctatataagaaagttgacaaaatgcactgtctagtagtttgaaaaacatgcctataaaatgaggtaaatcaggatcactgtatcacaatgagaaatgaaccgactatgccctttttttttcttcttcaatcgatttcaagatgcactatggtaaacgactatgccatactcttt

SEQ ID NO: 59721 - DNA, 6305 bp, Oryza sativa
acagcaaccgtgtgtcgcagtactcctgcggcacgggcttttctagctgaacttccttgttagccgagtcattagatggcgcttcttttgatatcccattagttcctacagggttaggatatggcggatcacgagtggacttacctccccttgtcgtgatcgccttaacattttcaacggaggagttaggttgccccggaatcctcccagtatcatttgcagggactaaggatgccaactgagctaactgggtctctatcatttgattgaagctcagctggttttgaaaagcagaagtgaagccatctaacttgacattaatgttttctaggatcttatcattggcagcaagctttttgcttagcgcatattggagtcgttcctcgctccaacccatattggagactatcttctctattagttcaatggctccttgaaccgttttagacaagaaggctcttctagctaccgtgtccaagtgatcgtgggacaccggggtgagtccattgtaaaaattctgcaggattagccagtcgtccatcccatgatgaggacaggcggccacgtactcctgcagttgttcccatgctttcggaatagactcatcccttatctgctagaaacttgaaatccttccataaagggcattggttttgcccatcgggaagaattttgagaggaatgccatcaagcatttgtcccaggtattgacagcagcacggttggcataaaaccactactttgctttcccgagaagggagaacagaaacagtcgtggcctgatagcgtcgggactgacgcccttgatggtgtacgtgctacagatctccaggaactgttgcagatgagcattggcatcctcattaggcttgccacagaacgggctagccggcgtcatcgtaatgaggctggacttcaagttgaaatccatacccccaatgttgacctgcggcccaatggccacattgttagtagagggagcagcgaacttgcgaagagtcttgctcgccatagtcttgaaggtcggtggcgctggtatggctggtttctctgttggtagagttttctgcggagcaacgactcgtggtctgacgctccgaaagacagcttccggcaggttgaaaccagtcatgtactactctgttctcacaacaaaagtaaaaacaaccaaggttagcctgcaaaggaaaatgattacacagaggtaaatataaagttttagttcaagtaatctctattatgaatcttccccggcaacggcgccagaaatgcttgttggtatttcttaatgacattactagaaatataattcccagcaatggcacataaatacttctggtatattatggttacagagttcatccgcaagcgcacggatataccattatagcatttcacccaagagtattttaagggtatcgtatttattttatcccgtgggaagatcatgtagagaaaacttgactaataatttatatattacttgtgataatcatattctaagcatgggttaaggtaatccaagggtagagtgacacacaagcattaactaatcattctcataatatatcatctaagctaagtcgaaagaaaagagaaagaaaatctattcctatacttctaatatacatagtatacatacattctagttaactgatatactagctaataccctctatccgatgccctcctggtacttcgagaagccacccctgactgccgagttccttacgacagcccgtcatgaccatacaacaggggctaaatatggaggaataccctccccagggaattaatttaggattatataccggcgcggaggaataccgtactgagctgtcaccattagcggcccacttctcatccacaatatataaccccaaataatgatatcccataatctagacaccacgtctaaactaccagatactactctaatatcatcgtcatgacatagagtaattgcataagcaaacattatacccgcaccaaagcatctcccagataagctagtcgtatattcagtataacatgaacataatataaagtaggtactcatatactcggaaactatttcaataccataaatgtatatagaagagtattccaataaaagtacaaagcttacaaaagagaagagaaaagctactacagccatacccgaactcttccaaaggcttccggactcctgatttctactctattccaattccaccagctagatactactaaactaaacttgagagaaatgagagagctattgcttgaggtgtgtgttgaattgaagagagtgaagtccttatataggctgccaatgacggttgtggcagttggaatggtcggaattgccttccaaccgtcattggggagtgatccacgccgtccagccagaacctggatccaacggcgccaggggaggttcggccgaaccagggccggcccatcctggcccaaaatcggcaggtggcctcctgaacttctccactccgcagacttgtgaattttggcccaattcatcgtgtcaattctgagttcttggcctattcatacataagtctggttctcgacatcatccaattgatttatcgtctgagttgatgtcgattctcctccactttattgtcattctctgcaaaaggttagtacacctaatactagtggaatattattattctaacatatttatgcattgcaagcatcactagttctcctctattttggtaatattgatggttgaaactgatcaataatgaccgtcaacacctacatatccggggcactgattacgggcgctcgtccctgatccaacatattacagcgtatcagagttctaatgactcacggtcggttgccgccggtagcagctccctctcgctatggtaagtcgccatgcggttacaacaggtacgcctctctatacctagtagaactccaagtcctaaactgtaaccgactacgtacacatattcgacacaaactctaacagccaccgcacgtgaatatcgttctcccatttttacgtacgaacccttaagaggacagcacgcatgcgggcttcttaagagcatcgcacaggaaaataccctccctcctttttccctctcaacacttcaaaaattccatacttatcctccctccaactctctcacctcctcatccttattctcacctctcctctcactttctctcctctcctctcaagtgtcgcggcggcaggcgagtggctcggcagcgggcgacgggacgacgaggaggtggctccgcctcgccgcctccgccgacgatgaggtgcctgggagcggcgcctttggccccacgaatccgcgccacccccgccgacgaggaggaggaggtggctaggagcggaggcagacggcggcagcgcgtccgcccccccggccctcccgcgcagcggcgcccctccgtcgttcggatctagtggcagcgccccttccgccctccgcccatagtatccggctttggtgcccctccccacgcggatccgggggtggcgactgcaaggatgacgacaagctacagcgacggcaacgacggcgacgagctgtggcggtggcaactagggtttgcgatggcggcgacggcaacgactatttttttggtggatttttgttttcgcgtgtggtcggtacaaatggactgcatgagataatcgattatcccgtgcggtccacttaacacgaccgcacgggaagatgtatttttccgtgcagttgggccgcccgcacgcgaaaatatttattttcctaggcacctgggggtgcagacgggcaagacctctgcacggaaaaacactttttgaccgcacggaaaagtcattttcgtagtagtgacatcgtgtggtattttacatctatctttgtgcgagaaggctaagtcgcgactggtcgcgttgcgtgcggagaggagggcagctgacggcgcggtttctttttttctttttcgacgctttcttttttttccggcgctctcggtatcttttttgttttttctgttttttctttccgtattttttgcagcttacggtttcctttttttttgtttttttctgtttcgtctttccgtatctttttagtattttcgcttttttaatacgtatttataaaactttgtatatgtagacatataaactttgtataagtgtattttttagactttttatatgtacgaacacaaactctatgtacatatgtatatttttatacattgaagtgcgcatgtatattgtatatacaatatacatacgtataaatgttgtatttacgtatacaaaatttatacgtatgtatatagtatatacatacgtatgtacactagtatataagagaagctagagagactagggggcagctgatcgcgcgcatgcgcggccacacgactagccgcggatcagcagccccttatctttgtgtacagtatgtctgtttgcaaaatagctttcaatttcttgagaacacagtcagtttgcaagctaaattatacaacctgcatgactgacaacctacataccataaaactattgcaggtacctcctatagtaacatttctgctaaccaggctctgttaaaactctgaaactcaggtatgcctttgttagttatcgcttttggaaattgaatagcctgagtgagagtccaaaaaggaaggcaaaaagaacagcaaatgagacaactaccatagccgggacccacaataactcatgatggaaaccaaagtagttcttgacaaagtcagatacacgctctccatcatcaaacttgtctgatacatccccaaactgtgaggtaaccaacccattgagcgtccatgcaaccgggcatatccaatagtaccatctccaccatataggaattctctgtagataaaaagagccatattaggaaaatcaatggctttaagataatttggctagatatttttgaaaagctggttcacttacagttaacggtattagaaatcctgagaaaaggttccacatggtataaaatcctgtggaaacaacagtggacatgttgtaatttggagttagacccaccgccatcatgccgtaaaatgtgtagtatgacaaagtgaagtacatgaagaaaaggtaccaaaagaatttggcacctgaccactcatatcctatcattgcatacactagcatgccatatattatggtctgaaggaagatgtacggaagttcaattgcaacctgcaatggaactatatgttaatagggcttattgtctggccattagtttccccatactgaggggattgctgatgaaattgagtagtatcttacaacattataagagactcatatgtcgaagaatttaacctgtcccaaggcatatggcaaaggggagtacatgtgcgatgctctttctctataaaagactgtgcgctcaatagagacaattggttgaactgaagcagagttttgtactcccatggtcaaacatgtagaatacatggaacccatggcgctgaacaaggcctgtttattattcctgcaacagtggaatatatctagtaaatggcaatagatgaactagaggcagcctttgaatatgtaaaagattgtatacgcactattttcttgtggtttttatattactttgttaccttttttggccaataccccagaacattgttccaaacaacaatgcaactataatggtgaagaagtatttcacagcaatatatcgaggattacgccagtatgacagacgttgcttccagaggcaagccaaacattgtgtaagaaagggctgtgaatattgagttggaaatgataagtcgcttgaactttcatggggcgtgcttaactcctttatcaaatttttgttccttctgtaatgaaagcaaagtaccgacatggtcaaatgataacatttcctattgccttcttcataaaattgaaaaattgtggcacttggtgataacttgaagcatatccattcaatattatgatttcaggattatctgcatttcaattttttttcatttgctgttaccttgtctagttattacaaatggaaaataaaaaaattacattattgtccttttggaatgttgtatttgtgtttttcatatcttagtatagaacataatattttgcatatgccaccaacttggacacacttctcacttatagcgttatggagccagtcatttggtgcatggagtaaagttcgctttgatcttaggtgttatgttagtggggcaaccattatagttccatgatcaaactatattaactgaaggacaaccaggggcggatttgccatgggggcgggggg

SEQ ID NO: 59722 - DNA, 635 bp, Oryza sativa
agccacctggagcttgtttcacttctccatctttggaagaaccagtcccaggactatcagcaaccacttttattttatacttctgaacaagtgtccccttgcgggtctgcatgaatgagttcagaaactgatcccgtgcctgctgcagcgttgcttcaaactcctccttctgctcaggtgtgaatttctctggatcgatcggcatgacgttgtcatcaatgatgtcagtcaatcccagcttcaacgccttgcctttaacggagcctgggctagatggtggtggtggctgtttctcggccatgaggaagaactgacgtctgacttcttagaggtcccaccaggcgtgccaaaagcgtgttgacagaaaacacgtggcctgggagatctgcttaactctagtgcaggtccaaagctcgccttcggatatgttagcgtgccagttgatttgatcctgtaatcaacaagaaatagaagcaaagaaaccgtggttaaatctataaatgatagctgatcagctagatgccgatgacatatcatttatctttgagccgatgtcatctgtgtatcgatcggccgccatgaataagtaaagaagaactaaatctattcgatcggctgtagatattaacgatata

SEQ ID NO: 59723 - DNA, 1115 bp, Oryza sativa
ttaactcatgagtgatattagtcttctccgcggacgacgactcgatgatcagaaaagtgacaccaattagacccaaaaccctcccaattccccccaatccgactgagactgaaccacaacgattcatttttcagaacacttgatggttgtgtcaggcattgactgaaacaaaatgactcgcgtatggtttggtttagtttcgctcgtactgttcgatttgtttgcgaaatcggtttcgttcgtactgtttgttttggtttctactttgtgaaatcactcgtttgctaaatttttggtctcgaaatcgtttccctcgtccggatttgtttactttcgcccgaacgtgtttgtttctcttgtacggtttggttcctgtgcgaaatttctcgttggttgcgaaatcccatattacggatttgatctgaattgattaggggttttaaaatttgatccacaggaatggccgatgtcatcgacgagcccatggtcgaggcgttcgcccgactcgccctgaaggcttccctcgctcacccgagggtgacatgggggagggcaccccgcaagtattttgggaggaatcgactctggcctcgcccccagaatccgcctggagctcgtagactgagacccttctcccgctaccccttcacttacatacccgctgtgagtttatctagtgtgatttgtgctgtgagtttttactactgtgatttgtttgttatgcagatatttgggatttattgatttggttttacatttgatggcaatatttaattgatattctgatttcagtctagttatgtttgacattgatatctctagttcaaagtaatatagacagattacaaactatttcattgttttttttgtccaggtttcagttttaatattctcttacagcgcactgtaacttacaataaaaatcaacaacaattcagtttatataacatgagtttataaaaatcaatagttattgagtttacagggcatgaaagctgactggtatcacaaatgtactaaaaatgaaaagtttatataacaaattaactaaaaatgggtatatgtgagtttatttataaatatgtttgtgatttagcctttggttctatgtgatt

SEQ ID NO: 59724 - DNA, 27624 bp, Oryza sativa
ccccactaccgccccagggtccatggagacccccctaagcccccactaaaatttttcacgagatgtggtggctggagcttcgtcaggttggctggagggaaggctggaggttgaagacgatgttatttcgcgatttgggcttgtttcgaagagcagcccacgaccacgagcgcagtcttcaagttttgtctagcccactccaagcaaaggcccacggtggcagattccagccagcccatttggctactccccctcccggcctcccgcctccccaattccccaatcccactggccacctcctcctctcctaaatccctaaccctaggcgaataggcgcgggcggcgggcggcggccgagcaggcggtggcgtccggcgaggggccagacgggaggcgtgccaggcggtgccccggtggtccagtgcatgcccggagcaggtggcgacctccggtgagctgcaagcctgcaagctggcgagcgccaagcggcaaggtgccgtggcggcgtccagtgagccggcgatgggccagacaggaggcaggccaggcggaggcggtggtccagcactccagtgcctgcgccgccacgccgccgggaaggtggcgagccgctcgctggcgaggtgccgcgagggcgcaaggcgccgaggcaggcaggcagcaggtcagcggcacagtggccggcaaggcagcaacgagtcaacgacgcagtcgcagcctactgtgactgtgattgaagatttgaagttagaaatcggtaaactagtaacctctaatactaatagatagtctaaaattgtgtcttaatgaggttgtgcacttgtgcttgaaacttataattattttctatacatttttagattgtcaacatgtcaaaaaaaacattgctcacgtattattttagtttaagcaacacaaatggcagtgatcctccatccagtaaagtgatcctccatccagtaatgagtgtttaagttagccaaagaaacccaagtcagggttttttcaatcggatgaaaaaatcatccaacaatttgaagatatgaaagcgcgtcagatgttattacctcaacagaaattagtggtatgctctatgcctccattcctccctaaatctctaaattatttgaatccaaaataagtatgtttcgattattcgttaatttgcctttttctttgtataaattactactcatgaagaataatagacgattgggtgtgacacgtcatctattcgatattggtttggtatggacaaaattctcgacatatcattaattcaatgtgtaccttgaactgacatttagccaatttacatgtgagacatgtttcgatttatgctggcgtaatttgttcagcccccactactattttttcctggatccgcccctgaggacaacccaatatatagttacctgtatagttcagaattcttgtaaacttgagtgaagtttacgccagttttttgttcttgcattgggctagtcacttccaacatccatgttgaaggattgtagccatgttttatcttgctgacaccttcaatagccttcagaaaataaaagcgattcaatagcatgtttctcaatgcaataaggcaagcatatattactttctattcttttttctaacctcaaaatatctaatcaattcacatgaatgttgtcctagtggaccgacataaatctcttcgcctcctcgtttcattaggaaaagctgcaaatattaacaacattataatgaattgagtggatcagcaaacgatgttataacccaccaacaatttacttttccttttgtctatgtctgcatgatagaaaaaaatggactatacaagtatgatttcattcacctcatcaaaggattcaaatatatcaatgcttggctggtgaattgtgcaaacaactgttcttcctgtgtccacagtattcctaattgccctcatgacaatggctgctgctcgtgcgtcaagtccagatgttggttcgtctaggaaaatgatagatgggtttgcaactagttccactgctattgttagcctttttctttgttcaattgataatccgcttacgccaggcaatccaaccaaagcatcttttaagggataaagctccacgagctccatgacctcctcaataatcatctgcatataagataaaaaaataacattatctaaaaaaagattaaaaaaacaatctggataacatgtaaaagaatacatgaatattcatgttaaatacactgccatgaaataaaaaaattcattgctatgaatattcatgtcaattttatttttcatttatagcattctatatcagttcagacaacattttcttttttatgcactactctgtatttgaataaagtgaaagtattttctttatctgacctttcttgttgcagaatcaattttagtaggtaatctgagccatgcagagaacataagggactcataaatagttacatttggtgaatggatgtcattctgttcacaatatcctgaaactctagcaaaggtttcttgcttctttgggtagccagagatggtaatattgccctctatgtatccactagtcttccttccagccaacacatctaatagtgttgtctttcctgcaccgctgacacccataagagctgtaagtactcctggcctaaaagagccactaatatccttcagtagttccaaccggctctctgtagcttgtgttttcagtgcctacaagttttgtttggtcaagactattttttttcaaagattgctcataaatggtacaaatagatgcaattttccatatggaacatgcatgtctggtagacttggcaatatttggggtacctctggcatgtctatactgtattttatatcttcaaacgtgatggaaagaggtacaaatggaaggaccattcctttaattcctgaactagaattccctatcatgtggtttgaagttgcctcatcgttgttaacgtccacagtacctggtacacataccacacgcacatcagcaataaactgacatctcatgtttaaactttagattagtggtccaaaaaaatatttacatcttgtattgtcagtagcctgctctccagacggtgcttccaaaacttgaccagtgatattagcttgctttttatggaaagtttcctgggacattattggctggttgttgttcaatactacagagtacatggtgcaataaaattagaatttgtagatcttttagaataatagcattatttactaacaataaaagattcaagattttctatgactcacatgtgagaaatatgagacagatggtgtagaggacatttaatagaatcacatatccgagcaaggcaccaacaccaatccaataccatttggcctcaggaaaaaacccacgagattccagaactagccttccaagtggttcgctaaaaccagatattgtctattgtgtgatgataagcaaatgttttagcgagacatattctgatgtatggcttttaattgatcgcataaatatgcttttaccttgttccagctgttacctaggaattcattaactgccaatgtgttcagtgcatacataaggggtgatatccagtaaccccatatccaccatttcttaatttcctctgttaaacataaaacaaattatattcataaaagtaccacatccaataaagaaattatgtaagaacttatccacatatcattgtggtgtttcatagatagtttgcgtacctcttgataggatgaatccacttgaaagcatagaaattaatatgcaggatgagcccatagtacttgccacaaccggatcccttgtaagggaagcaatgaagcggaaaagtccagatgttgcctcagacataacaaaaagcgctaggaattgtctaaaaaatctgcatcattttctttgtttttattaatcttttatttaacatgagtttattgaagctagttagaatttcgttttccttacctctctatatttgggtcaaatccaataacatagtatgttaggaagacccaaacaatcgtattgaggaaggagataggggtcttaaggatccatgatggcaaggaatacgtccaagctggatagaagaatagatcccgttgcttgaagaaaaccgggagctttgcaatagctaggcccatttctgccaacccattgaacatgatcatcaacatgccatagaactgtgctcccatgtatatcctcccattttctatggagtcacgatgcatattggtacgcataaagacagtcattgtatttattgccatgactgttaactgaacatttcagagaaaacataataagaggccaaattaacttttgatcatttaaattttataggttattgtgctggtaaacaatggaagatgtgctggtttcagagaatcaccctaattgcctggaatatatagaggaatgagtttcttttcatgagtaatatttccctgtcaatgttagcttgaagtagttctttcatgctaacaccatactttgatgttctcagcgcagcaggatggctcttgcccttgccaaatgggactaccaactcagttcttactgcttgaccgacatgaaaagactgaaatgcctcagcaatctctgcagcagaaatatatcggtatgtagaatcaccatgtgtccagtattgtttctgatctttccttgatgtaacctatcacatttcacatataataagtcagacttaagcattcagatcaaatttaatcctatgattctatcatgatggaaatcagtgaggaaactaacttcctgtaagaagtcagcgacaccttttcgctcagggcatttgaatccaattgattgaaagaactcaagcacatgatcacgagggccattgtagacaacttgaccatctgagaggataattatttcatcaaacaattcatatgtctcgggcgcaggctgtagcaatgcaataattgtcgttccaccaagaatgtgaacagtctgtcggatggagttcacaatctggaatgttgtcgagctatcaagtccagttaatatctcatccatgaaaagtgctcgtcctggtgttaccagcatctccgctgtagcgtcaatattaggaggtggattagcttttgtcaccatatgccaatttattaactccaataataaattacctgtagttagtcgctttttttgccctcctgatatacctctcaccatattatttcctacaattgtgtcagcacatatatccaatcctaagatcttcaatggttaaaaacaaagtaaagaattattatggcgcgtacatgtcaaattacatgggaatgacttgcaattttcaactatgaatttattgtaaattaaaaaacatttcaatacaagtacataatgctcattcacctttagtatgtgatttgtgaccacctcggctttctgctctcctgttgtagcagcttgcatatgcaaaatgagaaattaatgttcctcatgaaatcttatgtcagaacatcaatagatgcttaaaaacaactaagcataactcaactctggttgaggtgagttgcgatttatgaattgcatcgtaccttcaaatataaatcaatctctggatctggtttgatgttttcttccttttctcttctcaatagttccattagcatatctgaacattttgtaaaaaaatgttaatattttgatctgatatgacatttatgattaatgagtctcaaactcgccatttccatatcttaccatagtgatggccaactccttgacactttgcagagaaactgaccgtctcacgaaccgttagttcggccatatgtaaatcatgttggctaacataagctgctgatctttggggcacaaattcatccattgtatgaccattataagttatagtccctgataccttttgtagttgcagtgtttcatcatatcagtacttcaaacagccctatatataggtgagccacatactacataggaaagcatgaaagatgtacctttacagttgatgggagtgttcctgctaaggccatcagtagtgatgtctttcctgagccaggaggacctaaaagcaatgtcattctgaaaacaacagataaggttaacttatatcacataaattatttggaaacaatcaattactaggaatttacctgtgaggctttacgatcccactcacattgtgaaggatcgatattttttgcttcttttttcgtgttatgtgaagagcgttccccaggccctgtttggaggtgagtgttgtcactacacatggaaaatagaggatgctaatgcaatcatataaaatgaaatgaaaatcccagcctctgcatgcttagtctcgtaactacaggaaatctttctggattccttgaggaaattggcacaatttccaaaaaaaaaaaaaaaaaaacttaggcgcattcttggatttctcatatttttttggttttgttaaaatatcaagacttcgattgaatatagaccagttttctgttttttagattactttctgacatataaaaacatatttatatatagatcagttttttgttttctggaactatttgttcgaatatatgtgtacatattatttaaaaaaatattaaaccgtccgtttcccataaataataattttgaaacattttttttattttagcaattaatttggaacgtctacaaatggactaaatatacgtacattaaccatttttcaaacttgcgaaatattgattttaaatttgtatatgtgaaaatatatgatgtttatatgactagcaatcaattcatatagaacgtgaaagtcataattgtgaattcagaaaatctgtatttaaaaataatcatcgctaagatggattaatatttcataacaactaaattcgaaacttatttgctaatgaagtcttcgttttcatgcaaaccattataattcactccaacaaacagatgcatgcatttgctttctatatgctcgaaattattaattgttaattaggaattaaagactatcatgttgtattcggcgtggagcttgttttaatctaaataaattgttataatttggacctccgacatatagatggacaggtgttttaattattaacatagttattttctcaaagtagatgcagatacctcgaatatgttagcataggtattgaaaatggtgggaaaacctctgctgccaacatatgactctgcttccacatttaagttctcataccgcacttcaatagtcggaagcttgattccaaccctgcacaaaagaaaacatttctctgaaaaggagaattgataagaaacctttctcagttggagaatgaagctttaacgcaacctttctctgaaaaggagattaaggatgctattttccatatggagcataataaagcaccatgtccggatggtttcctggcggagttttaccaagttttttgaaatgttattaaaaatgacctgttggagctttctaattatttccataagggtgctctacctttgttttctcttaattttggcacaataattttgttacctaagtgtgttgatgccattaagattcagcagtatagacccatatgtttactaaatgttagttttaagatttttaccaacgttgcaacgaatagaataatgggggttgctcaaaaagttattagtcccactcaaacggcttttattctaggtaggaatattatggaaggaatggttattttacatgagactatgcatgaattacatcataaagataaaagcggtgtaatatttaagattgattttgaaaaagcttatgataaagtaaaatggtcctttgtacaacagatgttgaggatgttgaggatgaagggcttctcgcctaaatgttgtgagtggatagcttcttttatttaaggtggtcatgttggtataaaagtaaattatcaaattggtaacaattttcaaacatataaaggtcttaggcaagggtatcctttatcaccaatcctttttgacatagtagctgatatgcttgctctgttaattaagagagctaaagaggtgggtctcttaaaagggattattcctcacctagtggatgatggtttgtctatattgcaatatgcagatgataccattatctttttggaacataatttgcaacaggcaaagaatttgaaattgattttatctgtttttgaaaagctatctggcttaaaaataaattttcacaaaagtgaattattttattttggtcaggcaaaggagtattatgatcaatattccaatatctttggttgtaagttaggttcttttccttttaagtatttaggaattctaatgcattttaggaaactttctaataaagattggaaagtaattgaagaaagaattgagaaaaagattagtagttggaaagttaaacatttatctgtcgggggaaggttgatcttgattaattctgtactttcgagtttagctatgtttatgatatctttctttgagataccgaaaggggttatccaaaaaattgattattatagatcatgcttctttcggcaaggggatgatcataagaaaaagtacagactcactagatgggatattatttgccaacctaaggatcaaggaggccttggaattacaaaataaatgacttttgagtaagtggttgtataagcaaataaatgagggaggggtttggcaggacttattgaagaggaagtatctttataataagtctataatctaagttgacaagaaacaaggtgattcctatttttggtcatggcttatgaaagtcaaaagtatttttttagatatgggttcttgtatcgtgaatgatggggaacaaataagattttggtaagataaatggctaggtaacttagctttgaaggataaatatccatctttatatgctatagtccgaaggaaatcatcctctattgccactattatgggatctgttccgcttaatgtttcttttagaagagctttagttggtaagaatcttatatactggcatgaattgtgtgcttctattgtacatattcaattgaatttttcttctgactgttttagatgaaattatcatcagaatggtaggttctcagtaaggtcaatgtatctagctttaattaacaatggttatgttgagaagaataactatatttggaaacttaagatgacgcttaagattaagatctttatgtggtacttgcttaagagggttgtgttaaccaaggataatttggcaagacggaattggaatggtagcttaaggtgttgcttttgtatgaaaaatgagtctattcaacatctgtttatggattgtcattatgcaaagttcatatgaagagcagttcagttttttttttgttttaaccttccaactagtatatctcatattttttatgggtggcttttaggggttgacaagaaaaagagtaaactgatacttgttggagcttctgccatttgtttggttctatggttgagtagaaatgatatggtttttgacaaatcaccatctatttcctatatgcaagtaatttcagggcaacgcattggctccggttttgggcacagctacaaagatgtgaggatgatggggagttcctaaaagttgcgtgccgcaagttggagtcgatggttattcaactatttgccaatcataggtggaggttcacaagtagacttcaataaatgtgttctccttattttggcttgggttcctttgtttttgttttgtgtgttctttttatctgaactacactcttttctagggtgctacttcgtaataattggctgtagctctttttgaagaaaggccgggatgttatattccattatctaaaaaaacaaaaggaaacattttccaattgaggattggaaataaaagtttcaaaattaatttaacatggatcatcttggtcttaattatcgattttaaaaaaatataggaacacaaaaggatatgtttttataaagtaaatttcactttgggtcacctcttattaccgatgttttgctttagattgcctttcatcaatgttttcactttggaccggatattgttgcctttggttcacattggaccatcccgactctcttctcaagcatatgaacaatctccaatacgttggtttttacttgtcaataaacttccacaactgtatgtagactatttctttttttttttttggggaatgtagaccatttatttgacacacaataaatcgaatgtagatggataaaatagttgggactaatccaaagtaataacagatccaaagcaaaacaaacggtaatacaaggtggcataaagtggaatttactttaactttttttctatccaaaatatactgcacctgtggagatgaccaaataaatatagaagcatatgaactgactacatgaaaattaatcattgaattaccttacaagatacactcataagtttattttaaaaaaattccgtgctatggatcggatcatcacttttggtactgtttaattcctaaaagtacaagtacggtgcaacctgcaacacaatttcaaaaatataccaccaaatttaaattttcaaaactacatatagtccttgagcgcatataatttacggggaaacggtacgtgttggtgtgtgtggggtgtgttcaacgtcgtgtacgtaatcgcaaaaaatagcagagaaaccgcgcacgatagagctcggctacacgcgtgagcactcctctgactgatcacccgtataaaaatgattgctaccagagaagtgatctttatgggtaatgtaaaaatcacattaatttcgatttaaattgaagccaggacataaaaaatttatttatagtcccgattaaaaagtagaacatataaaaattcatttgtagtcccggttaaaaaaacgttcgtgactttataatctttatagtaccgcggttggtggtactaatcgattaatttggccttaccgatccaaacgttccttgaacatgcagaggaagcccgcgtggtcgtcagcgacgcccgcgacgcgctccagcagcgcgcgctgctcgtcggcggcgagccgccgcacgttcacctcccgcagctcgccgtccggcggcaaggccagcagcgccgtccgtgctcggtcgtaggtcggcagcttctccagcgccgcccaccgcaggtcctcctcgtcgtcctccctcgctgacgacgacgaccgcgagaacacgctgtccgccgccgccgccgcccacgcccagccgccctcccgccgtccgccgccgcacccgtaggtctcgccgccgccgccgtccatctcgccgatcaatgttgttgcctccggccagtgatccgatgtgccacgagaccaacgtgaactgaggagatgctggaggaaagaaatgggcgcaattatatatatatatatatatatatatatatatatatatatatatatatatatatatatatatatatatatatatatatatatatatagcacgcgcacttcgaagcaaaagctaatgtagtgaaaaaatatatatttgttcggctttttaataaaaaatggattaaaattcagactctacttacctcttaaattggatgtactatacacagccaaaaatatatatgttcgaattagcacagtatttctttttaaaggatatagagcacgtccgtttgacaaatatgacaggttggagttgtcctgtatataataaaagactatccgccctcaactgtactataaataaatcatcatcactaagtattaattcttttatttaatattgtaacttgtttatgattttttttaactaaaaacacatgggtacgacgatcaaagaggctagatagcaaaatagatcgcaaatagatagcaagtagccaagtaccaataccgccggttgaagttgtaatagaaaatcaacatattttttaattgaaaatgttagtatagctgtattttttaattatgacaaacgtatgggcgtcgattatgttaatcaccactcatttctgattgtgcttatcccattaattgaatgcagttgtacatgcccttgtttaatttgatgtgtgtacaccaccagatcagtatatatactatattcagacaatttagggatatattaggatgggattggaaatggatatttcctcttttttcatcttgtagaagttaaatttaagcttacatgtttattaattgatatattacatactaaactatattgtgattttttttcataactatttggatgacatgtaaataaaaataaaccagaggacatcccctcgagggattaaaaacagtttgccatatataattgacgtgtttagaccgcgcactactatagaaaaatcatttttcatagtgttacccttttccttttactggcgggtttgataaaaaagcgcttgtgaaaataattgagagggattccggttaccgaccgctagtgaaaatacaattttccctgcggttgtcaaggaccaccgactgcaaaaatacttttgctatattaaaataaccaccaactgcgacgaatccatctttatctcctcctccccccagactcaacgccttagcgataactcctctcctcctcctcccttctacctctcctcctcctactcctcctcggcgagcagtggcaactcctcctccttctcctcaccggcctcctcctcccttctccatctcctcctccttggcaagcagcggcgctccggggttggcgcggtgatgggtggccggcgagcggcgcgcagtcttctcctcttcacggcggcggggcacgacctcctcctcttcgccgcgccatatgctcggggccagatatgccgcccgaccagaggggaggctggaaccactgccgcgacgacgggggaggccgcatccaccgccacgagaatgggggaggccggatccgctactgcgacgacggaggtggccggatctgccaccctgatgacgggggagaccggatccaccgccgtgacgacggtggaggttggatccgccaccgcgacgacgtggaggccggatccgccgccgcgacgacggggaggcgggatccgctagctgccgtgatgacgggggagccaacagggagggcggcgatggtggcgggagggtgggcgcggatctgacggcgtcggtgcttgggcggccctccttggcggtgaaggaggtggatccggcggcggctggcacaacgacgacagctgctcccgtgatgacaatgacggttaccgtgatgatgatgacaacggctaccgcgactccaacccactcccctctactgcctggcgaccacggcgtggacttcggcaggcggcgcccatggtgaggtgtcgcgatggccgccggtggtgcttatggatgtggcggccagtggcaacattttgaattttttttatcccaaaattgttttcactggcggtgcactttattttgccgctagccaaattactatttttggtagcagttgtcttagcatagctgcttgcgtaactcaatttttccaagcggccagctggccactagtgaaaacacattattttcactagcctttaggtaggggtgaaaacttatcggataatatccgacccgatccgctccgaatcgctctgaaacgaggatatggtatgggcttttcgaaatccggtagatatgaatgtggatgcggatagtataatgtggatgcggatgcggatatggtatctctaaaatccggtgaatgcggattatctgatatttatgtcggattatctgataggccactttccggataatccgaaattatcaacatatgtgatatctctatctattgcatataacataaattggttccttcaatgatctaattcatcaattaacctagatttcttagtctgaggctttcaccgtttcttgtcagacttgcctagctgtatttttatattatggacctcatattcatgttgtttggcacttaagcatataattattacgatggatcgtttattgattattatattattgttcattgcattactaacttgatattatattggttgcatacacacgtaacatccgataaatttattccattcccgaactgattccgcaccatttccgacatccaaaataatccgttccgcatccgcgtccgtacactatccgcacccgcttcgaatccgcttaaaaatatggtttaagatatggtatgaccgtccgaatccgctctgttttcacccctacctttaggcattggaggcacctctgtccgccaagaaaaaaaaaaccttttttaagtagtggcggctatctatgcaccataaccaccctataaatagtggctagatttttagctatttgttgctcattgataaatagcactttatattaacttacacggtcacgtaggtaaataaaaaagagctgccagaaagctgtatttgtcaggagcaagccactagaaattatgggaaaatttgaaccatgccacgcaaattttgcaaaatttgtgatatgccaccctaacccacatgtcattgactcatatgggtcctacatgtcattgagatacgggtggcatatctcaaattttgcaaaattagggtggcatggttccaacaaacccaagaattattgggttcgaatgacatgataccaccacctaaaattaaatcttcggaaggattaatttgattcttctcaatatcttgtactattttgttcagcgaaaatggtaaatatcttgtccaaaaacttattttaaaaatttaatatggcattaaaatgtggtaaaactttgctataaaatttatgagtagctagttgtttcgatacagcaataccaatacttcctctggttctatattaattgacgttttggacaaggttgtcgttaaacttttataactttgaccatcaataactttaaaaatatttagtttaaaaaaactagaaaaacatatatagatttgtctttcaaaacactataataaaagtaaacatgcatttatttattgcatatattataatagaaaaataaggtcaaaggtatatctcgtagagcgtgtcattatccaaagcatcaattaaaatgaaaccggagggagtaccaattaatagagaatcaaaaaccaattaccgagggtcgtatatactaaaagtctatacagttaactaatataatactccttcctttttttaatagatgacaccgttgactttttctcgtatgtttgaccattcgtcttattcaaaaattttatgcaaatgtataagatataaatcacacttaaagtactatgaatgataaaacaactcataacaaaataaattataattacgtaaatttttttaaaaagatgaatggtcaaacatgtgagaaaaagtcaacgacgtcatctattaaaaaacggaggtagtagttaacatagcttcttaggccatgtacaaagctagagtcagacatgagctctacgttatttagagactagcatcctacaacagttggagacaatatgatctctaatcattagtgtatcaaaatattttttccttactcttctttcctttctttcaccaccatgcaacaaaaattactctaataaatgttaagagtcgactctgagccgttgtcatgcataacaaccatatttctcttttgtcctttctctttcttccatgtcatcaaatttacttgcatggcaatagagagactactaataaagacggctgtacatgcccttatatttcttgcaataaatggatgatgaccctaatgatagtatttatatgataagttggcttgtacaatgatattttttgaaagttgtctttatcgttgtattgtttaaagtagagcgttcatcaatggcatttgttgtattttctattgttataaggctaagtttgattgagctacacctaagctattttctcattatctatagacacgtttcccaaacaacttaacatgtttttcgtataaaaaactttatataagaaagttttttaaaagtatcaaataaatatgtctttcaagcttgtagtaatactaaaataatcatccatcaatattccatcttggggttcattcgtttcaaagaaattaattgtaaacaaaaagtacaaaaatatattatcttttgagatgcgtactgaactaccattcgtttcaaaggaacaaaaaaaaaaaacctcctttccctccacttttagagggaaaacaaacattaaaaaaaataatccactccaacccaatgttgtcaatcttttgaattgtttgctgcacaactatagaaaaagttctttatatttttcaatcctttaagtgtacatgtattttcatactatttctacgttttaaaattcctataaaccgaacgagctcttgattagttttgcatgaagcaatttgctccagccaaaagtcctgcgcgagcgatcccttaattagtttcgattaattacatcagcgagcatggtatccccaattctcccaccaatgcaagacaagacatcagcaacatggtacagtacgtacaacggtacaagtcccccccccctcccccttcaaactcgtggaacatgtgcatgttgctatgtcttcccgtcattaaatgcattaggcagttttataccagattcaatacaatctttagaaaatgttataaaaaaacagaactctgtttagggcatgtacaatcactgagatggctgctctctctctctgtttcaaaatataaatcgttttaattttggtcgaagtcaaactaatttaattttgaccaagttcgtagataaatatagtaatatttataacaccaaattaatttcataaaatctataattccatataaatttataatatattattttgggttgaaaatattacttttttttcgttaaaccttgtcgaacttgaagcagttttattttgaccaaagctagaatgacttataatctaaaacagatgaagtaatgtttaaaatagttaggcatgtgcaacaataactatgtactccctctataaaaaagacatgtatccggattcattcctagattttgaagttttttgacgcagagagtagatatccattctttctataaagacccaaagctgaaacctcagtgttccacgtcatcgctaattctcagtcgttcgatcagtggatgagatcgcatattaaccattggatgagaagatccctgcatgagatgtcgaggagtgaaaaacctccctctgtcgaagtatatgatggcagcagctagatcaacgatgatatgcagtgactgcgaggattaatagtactccctccgttctaagtcataagacgttttgactttagttaaagtcaaactatttaaagtttgactaattttatagacaaatatagtaatatttataatactaaattaatttcatcaaatcaataattgaatatattttcataataaatttgtctttagttaaaaatattactactatttttttataaactttatcaaatttaaagcagtaaagtcaaagcgttttaaaacctgaaacgaagggagtataatggaagtatgcatttggtcaaaggatgataaaatgaattaagcacgacattaaagccattaatcacggccgctcggctgccttttgatggcgatattccattgcccgagaactaatctatcggaagaggaaccatccatcgggccatgtgtgatctagaagtcgatgtgtgatgtactggtggctgttcatagtgaggcgaagaggatcaatggctcgagtaaccatgtttcagaaacaggtatttgccctcttgagacctgcttctttgctggtactttgtttccaatctacttacacaatttgtctgtatagctgtataattgatcattctttcgtacaccctgcatacttacgtacatatgttattcctccaaatatctgattgattgatacgtgatacaatgttcaggcaccatccattatatttgttcgttgattttgaaatgatttttacatcatatccaaatatatatccaatgtttctgcccttgattatcttctacatggacctatccaacccactagctgcatttacagtaattgtggtggttaatagcgatcgatttcgcttcaggaattgtagcttgcacaagtcatggcaagttgtctgatgatccctgtgtcctattgactgcaatttaattgatctctgcactaaaacattgactttgcagccttcagtctctaatagtttacatgtatcattcgttctcccattttttttagtgaaatcactggtggagaaaccatctttcgtcggtcggacaaaatccacaatagtgtcccggttccactaaaaaccgggactaaaaatgatttttagttccggtttataagagcaacaggaatatttgatattcagtagagttaccaacccaagttaccaaccgagagtcccggttcatatgctgtaagggcttgtcgcccccccccccccgatctttacacccgattagtaacaccaactgggactaaacatcctaactttagtccaaagatcaatccctttgtatttggttttttcctcctccagcccaagccaagcttcaaaattcttctacaagaggggaggtcatgccaaaatttcttgtgaatttattttggtgattatatacaaatcagaggtatgtaaaaggttagcaacttcttcctccattgtttttgttgtcatattacatttggagctatgttttgtacacattattatctctaaaactttgttggaagttgatgagagagaaaatttgtgtagggaagaagaatatattgaaattttgtttatttacaattttataaaaaaaattataaaatagctaagaagaaatatatattgaaaattaatctaaaataatagaaaacaaactaaattgaaaactaaaagaagtacaacacattaaatattagtttaaaacttcaaaaataatttaaaaagaataatttgtgagattattttataattattgtatgaataatgatatgtcattactgtatgactatttagtggatttcactttcattgaataattttatgatttttttgcatttcatatagatggatcggcaatggatgtacgcggaccggtggttgaaagagtttattgacggcgtgcattattttttgagagtggcagaggctagcaagcataagggttttatttgttgtccatgcattaagtgcaagaaccagaaggattgtacagtaaggactattcatttccacttgtttgagtaggggttcatgcctagctataattgttggacatcacacgaagagataggggttcaaatggaagaagatgaagtggaagacaagaacattccggactgggttcagtacgctggatttgaaggaaatagaacgggtgaggtggacggggatgttgacgataatgacgctgcggatgatcttggtcagatgttgtaggatgctaagcaggattgtgaaagtgaaaaagatgcccataaattggagcatatgttagaagaccacagaacgtcgttgtaactaggttgcgaacaggggcataaaaagttgggtaccactctagaattcttgcaatggatggcaaaaaatagtgttactgacaaggcatttggcgatttattgaaactcgtcaagaacattcttccggagggaaacaaattgcctgagacaatatacaaggctaagaagatagtctgccctctaggactggaagttagaagatacacgcatgtccgaacgattgtatcctctatcgcggtgaggagtacgagaacctagaagcatgccctttttgtaaagtactacgatacaagattagacttgatgatccaggtgaagttgacgggcagccaacgaagaagagaattcctgctaaggtggtgtggtatttccctataataccagggctatggcgtttgttcaggaacaatgggaagcccagaatggtttgttggcacgcagaagaacgtcaacaggacgggatattgagacactccgccgacggttcgcagtggcgaaacatcgacagaacatttaaagactttggagaggacgcacgaaacataaggttcggtttaagtatggatggcatgaatccttttggagagatgagcaacacccataacacttggcctattatgatatgtatctacaacatccctccttggctatgcatgaagaggaactacataataataccgattattattcaatgcccaaagcaacctggtaatgatattaatgtgtaccaaagaccactggtcgaatatctgaaattgctgtagaagaaagaaggtgtcccgtatgggatgaggacaaataggagaagttgaacctatgagcactgctgtttgtaaccatcaacgattggcatgcacttagcaacctattcgggcagtcaaacaaggggtacaaggcttgcactcatagtatggctgaaactgaaagtacgtatctgaagcattgcaggaaggttgtgtacatgggccatcgtcgatttcttgttgcaaaccaccctgtacgaaagaaaggtaagcactttgaacataaggcagaccaccgtattaagcctaaacatcgcagtggaaaagcaatgtttgctatggtgaaaaatctcaaagtagtgtttagaaaggggcccggcagccaacctatagagaacgaagatggtcacgcgacgatgtggaagaagaactatattttttgggagttaccatattgggaatttttggacgtccgccacgcaatcgacgtgatgcacctcactaagaacctttgcgtaaatctgatgggcttttaaggtgtatatgggaagtcgaaagatacactggaagcacgtaatgatatgaagcatatggaacaacgcggcgaccttcacctagaaccaaaggagaaaggaagccattacttgagtccagccagctacactcttagcaaggcagagaaggaaagtatgtttgaatgcttggagagcatcaaggtaccatctggatactcctcgaatataacgtgaataataagcatgaaggagaagaagatcacaaatctaaagtctcatgattgtcccgttatattcacgctatagtaagtctcatgattgctacctattatattcggggtatccttcccgacaatgtccgggcaacaataacaaagctatgtgcttttataaacgcaatttcgcagaagatcatcgatccggatatattagaaggccttcaaaatgatgtggtgcaatgtcttataactaggtataaattgaatacttataactaggtacatactcataattttaaaattatgaaaaatttgggcgaatttgtgtatttcataccatggtgccccatatgagtgtcctatatattatgcatatatatatatatatatgtatatatgtgtgtgtgtgtgtgtattgaaacatatatatgcataatatatataaaccatgcagcaacagaggcatgcaaataaaaaaaagataaaagatcttgagtcctggttggttacaccaatctggctgagccatctttagtcccggttggtggagactaaagatcgatctttactcctggctttttcacttgggactaaagatcgctgtctttagtacaggcgggtccaaaccaggagtaaagacagtttctccacaactgccagcttggaagcatgcacgcgtgctttgacatgatcactttttctacaggaaattaactcgtacgtacggttaattgttgttccatatcactttcaatcgcgtagcaaatttcttatagcatgataaatcagtaactacgtacttgtcccaagcgactaattaatctattttaccaccagcaccaagtggtatgcatgacctcgtcacccatccgttgtggcacaaatttaagagagaaaactagtacatatacatgtacaagtagtagagctaaggtcaataatgcagcccactgttggctaaaaaaaataaccatgtcatttataataaacgttgtaactaatgtctatacaataggacatactatagcacaaatattttatctttaatgggacccaccatcttcccaacatgtagcagtttctgctcggaaatcctaatgggcgggtgatcgctgccccatcggcccagcgatcacctcccttgcccctccccaatactcagatacactcttccctcctctccccctttatcctccccttcttctcttcctacggtacaccacacaaatttttttaaaaaataaaatttttaaaaaataaaagttagaaaaatttatgtatagaaatactatatataaaaaatttgaattcaaattcaaatttgaatcgggcatgtacaattttgacttataaactttgggtctataaactttaggtgtataaactttagatgtatggaaatactatatatagaaaatatttgaattcaaattcaaatttgaatcagatataattcaaattcaaatttgaatcgggtatataaactttaggtctataaactttacgtgtataaactttagatgtataaaaatactatatatgaaaaatatttgaattcaaattcaaatttgaatcggatatttgaattaaaattcaaatttgaatcgaatataattcaaattcaaatttgaatcggatatataaactttaggtctataaactttaggtgtataaactttagatgtatagaaatactatatataaaaaaatttaaattcaaattcaaatttaaatcggatatataaacttttgacttataaacttttagtctctaaactttatatgtgtaaacttgatgtgtataaactttaggggtataaatttactaaaataggaaagtaatgcggtgccaaaaaagaaagggaaaatttcatctataccacaaacttttgagcagtaccaaaaaatcccaccttcccaacaataccacaaaacgcaacagaagtggaacgggaagtggcgtttacattttgtaggaccaaaatacccttgtgcacagtggagaagatcgggagaccgtgcgacgggagagatcgcgtgcgagagtttctgttttccttttcttttactagtaattatgcacgtgcattgcacgtaatagccaaaataaattaaatcaaacatatcactatgtaaatttaccaacgttagtggctttcaacttaaacactacagtatattcatacaaagcagcacaaattggcaaactatatgcttcgtttaattttataaaaccacatccaataatataatcttgaaataatccaacaatagattttgatcataaattcaagtatagtacggattcttgaagaataactttattaatggacaaaaaaaaaagtaaagtgcacaccctgaaactaaattttcatttgtagtccatgcatggtattaatttgtttttccataatctccaatgagtgctcttggcagaaaattgaaataaataacaatgctaaaaataaattaaagggtccaataaccatgtatagtatgacaaaccgttttcacaacaaaatctgacaataactgtttgttcggtactatccaactatccaactatccaagatcaacttctcatcgaacttgtgcctcgcattgtcctgcttcaacctcacaatcccatatcagaatggctgcacactggatgtgcatggcccctttcaaagtgaacacactattattcaattccagcatagctaggaactgcccatcaattcacccaaggaccagggcactaccaattgaatgatctacttccaagtacaggtttcagcccccattcagagatcctcaaagatgattgtgtcaaaagcaatgttttaaatagcgtgctaagacatttagcgattagcttctcaaacagctgtagcggcagctatagcgagctaaacagagctatagcagctaaattatacatgagagcaaatagttagaacccttgtcaaacagctataacgggagatttaaaaccctggtcaaaagtatcaatgaacctaaacatgtaagccacattgccagaaaaaaacgtgagcaaactcaatgtataacctgagattataacctcacattggcagttgatgagtttgatctgtaaggtgctataactttacattatatcatacccaataatgaatactaaatcatatgtatagttagattgaaggggaaaatcatctaatttgagaataaaatacaatatgattctataattttattttgaaatttctggctgggtatataattcatagatctggctgatgcaaagtatggttctctgtcgtttgtacagaatatagacttttcaattaaatatacaagtcaaatttgttatctaccagttttttttcttaatggtgcacttatccatattaagattaaaactacagctttcttgtgaggatgtatattgtatctgtttggaaccggcctatgcaaccttgcttctgttcatcattggagaagtaaaaatcttgccctatagtcagtataaaactatatttagaataattagattgctctatagtataaaaagaaaacaatggtttcagactatcagtctcttgtcaatctgctaacatataattatctaacctataggtgttattggaatggaagaaaaattatatcaaaatatcaaacataaatcttaagttcttgcaatttgctacatgacaactgaatgttcctcatttccatcttacaaaatctactctgagttccaagcacactatatactttttttttctggaaaatgggagtttgatagtaataaggaaaagagggataaaaataatgtaatcatgcagaggttaataaacacaataacaataatcatgcagaggctgtcttgttgaaaccacatcaatcaattcaacaactacacaataacaatcagtaattttctctacaattaaaatgaacagaaaaggcagaatattttggtttccctagcaaaatattcaacagttggctataattcaaaaaattttgaatactggataaatatgagttgggacgtcctatggttgccctagggcgcacacccccttggactaagcccatgacacaattataaggcccaaaacccaaatacaagattgttgaaatggttactatcaaatattcaacagttggctataattccagaggtagaaatcatcatcttggtagggttactattgtttgctcagtagttttatgaacttgatctctcatagataggattttttatgatgaactgtttgtgtttgattctggttgcagtacctctcgaacaactttgtttgccaataatgtgaagttactacaactacagctccttcaactcccttcttatgtatctgaaaaccattcaagttatgttatcagcatttccgataaatataaagaagtcaaaatcacagtgaattttcggatacgtaaatccacatgcatatgtttgttaaacattatagacccataatgtaaaacaaagtgaatcaaagtatacttgactgcatgacatatcagccaactaacaaagaaaaaaaacagccattaggagtgaggacttcctaattatcaggaattaggagtatagaacttcaaggataacatcaggaccaagtaatagatccattatgttgaaaaaaaacaaaagtacgagaatatggttaggtaatcgaaacagatagctagaccaaaacatagtcattgattttacttcctagcattggattcattatattgaaaacctgaaacaaaatatagaaaaaaatacagtaaattggaactcattagaaactccaattaaggttaacagcttaggtcaagacaaatacttatccacatgcctgcaggtacacggcagcatgcactatggtaaacatccaaaaaaaagcttcaatgataatgttcagaaacttgcctttgcagtgagaagaatgtggagttgtggttgcagtcttgcagaggacagaggagattggcgcgtgaggaccagcagaatcagtagcacctcctcaccttctccaaaactttcattaggtgtaacgtttctatctattgtacaatttatcgccaaatcagaaacctgcaagagaacaagtcgaacaatgtggcacttgatttcataaaagcggcagtattatgaactatcagctatctgattgatagcaagaagatacattttgtagtttatcattatatatacatatcatccattccttataatgctagtccagattaaatcatgcatagtcatatatggaatatggatatttattcaactaaaaacatggcacataaaacattatacaactcaggtccacattcaacttgaattgctgtcacagaaaaagggaacataattggaagctgcacgttgagccaagaacacaataaaaaacacaccatttttacgcccacactgccggtacatattttatgcaaacaagcatataattatgctagtccaggactccaggtcaaatcagtacagggagatatgaacgcagaaaggcactcaccgttgtggaactcgtgaccacaccgctgcccgccatagacctcctgtctgaatatgtatgctaggtcctaattcaagtgactggccaaaaaaaaaaaaagaaagaaatcatgattcaatcatttgtggtcacaatcaaagttcaggcaatttatgaaatggagctatctctaaaattttcaggttaggataagaagctggcagtgtgggcggcaattagacgacttcacttaatgggagtttggcaagttattcatgaatggaaattagtacacctttgaaatatgtacaattaccggcagtgtgggcggcaatccgaggttttaagttagatatatacatattctgaaatatataccatgtcctgaatctgaaacaacaccacttgttttcttcaagtactcattaaaaaaattatgcagcaatcaagcaatatcactacaagtgggacaggataactcataaaaacagtaggaacgtttattttggtcaaattgaactgaaaagaatttgtggtcctggaaataataacaattaatatacacattgggagtaagaaaattcaaccaacgacatactgttgtgagaataatttagggtaatctacagacggagttcctcactgaaaattttgtgaagtgatctacaaatgagatgggagcaaaggggcttgtgcttcagattaattttgcatatgctagtcttcaacgcacaaaaaaattgtgaatgtcagatcggagctatacaaaattgaaagcaaggcaagcattaaaggcaatggttgaactaatatgcacggaagaatgtaatatgcagtttggccaacctggcttaggcaaatcaacgaacacattgcataaatcctagggattgataaatgctacgataaaaatgggatggtatcgaagcatcgtttagtgattaactaacctaattaaggatttagggatggatcgagcatatgattgagaggctgagagctggcgttggaaggcagacgcaccagaggcgtggtggtgcttcgcgcggcgaggaggtttggagagcgcaggggaaggagcagtgccgggggggggggggggg

SEQ ID NO: 59725 - DNA, 1133 bp, Oryza sativa
aagtaagtgtgcctgacgtagtgtttattgacatttgggaatctgtacaaattgtgttgttttgggcttaagaacaatgggtagatacttcacattataatcatacttcacatttactaatcaaacggttcaatgtaaaagttactcatgctcaccaatttcataataagttgattactgaaatgttgatttcttctaatattttaatgttatttaaaattggcagaagaatgaattttaactctttccccttgtgcattgttcgtacttttgatctgcttttgctcctgaatttgatctttgaagttttcttgtacctgcaactttatcactcttctccatctccatctttttcttcttgaatagatttgttgcagagaagcttctttcttcggtggatctgagatttcctctaagataattgattctaaatagatctggattttgatctgcttgcgtttttttatctccatctttctcactcttctccatgtccatgcttttttctcgatctggatgctgtattttgttgttaattggtttttctagagcaagtcacgcgattgtctcctcttcttggtagccaaattctctatctttgttagtgttttgggttttgtatctgttgttagttaagctgatgggctaaatttgagtcacttctatattgttttgggcctttaaattgactttaatcttaatctcggctttcatttgatgtaaattttttatttgggctcaatctgggccatttgattgggtcgggttgtgtatgggccctttgaaaatgggcttccaaacctatttgtgtttgtttttttttttagttgtcaaataatattacctttgtatattgttttgtttttatagttcaatgagtacttcttttcagtgccacaggtgacggaatgcttaaagctggatgctctcaataaactcttttatcgcaaattaaatgaggttttttttgttattttaaaccaataattaattaaatgtttattattggaagtgttttattttattttttctaaaattgttttctgcttgtagatcggaatgttgagaaaaatcatttatatgcgcaaggcatatattcctaaaccagctaagaaagaagcattcctcagacg

SEQ ID NO: 59726 - DNA, 655 bp, Oryza sativa
agtgatgtctagtgtaatgagttaatattattaatgctgttattaattgaagcattgtgcatatgtgtttcctcttgtattgcctccatatgattgctgtgaagctaccaagatttgtgtttgtcatgaagccgccattatgtatagtataatgcctcctttggttacacagttttcgctctcttataactgcgtacatatcaatttcatcttttatttctgtactcagtaatgaatatctgtggttgattcagtgtagttgatgataggaatgctggaatagtgcagtacattgtacagatgcaaatgcctgtgcattgtatagtgtcctcttctattacctgatcaaaagcaggaactttgagctctcttgctttgtttggatgtggtgagtgattgagtgccacttatttgtttttctgggactgaacacagatttttggtaagagtactaatctcaatgccttgtagcatgtttgtgttgccttcagcactgcgaatcgattactagtatatgaattttgagctgacacctgatgattttcatttttggcatgtaggcgctcattctctttagacaatcatcatgcaagaatcaagaattcaggatggatatttggaaaaaaggtatgatcttgagtcaatacttcaaaga

SEQ ID NO: 59727 - DNA, 664 bp, Oryza sativa
agcctttctctcgtttaaccgctggtctcccagcctccgcctcccaccgactcctcgccgccagccgccacagccgcggaagctcatctccgccgcaatctaacgccagcgccgtcgtcccttgaccaccgccgtgccgccgccggcggccgtcggtgtcgtgctgcatctactggctactgctaaagcaagtggagatccgacggatgcaaccacgggcacacgccatgtgaggggacatgaggtgggcacgtgagcgaggggcacatctgtctgtatcttctccctcctcctactcccacaaaaaaaaaagccgttcttgatggcgccatggagatcttgggccccctcccaatggcggaatcttctcggcaagcggcaattgatggctgtacttgggtgaaccgcgtcgcgaccagctcggctgcgaactgttcctcgactactactactacagtctctacttgcccttgctgctgcaatggtggtggtccatgtgaggtgaattgatgagctaaccttgtaataatgtttctctgaagatctgaagacttcttgcaaaagcaatataatgtggagttggaactctgaacttgaagtcatgggtgttcttggcttgcacggcgagagatttaccgctgcaaacctgtcaaaggggaaaatg

SEQ ID NO: 59728 - DNA, 599 bp, Oryza sativa
ttttcttctttaaactttcaactttttcgtcacatcgaactttcctacatacataaatttctaactttttcattacatcgttctaatttcattgaacttctaattttggcatgaaactaatcacagcctgtaactgaaatcatgaacaacaaaaaagggggaagaatctcaccagggtttctgactgtcgtgttgacagcatatcccttctgaagcagcatcttgatgagcgccgaagcgatatacccgttcccgccggtcacgcacgccgtcttcatcccaaccgctgacatcgccgtgccgccggctacttcgtcccctccaggctccactacgtcctcctgagagaaatagcttactggaatgaagacggcggttgtaagagtacaagagtacagtcactgtcactgacgttcatctgataggatatgcttgtcagttgtcaccaataagaaatcttttgtatttagatgcaaaggtatgtttgtatccagggagtaaacttattccatgtcacattggatatttggatgctaatttagagttttaaacatagaataattccaagacttattgctaaatgagagttaattcacgag

SEQ ID NO: 59729 - DNA, 2809 bp, Oryza sativa
aaggtcaacaaaattggtactttgtgacatcttgtctcataggctcgtttgctattgcatatgtttaaggtgcccattaattagctagtgtgagatgggtggtggtcctgtcctttgatgatattacatccaccctttgttctgagtctattgctctcatttccactcatttttctctcgtaaaagtctccctgttgtagccattttggagtccttccatcatttttagaatacccacgctgtactctctctctctctctctctctctctctctctctctctctcctcattttcgtttttattgtttttgttcatgtgattcttatatgaaaacgtttgctttacgttcatgccattcgaccgtccctcttgtttataaaatcggccctgaattcgatatcggtaactaaacacggaagaacatcatacaagatcaaaacttgatgatgatatctatgcacgatatttagatcgagttcagtcgaaacctacatcttcatagcactaattatggacgatgattttcaaactagcatattacaatatatccaggtatcacaaccatcgatcggctcagtcgtcggctagtcgtttccacacctatgttactgtcactacgtggatataacatgtatgcttttctatttgcgagaagacttatgacagggtccgactcaacttctatcctatccttattacaattccaagttctaatttgtaattgattgcatattcatactaaacacaaactctatcttatcttttagaaagaataaaagaaatgtttctcatatgaacccactcataatatatactccctccatccaaaatgaatatttcgttggttttgtcaagataagttaattactcttggtcttggcaattaaaaaaaaatagatcttaaacttttggatgaaaagagtactactttaaataatgctaatggtggtatccaagtctgtctcaaacaccataaactggtatatatgtggggctataaggtatccacacgtgaataaccatgtaattgttattcaaccgtatgctttaatttagcccttctgaaaataggcccgtagaataaaaacatatgatctagcagcatatttcagtacggctgcattaaaagatggcattatatgcctaatcaactaactatactataaacttattgtttttgcttttgttgttatcttttataatatatgttgcaacgcacggcctttagcaagtttcctaaatgaatttacgtgtcacccgtattattgatggcatttcatcatgcgttgcacaagtagcagcataagtcggttgcaacctgtactgcagctatcggcctattcgcatttgttgaccaagtgggcatgcaaaatttcgcgttgctttctgggtgttttacagcgcggctccgtgtaccgcgcgaggaaagaaaaggtgggtgtgttccacttggtctgcaagggaggcagccgattggcagccaaaaggcgccacatgcgaccacagctgcacccacacacccaccttgctctttctcgcaagtgctggatcctctacaaccaccaccagaatgtgcagcaaccccagggtcaaacggcaatgtcaaaggctatgtgaactagaactacacgtcctgagatatttgatgacctcatgtgggattaatcttcgactgtttgttcgcggtaattgagagagtaaaggccatttgacgcagcttgtagtagaaaggaatgtataaaaatgttcatgtttttctcacttactctttccctccacgagattacggtagagaaacaacatgtttttaaaagattacgatagagaaacaacacggtttaaaagaaaaaatgaaaaaaaaaacttaaaaagaaaacgtgaccacaggtccacaactcagtcacgtatacgagtcgctgacagacttatcacgtgggggcattttacacgttggcttgggcgcgcccaccgtactgtagtcggcatttggcgagtggataaaccctatggacggccacatggttccatgtgtccaccaaatccaagagacggtggactttgggaggaggatatgtgggtcgcgcgcgtccttccttcctcgcccctcgcgggctcgccttgccgtgcgcgtctcgcgcgagcgaatcagccgcctccacttggcttagctagctagtccagtactcgtgcccccactccggcccaacgccaccgcaacacctgtcccaccctccccgcctataaatccccggcgccggccgcgtcccccggacaacgccgcatcattgtgtccggctccggctcccgggacacgacacagcgcacgcccagagcgcgctactacttgctttcgagagggttgcgtgcggctttgcatgaggaggaggaggatgggggcactgcacgtcggcgagccgcgggtcagcttccagcagcagcagcagcagcaggtcggcaagaacgggcagcaagggcatggccatggcgccgtggtggaggagatacacgggctcatcaaggtttacagggacgggttcgtggagcgcatcccggcgatccccgacgtgccgtgcacgtggggcacgacggcgtcggtgccgggcgtcgtcatcgcgcgcgacgctgtggtcgaccgtgccacgagggtgtgggcgcggctgtacgcgcctgcggcggcggcggcggcggggagggtgcccgtggtggtgtacttccacggcggcgggttctgcgtcggctccgcggcgtggagctgctaccacgagttcctcgccaagctggccgcgcgggcggggtgcgccgtgatgtc

SEQ ID NO: 59730 - DNA, 4197 bp, Oryza sativa
ccctcctattaaaccaaggcaccctcccttcctttccctctcccattcgccctcgctccaccgcgccattgctgtcccctctgtctctctaccaccgaccaccgccgtcgcgtgtgccggaggagccggtgcgcgctaggacgcggaaggggactccgggcgctcgtcttcttcctcttccccggcccgaggccggagagatcacttccgtgccgtcggcctctcgtcacagcaccccgcctcgtctcggtagggcatccctccgttctccctcctcgctccatctcttccccttagctttgagtagcagctcgagtagtaccccagtagctagttggcgccgccccaagccacgccgccgctcgcagtaggctcgccgccgtcgccgcccgcgctcggtagtagccgcccgtcgccggccttcctcggcgatgacccgtccaatccgacgctagaaacggattcctggagtcgcgtagatgctctagctcgctcgaatcgaactcccgtcgcgccgtcgccgttaccctctttcctcgccgccggttgccgccgccgcaatccgccgccgtcgggctccttccggcgaatccaatccattggctcgtctcccctcgtcccgtgcaacctcccggtgtgctcgctttcgcctgtatcgccgtggttcgccccgctgctcgccgccgccgtccgccatccgttccggccggcgtcgtcgtcttcctcccgccggcccgcgtggctgccacaaaggcgccacgtcggcgccagctcggccacgggccaggtcggtttgacctcagtcaaccgctcctccgatccgttctcctgtacgcgcgtggtccacggagagccagccggctgcgcttgggcccgccgtctcccagtccacctggtgcaccatctgtgagccgcgtccgcaaacactagctcccccgcgccgcgtaaaccctctctcccgtgcaccgagtcactgactcgtgggctcgtccaggaccccgcacgatggatccggctcacccggatctctctctctctccacgcctccttttgttgggccgccttctgagcccgcgccagcccaattggttggccgagccgcgccaactcctctcgggccgcgctcaagccgcccgcaaagtctacatctcttccctatctcgtttctaatccaaaaaggaggttaataaatccttttcttttagtccagtaaatcctttagtcttagagactccatatcttctcaaccgtacatccgtttgactccgtttaacttccaaaattcctcaaatatcgagatctatctaatggcacgcttagaggtcaataatagagctttatttttaccgtttgttgagttgtcccgtttcgcgtgtagtttcggagcccgaagacccgcagtgcgaggatttcgaggatcaagctcaagatctcgagcaaggcaagtcacctttgatcatcttgcacctataatttaaatctaagtatttctcttccgcaaatattgcatgattaggtttaacacaagtaatttggccgcggcttgcgagaaagcctaccggccccaatcctaattgctgcaattaccctccttgaattattgaacaattaaaactcccttgtcgactgttgtgcttcgatgcacgggccttcaggcacgtgcatgggaacacctcccctcaaacttaaaatatccaacgatgggtaaaacttgaggttttacaaaagacttggaaaacccgacgcctgggtcggtgcttgcgaaccaaatgaatttccaaaaatcgcagaccgggggacgtgccgggagcacggtttcccactcttgcacttaaggaccgatttcctttggaatttcatccgtacatataacaagtacgaccacatgggtggaatgggacacccctggctgagtaattagctaatcaggggagccttgatgcctggagacaagtggattcaccagggtggtgtcggagaggacccctgggcttcctggcacagtatggtctgggacctaacctgttgttggtctgggacccctctcgtcggcatatggtaaacctgtgtcggctctcgaaatgccttgttatgaaagcctcaaggtcaccagacgtggctgttctgcacgggctgggtgatctgggttagtaatgtcgtgtgggtaaagtgtgccccctctgcagaggttattaaactgttcgaacagccgtgttcacggtcatgggcggatgtaaagtgattccttagcgtagttttgtttgactaccgctttgtgaaattgctgttgtggacttggggttcgatgtttggaacatctgtggctgacgggatcagctaggcccgggtggccattttaaagttgtggccgggtgccaatctcaaatctatcaaagactgatacattgcacatactccgaccggacgagatgcactgtctcatccgtgtcgtttgagaagcactcacttagttgttttaaaaaggagtttaactaaaaatcaattgtaaaaacaacagcctttcctttgaagccttcattaaacacataattcccatgacttgctgagtactcctgtactcacccttgctctatataaataatcccccccagttgctgaagaagatgagatggatcccgctgacgaggagttcttctaggagcaagtcggctatgatgagttttagggttttgatctagttcccaagttgcgcctgtgatgaatggtccaagtcttggcttccgctttcctcttttgtaatgcagttgtgagctcggggtctgttcgcagcccaacatgactgtaatcctactctataataaagagacctctgttgctgtgatattctgtcttcctatgataccagcactgtttcctgggactggtatcggataacaggttaatttggggcgcctcgggctggttccgttcggggctagttcggggtgtgacacacaccccctaaaacactttattttgtagttgtggtgtagtattgcaccatatttaaagtttttttttcaggacatatttatatttatacaagttgttgaataaatgtaaaactacagtcgccatttggctgtttacaaaatcaactcaagtttagaccaaagatggcatcaactatcatatataagggtgcaatataatgtttacaacttgtatataaaagaaatccaatttttcagcgccgaaataccgaacattagttgcatcgaatgagagaaacacatataacatcatctaaatactagatgaaaccccacgtgtctcaacaagaatattggatgataataaaaaaaaataaagtataagatgagtttgttttttaaagctaaatgtcgtaactttgtatacatttgtattgaacgatcattaaaagaagttataaacaattgagatgatacattttattacgatttaaatcaaacatagttctatgatccaaaggcaaaaactaaggtaatgtggatttatgaaagaagaacaaaaggtggacaatttgagctgtaaataaatcatgcagtggttagaattaattgattggtgatgttctttaataagaaaaggaaatcaataacatcaacttcacttagtgaggataaattataactatatatataggatgtaaataatatgattgtgctatatatgtctagatggcggagataaaattgaagtagttttaaatcattgaaatattatttaagggtaattgtatttttactctgttttgaagtctaactaatgattttatcttgtttttccaagtttactcatttgacactcttttttttaaaaaaaaaatgaaaatcaggtcttgcctgttttgtaaaggtaacctaacggtgttaacccggaaaaagaaatatcatttatgtcctcatcctggtttaccgagacaggtgatggtggtatccttgttgtcgcaaccttcctaaagatatcgtttgaaggtctatttcctaccgatctttcttcatgaggtatgtcctcttatggtggcactttataccactacaagatgaccacgttggcggatttatacggggaagaacggatccatgctctatgtcatgatttccctctccaacccaaagatgtgaataatggagctaagtgtagttgggacgttgcactcctgtttgttcctcagcatggtgcgattttgttgaatttttttttcttatgatc

SEQ ID NO: 59731 - DNA, 551 bp, Oryza sativa
atatatagaaatttctttaaaatatcaattatataaatttattaagtttgtaataatcaaaatttaattaattatgtgccaataatagctttttcgttcttcatcagtttcaaacaccatctaattaggctaggccgatgggtattccgcattgtaattgtcccccttagtcaggccgtctttcggcccatttatctcccactcccccgcgtccgtccctaatattgggccgcgcacgtgcgaagtcattgccgggccaattttcacgggttaggcccatttaagaagagagatcctcctgcttctcccctcccgtgctcccctttcttcccctgcgccctcccaccgggagtccacacccctctactcctcgcccgaaacctcccccttcgtgccggcctccgaccgagaaagcgcggcgtctcccaagccacgcgctcgtgtcgggcgaccgccgcgccctatcctgcaggtacgtgcccctgcttcccccacgttcccctcccgtgcgccgtgcgccggggctctctcgggcttccgggccgagacgg

SEQ ID NO: 59732 - DNA, 991 bp, Oryza sativa
ctcgataccatagcattgaaaaagtccatttttatacattcctcaatgatggattgagttccattcgtatctcttagtcgtaaaatcaattatagagcgtccccggccccaactatcaaatccagtgcaaattaagattctcagcggtttcattctacgtctcataacaatcagcatattgacatggttttccgttttcatagactcccggctggctcaaatgaggatgtcgatggggtcaacaaacgacgaggcacatcgagctgagatcgaagtactcctggttgacatcgatgatgatgacctcgccatcgtctgggatggcgagcatagagcaggcaatgaaacacatcagcctgccttctccatgcttgagctctactgcccgctggactaccactgctgacaatagagtggaaagggaagcaaagggtgagctggaggaagtgagaccccatatcagcctcatctctttgcttatacttatgcttatcattcaaaatttaaattttaaatcttaaatttaaagttgattttgggtttttcatcgaaatttattttttagcatttatttttagatcactaagaacatatatataaaagttttattcacaaattatttttcgtttggaaatatgttgtttcgcttattcctcgaatatgaaacgatgggggtcgtatgtatggtatttttttcttcatgtatctgacatgtggactacatagattttttttctaaagtgacactgacattggtcacattgagtttttttttatcgcaactagcatggtggcccgtgcagattgcgcggctagcatcattatattttctctcatataatagcatatatgttttctcattatattattaaaatatattacaatgacaacataattttaaattttgcaataacttttcaaaactactaatgtgtaataactactctagtcttctcttctaatattacttattttttaattatgaatttca

SEQ ID NO: 59733 - DNA, 503 bp, Oryza sativa
atagatcctgaacagcatcgcccttttggctgtcagaatctttttttttcttcttattaatatcgatccggagaaggaatggaattatgagaactgctcgtctgtacactgccgggtccatgtctccatgacaatcatggatcggttgggccgatcagaataataaccgtgtgaactgtagtgtgcgtgatctgtgccccatctttcttatactggattagctgttgtctctttctccatgtccctgaattcagtgagtaaattaatttaccctaaaaatttgtcctttgtttgcagatcagtctgacattcgttagactgtcaaagactgatcgaatcaacgcggaatgaccgacgatataataattaaacatactcgaaaacaatgcatgcatccatggagactattccattggattgcggtggggttagcggtcggcatgccgccaaagaagcgcacatgtgttggttctctgactgtccatctacatatatctgaaatc

SEQ ID NO: 59734 - DNA, 15083 bp, Oryza sativa
  unsure (1)..(15083): unsure at all n locations
tgtgagaatttctaggtcatgagagcgaacatgnaggctcctttttttttgcgaattttagttagttttaaattcctatatgaactctatactctacttctaatatttcttatttttcaattccaaatttctactttttttcttaattgtatttctatatgaactctatactctacttctaatattccttatttttaattcagaatttctattatttcctaattgtatttctatatggactctgtactctacttctaatatttcttatttttaattccgaatttctattatttcctaattgtatttctatatggactctatactcctcttctaatattccttattttttaattccgaatttcaactatttctaaagtgtatttctatatagactctagtctcctcttctaatattccttattttttaattccgaatttcagctatttctaaattgtatttctatatggactctgttttttctttttgtctgattaatgtgagaatttctaagccatgagagcgaacgtggaggctcttttttctattcctttaattatataatagatagattgtgcatgggcatcacgttaaatgaagactaaatcaatataccaaaccaaatcattcgaaactaccctcaataccattaagcaaatcgatttatattggttttcaaagttatggaacgttctatacctatgcgaaccaaattccaccaatagttggaggtctcaaagtggacttttccaatggcatttctgtttcctgctccctagtcgtccctactgtacgctccatgtgatctgattgctgtgtacctaaaacctaccagctggtgtactcatcatagtactactgactattgactattatagcaaggaattcaatacttatattatatacacatgtttaagttggaaactttttttcaaactttcaacttttttatcacatcaaaactttcctaccacataaacttccaacttttccatcacatcgttccaatttcaaccaaacttctaattttagcgtaaactaaacacacccatagtttaggccccatttgattaaaaaaattcataaaattttagaggattttatttctataggaatttttcatatataaccctttgaattaaaggaatggatcttatataatcctatgaaactcctatggaatgtctaatgccatgtaagttttggaggaaacctaacctgaggtagaacctcgtggaaactttcttttgagtctttatctctcttctaattcatgtgtttttcctgtggtctaatcaaacggtcattcctgtgttttttttctgtgttttgcaattatctgttttacacttatattcctattaaaattttccgtttttcttattcctacgtcttctcaaattgttgcacaatgagaaaacgctactaatattttttatacgtttatgctgtaccaacccaatcatatgttcattattttagtatgataaccagcaatcgtcgaacctcagcgaaaaaaacctgttcatcatcagttcgagtgttcaacgacctttgccctccatcccaaaatctcaccgtcaccagcaaaggcagccatggatccagccaccaccgagctgcggttcgacaccccgctccttcgcatttacaacgacggccgcgtggagcgcctctttggcacggaaaccacaccggcgggcttcgacggcgccaccggggtcaccttcaaggacgtcgtcatcgacgacgcccccggcgtctctgcctgcctctacatccccgacctccaggcttccggccccggtcatcaccgcaaaaagctacccatcgtcgtctacttccacgtcggcggcatggtcctcgactcgaccgcctccccgacgtaccacaggtacctcaactccctcgtctccaaggccggcgccctcgccgtgtccgtcaactaccggcttgccccggagcacccgcttccggcggcgtacgacgacgcctgggccgcactcagctggaccgcgtcagctgccgacccatggctgtcggagcacggtgacgtcggccgtgtcttcttggccggtgacagcggcggcgccaacgtcgtccacaacgtagcaatcatggccggcgccggccaatctagcctacccccaggagcaacagtggaaggtgtgatcatactgcatcccatgttttccggcaaggagccgatcgacggcgagaacgcggagacgagggagctgacggagaagctctggcccctgatatgtgcagacgcagaggctgggctcgatgacccgaggctgaaccccatggcagaaggagctccgagcttgcagaagctgggatgccggaagctgctcgtctgctcggccgagagcgacattgtgctggcgagggcggcggcgtactaccaggcagtgatggcgagcgggtggcccggcatggctgagtggctggagtccaagggagaggagcacgtgttcttcctcaacaagccggattgcgaggagtctgtggcgctcatggacagggtagtcgccttcctcgcgggtaattgatgaaagggatcggatgaaatcaaaactgttcttgcttatcgcaagcacataaatttgatcgtgaataatgggagattggggggagaaagggatgggattttcctcttgttctctgcaaccactagttcaagaaagatgcgctaaatcggatcaagttcaggctttgttagctgtggttgttaagctctaagatgaaattcatgaggtgtttaatagaaggtgaaactgaaagcgtgtactgggtatgatgatttattgtgaggtaagttcggtgtgaaatatggaacatgatttaactgtattcgctattcttgaataaatcatgctcagtaaacaaactgtactgggagcacatgacaaaaccatttgtcaactgcagaagttgctcacctaacacgatttcaggtcgagattcgaggagatccttcattttggcctttattgcgtgaatcagagaccatttaccacacaaatgaaccactaggtgcaaacattcctagctacgattaggttttacaccctccttcagagtatgataactgataagatacccaatattacaaactcaatagcatcatctggactttagactgacattaaaaaaatggcattttttttggtgattagacaatgaagaactagaatgagtacactcattgatgttgcagttttctaaaatttactcaactagaaatgaacaaaagggatagggcaaaatttcatagctatgctgaaccttgacgcacttaggaaattcataatcaactaaaatattccttttcttttccacttcaatgatgcaaatcatcaatgagaatcaaaatcatagacagtatatattcctccctttattactagttacgagtagtagtagtataatcgctcaccggcgacacgagggataaccgaagcggctggcttcaacagcgccggacgaaatcggtcacgacggcgagctccttgacggcattgtcgcagtcgggcttgggcaagaagaagacatggccctcgccatcggtctcgtggagctccacctcgccgtcccacccgcactttttgatcccctccgcgtacgcgcgcgccctctccacgaaccagcagtgctccgccgtagtgaccaggacgcggccggccccgagctgcctccactcctccggcgacgccagcgggttgacgcacgggtggtcgaggccgagcttgccggcgctgacgaactcccacgtgccgtggaacgagccgcggtagccggcgtcggtggactcgccgcccacggggtccttcccccagaagtaggggtggaggagcaccacgccgctgaccttgtcgccgtagccctcgatcccttccttccgcagccggatcgccgcgttgtgcgccatgttggcgccggcgctgtcgcccgcgagcacgacgcgggacgcgtcgccgtgcgcggcgagccatggctcggcgccgtcggggcggcacgcagcgacgaccgccctgagggcggcgaacgcgtcgtcgtaggcggccgggacgggctgctccggggcgaggcggtagtccgccgagacgacgacggcagggaccgccgcggcgagggaggcggcgtacctgtggtagagcggggacgcggcggtgtggaccaagaacgcgccgccgtggaagaagagcacgacggggagcttcttccccggctccacaccaggcgggaggtagagacgagcggagatgccggcggacgggtcgaggacgacgtccttggagacgacgccgttggcggggtcgccggatggggacggcgggacggtctgcgtgccgtcgaagcgctcgacgcggccgtccttgtacatgcgcaggacgccgggcatatcgaactcgatctcggaagcggcggcgtccatgacggcggcggcgacggtgtccgtgctgcggggcttgaggctgattgggatcgggagctgcaagagcagagcagcaagcggagcggcgagcagagccacacgcagcaaccaacgcgacaattctggagcgggtgttgccatcttgatggcgagcaaacggcccgaccaaccagagatccgctgacctgaatccgaatcctacgccttccgagtagacacgccatctcaaagtctctccaaatcgtaccttccaccactcatcaaccactctctgatctgtagtgttatctctgcttctgtagaaatccgtatcacattgcttacagagcacttgtttagtttccagttttttcttcaaacttgtaacttttccatcacatcgaaactttcctatacacacaaactttcaactttttcatcacattattccaatttcaaccaaactttcaattttagcgtgaactaaacacacctagaagttgatgtcttgacttccttgcttcctgcacggctgcacggtcatgccataaacagaccatgaattttggaggaactttaggtatttgatgtggtaataggaggtacagtatcatatttcttagcataaaattgagattataagaaatagcacttgagaatctagaccccaatttctgaatgctaattggaactatttacacgacattcaaaagtatttaggtgtcaaaacactcgaaatttcactattagtgagtgcttgggttttatgaaagggaaaaattgattaaaatcagggtgatgcttatggctagtgtgtgtttgagtgttgtggcttatttggaatgattgggttttttcaagacatcttggttaattcttccttgcaggtaatttacaaagctttatccttttttcagaaatggtgtatcatgttaagaaaagaagatcaagctactatgctaggttggcatgacttgatgatggagggactgaattaagtgaaaccatgttgccttcctgcagcggtgtagttgatgcttagtgtacgttagtaggaagtttttttaagtctgttattgtagctgcaatagtgggtgtcgttctgcttgctctgagacctggccctgtttgtcggttttactttagtttgttttgcttgtctttccttcagtgtaagactctgtgatgcttttggccttttgggctttcttataaaactggatcaatgcaaatttgatctgttaaaaaaaacaatcgaatttttcagccactgattcaacattgacggtcatggctatggttcatgggccctcaacaaaatacaatacaataaggatggcccatttgcaaaattcgggggaaatttgggaccataatggtgtagtcacatgtctagttacagcgtaaactaacgtgtaaaagtgtcacttgaacaacgtaattggtgcagctcagtggaaaggaatcatccttgtgaagcggagggtgcctggttgattccctgtgtagtttttctccaaaaaaattgccgctaggtttttatccattcggtattaatttattatcaaagttcttttgctatcaagtcctaaaattagaataagaatctggtccttctggactacccggagattctgagagtagttgtagacttgtagtttagaagctcttttaaacggagccttattaccttctgatagttgaattatccagagattgtaaacttgacactatgaaatgtggccatatttgacaaagtttgtcctatggattggtggtgagcaaatgattgaatgagatatttgcttgaatccaaaatatctcaaagtagacacaccatctcaacgtaatctcaaaatctccctaacttaatccgtacctaccactcagcttgtccttgatctagtgatgcttctatagaaaccaacatcacattacttgcaggagtttgatgccctgacctcgcgaaaatcctaataagagatcaatcgccccgcgtgatcacctcattctccacatggttttcttttttggcaccgcattactttcctattttagtaaatttattcacataaaggttatacacctcaagtttacacatctaaagtttatacacctaaagattagaaacccaaagtttataagtcaaaagtttatatatccgattcaaatttgaatttgaattcaaatattttttatatataatatttatatacatctaaaatttatacacctaaagtttatagacccaaagtttataagttaaaagtttatataccagattcaaatttgaatctgaatttaaatatttttttatacatagtatttctatacataaatttttctaactttgttttttttattttttaaaaaaatttatggtgtagtaggaacagaagaagagaggaggaagcaggagaggagcgtattaggggggatgggggtgatcgcccacagcgatcacccgcccattagcgtcacccctagcctcgtgcacgacaatgtcataaacaaaccacgaattccagataaattttaggtatttgatgaggtattgggagtacgattttttcagtgcaaaatttaaaatatagagatttagacatgtatattagagctagaggttctaagttgttggtgagaatttggtccaccacttctagagatattagttcatctcgaaaactggactatttgaaggggttagagattctaggattagcatttagctaaagctaccaaaagctcttccaaatgaggacttaggatctgtttgatggtgtttctagcagctgcagcttctctcacaatcgaaaactcactcaaatagtctaacttttcatatagattttaacaagttatagttgtacaatccagaaaataaattagaagccagaaactagattttctaagttctatagattctcaggattctcataagctacttctcaaaatctggaattcctgtttagggagttttaaattctgataagcaactggttggcacttaggctattcatatcacgtgtctagaattccttcatttttcttatgtagtaatcaaaacaattttgttgtgtatcaaaatctcataggaatccaataaacatgacattttatttctatgttttctcaatctgacgtttaaaaagggctatcagtcaataagtagcttgaaaaactgtttttttaagaacaacaatgagtattacattcaaaacttgatctagctaagtaaccaaacgaagtttcacacgaagcaattcattcccaagcaaaggtttttctacaatccaaacttcaggctgtctgtgccactccgctccaaggcgacatgggcggcgacactaaaccccgctgctagctcccctccctcgcctcctctgcctcgccgccgcctgagcagttgccaacaaagccgggcggcggtgaggaacttcttcttgctcgcaccacaacccgacatatggagctttgatgaggaacgagcggaggggcagagacgtggtcttcggcaccgctggtggctggaggcgatggatccgaaactgacgaaggaggatctgccccgctagcagctagatcgggatggagcagcgccggccatgccgcgtcgaaggccggcaaaggaggttgagccgctggcagagaaggccgagacgtaggcgaagggcgtcatggtgccggcaaaggacgttgcagcgcaggcggaggagatcgcggcgccggtggacgaggtggtggcggggccaaggggtggtggcagccacgagtggtggtggaggtggcggcatcccgtctagatccatgccgttctgaccggatatgggaggtggccgctggcggtggggttgagtggtggcggcgtcagctggcgatggtagctgcagtggcggtgatgatcgacaccagtgatggcgactgctagcggcggtgtcacccaggccagcgtcatggcagaggcggcgggttggcgtgtcgtcgacggcgacagcacgaggtggaggcggggaaggaggagaccggtgaggtgtcgacagcgggatgcgggcgatggcaacttcggcaagaggtgcgggcggctgtggatgagatacaggcgactagccgggagggagggggaggcatgggcgacgacagcagctggccgacggaggagccgacgtgactggaggcgcggctagaggtccgcacgacgcgaggaggcgcaaccagcgggtggtagaggccggtgcgttgtggcggcatgcggaggctggtcgccagggggcgttagtgcagcggtgccacgtgccggcaaaggatttgatggcagaggagcatcaatatggcggatgtggatttgcaggcggtgggcggcaggtgaaaacctagcctagccttggctgggcctgcaacgacgacgttttcaagcgtcttcccctcttgagggcattgccatgccgtcccatctcctccagactccagtgggactgtcgggtgaaaacctagtctcggctatccttaagaccttgacggacgacaacggcgatgtctttgtcgttcctctctctagagatgtcatctaggtagcccttggccgaatccatccagacaacttgtgcaagctcgctctctagatgcatgtcctcttgtgtcggcgccctagcttatgtaagttggccccgtcgaaaagcctagagggagagtggttcaatccttctctttcaccctctctccctcaatcccatagaggtggctggagtggggtttagtgttggttgttagggatatgttttgggcaatctcggctatagtttctttgttgttatagcggcggccggttcgagtgccagccttttctaggatttgtgtttggtgctgtcggtacatgggtggtggttttttaaaaaaaaaaactggttaaaacctcccaagattgtatcaatatgaatttcacgctgtccgatgcgagttgcttaaaaaaaaagaaacttcaggctgtcaggagaagggacgggcagatacatgaaagaagcaattcattcatcccaatatttgtcaacgcagaaacgctagacaaatcagtacccagcacgagctggtgtctttcccgagtccccgtcgggatgccgtgatccaccacaacaccacggaccaccaaaccaaagcaaagcaagggtctccgtcatgctcacattcctaggtcctccttgtggcatctccccaccaaaaagcgtcgtcctcaacctcaaacctcgcaattttctatctgttctccctaccaggcgctatttattcagattgagctaatcagccaccaaactcgcagaattgtggctgttttcttcctctccagcttccaatctgatcgttgtcagtgtggttattggagcagttgccatcgatcatggtcgccaagatcaagcgacagatcggcggcctctcactcctcgctaagcttggtttgcttctgctcgcgctgctgctgcttcttgctgctatcttgctgttggtgttcttgctcccgcgtcaccatcggaggccgttgccgccggggtcgccgccggtgaacgcctccgaccccgacaacatcgtggcgtttgatttctcgccgttccttatactgtacaagagtgggcgcgtccaccggatggatgggacggaccgcgtccccgccggcgtcgacgaggccaccggggtgacgtccaaggacgtcgtcatcgaccggagcaccggcgtcggcgcccggatgtacctaccgccggcgaaaggtgcggggaagaaggaccttgccggcgcgctgcccgttcttgtgttcttccacggcggcgcgttcgtcatcgagtcggcgttcacggccaagtaccacgactacctgaacaaggtcacggcgaaggcgcgcgtcgtggcggtgtccgtggactaccgcctcgcgccggagcacccggtgccgacggcgtacgacgactcgtggcaggcgctgaactgggtggccaagaacggcaggtccgggccggagccgtggctgcgggaccgcgggaacatgtcccgcctgttcctcgccggcgacagcgccggcgccaacatcgcgcacaacatggcgatgcgcgccgggaaggacggggggcagcttgagggcggcgtggccatcaccggcatcctcctcctcgacccctacttctggggcaagaaccccgtgggcgcggagaccacggacccggcgaggcggcgccagtacgaggcgacgtggtcgttcatctgcgacggcaagtacggcatcgacgacaggctggtggacccgctgtgcatcccggcaccggagtgggtaatgcttgcgtgctcgagtgtgtccgtatcggtgtccgaccttagcgacttcaaggagagaggcaagtcgtacagtacggcgctccgcgccaacgggtggggcgcctaggtgaagaagtacgagaccgccgtcgaggtgtacgtatacttcctcgacaagccctcgagccgcaagtccgtcaaggaggtcaccttagtcgacggctacttgagccacgagtatcagcagcagcaaaacggcatgggtgtcagattggtcgcagacttgcagtacatgattgattgataattactcattagtggagtaccagctagcacagttgtctacatgtcttcttgtcttgtgcatctatagatttctccattgtttgatcgatcggtcatccggatccagttcatgatgagtacagtgaaattgctggggattttgggggaaagttggatgctttccgtgcctgcagtgttcagaagaatcggcaggggagtgtaagtttctccaaagtgagtgcagagtgcagtcagaggattggtcaatctcgttatcttgtggtgaccgggtgacgcatgccgagcacccagtgcaaatattttactgtttggatcatttgttttcttcagaaacctcgtacggttgttcagatgtctcctggtcttgccaaaattatgcatgaagctgctggttattttaaacggtgtcaagaaatcaaaaccggtcaattcagaattttgtgctgctgacatctcaactgaactccaggatgactgactgcttgatcaatgcagaactgcagatatgttttgcctgtcaatgtttgttggggtcctagtggtgaatgcacttatttaggactgtgaaaggcacttgattagtgctgacgattcgattagcgaaacgctagaatgagcaatagtactgtgcctgagacaagctagtgtcgtattggcgatttggcgtagagtgggaatgggctgggatggcgaccacaggagacagggaaagatgaagaaaaacagccacaatttcgagataatacaatgcattgcaatgctttggaacaaaaacttcagaaccataccttcgatcttcgatgcacagattgttgccgaacaattacaaatttgaactgttctttttctccttttttcgacttgcccatatgtaattgttatttttcacctatcccaataacaaagaaacctgacttaaacgatcctacgtaagcaaaattagctcctccattttgtactaattgtttatggttgtgcaaggtgcttcctttcgtggggaggcaaaccaagcacacattgccctgagaaagcagaaagctcatcggatgtcccttttgtccaaacacagaacggcaaaaactgatgaagataatgatgtttcacctaatacaccacagtgagaccggaagaaggattagtaggttaaacgacaaggttgatcatgcctgcaaggctgcaacaccaagccgttgtttcaaagcgaagatccgtagcatgaagcacgtccataaagtgctagagagatgatgtcaagcacggctctaggaacctgattattattgactatagttgtaactaggcaatgattggcgttggcgaaatggcgagccagaagacaaaagttcacatcagccatcgtgtcacttccttggccaagtgcaattttgtgcaagactttgtggagctcaacaacttgtgcaactgcatctctcctcttctcattcaattcatgcctgataccatgtgcttggtttggtgatcaggatacaaggcagaatgttggtgattgatgaagttcggttaaacgaatgcacacattagcaacaggaactacattagcaacagcaacaggaacatagtccatctttggcatacattgatctagttcaactgaaaaggaaaaggggactgcctatttaatgattcacgagaacaccattctaaatcctactatttttaactattggattgccgtaaggtttatgcagattcctctaaccctaacctctctctcttttccttcttcctcccttcctgccgccacggtgtgagcgcttgatgtcactggcgttaccctgcctcctgctctgccacctggttggaagggggtctaaagaagctagtgagccccatcctgacccacccaagcagcctcatccccgccttctcttccccaaggcaatgacaccaattgatgcctcatcatctttcttgtctccgacggttcttcactgctagatacatcattactagccaccgcctcgtaaccagtctcccctcgtgttcccgttggcccaccgcctgttgccaaccccgcggctccggcacgtccgttggtatccaccgtccaccgttagttctctgccgcccacgaccattcctctaaagccttggggaaccgcaaccccaaaccataatttttatgtctcttgccatagttggggatgatgttggagaaaatagggaactcgctggagttagataagaggaagcccatgcacgaatattggctggatccgacggtccaaaatttgtaagttttcatccccaaatttctgtcaaatgccatttagcaaattcacatttacgactaattattttttaagtagtaggcgacgtacctatcgatagcaaggtggtgacttcgtcagtctcaagatttgttagatccagtttttcggatgtacttatataagggtaggatatgtgtgttcatagagatacgtgtatacgcattgtgaacgcatatgcttgtattgtgtttctgacaaggaaaacccattttctacgttgtgcaagtaaaatagaaaggacagtttttaagttgaaatgtagtgtgtcaatagacatctgtgttttacatggattcatactaggcgaaatcagcataaatcaaataacaaatcatacagcaatagcaatagacagcagcatgcccaatgcaacagttacccaagaggccattggattctctaccgatttacgaactcagcaatggcgtcgtcctgcctgacggcctcgtcgccgttgaagtccatcaggtggaagcagtggccatggccggccacctcgacgacctccacctcccccgcccacccgctcgccttaagcccctcgcagtacgcgcggccgcggtcgcggatcacatccttctccgcgaggcacacgagcacgcggccgcaggccagcccttccaaccccggcgcgccgtcggcgagcgggttgatccacggatcgtcgacgccggtggtcgccgggcacacgacgctccacatcttcaccacgttctccgccatcgccgggtcccagtcctctgaggggaccttgccgcggccgaggaagtaggggtggactaggacgacgccgttgaccctgccgccgtgggggagcccctcggcgccggctcgcatggccatgttgtgcgcgatgttcgcgccggcgctctccccggcgaggtacacgcgggagaagtcggcgtggtcggtgagccaggtctcctcgccggcgccgggggcgtgggaggccgcccagaggacagcctgccacgagtcctcgtacgcggcggggagggggtgctcgggcgcgaggcggtactcgacggagacgacgatggctcgggtgcgcgcggcgaggaaggtaaggtaggcgtggaagacgaagttgaaggccgtgtggaggcagaagccgccgccatggaagtagatgaggagcgggagcttctttccctcaccttccccgctcacgccggcgacgggcgggaggtagaggcggacggagacgtcgggggagatggcgcggtctttggaggcgacgccggtggcggcatctgtggaggccgggacggagtcggaaccgaagtagcgctcgacgcggccgcccttgaagatgcgtatgcagtgttcgacctcgaagacgacctcgccgtcgatgtcgccggagccagccatggagtcgggatcaactacggtaggtgttgccctgttggtttgttgggctgtgtgccttttgctttgctttggtattgaaggggccaaccgccaacgtggcccacgtggatgtgccacatgatcgtttagacttttcagtctcacgtgagccgttcgattctacatttgacggtctcgattgaaacggctcaatgctgcgccgccgacgttgtctcgcggcggcggtggcggcttcttcggcggccacctcgattcttccagaatccagatccaagttttgaagtggagtactccactagttcgaatttgtccgagatctcccggcgccatgtccgacgctggggctggaggcgacagcgacgaggtcatccacgacgcccccaacttcatccgcgtg

SEQ ID NO: 59735 - DNA, 500 bp, Oryza sativa
ggaattagtgctgtggacacacatgcatctttatatcttaatctactgtttcctccctcttaaacaaccttttaagtttaaaattggtttgatcaacttcataatctcaatctaaccattcacatttaaattttacttctctcatctccttaattccaatgaataattatgaaagcgtttatatttcagagatggaagagtactttaactacactgcatgtctgcatatatgtgtagtggatatcttcaattactgcaacaagaacgtacacgtgcgtactgctagatgggcaagctagctgatgccagcccaacattcgaacagtgttttgcagatggagagatcgatggagtgccgtgtgtaaatgtaagtctacgtacaatgcgtgcgtttaattgtgcgtgtgatgcatgcaatgcatctcgattggattgttcaactagtgcattctactccagcttgcgcttgctagccaatcgatccagtacgcatacacact

SEQ ID NO: 59736 - DNA, 560 bp, Oryza sativa
gggtggggtttaggagtaaggtagctagggttgcacccctactcttgaatctaaatatacattagaactgtaaaaacttcaaaaagtagagaattaaaggcaaaactatgtcaattacattagttgagccttagacttggaagaatcctggttctgctacacgtactgtataggtcacactgctccactcgatctctgtagccggccttaccgtatacgtacgtaggcataagtatgacatgtacagggatgggctctatatctcctgatgcgtcacttgtcatgcatggacacacacatcaccagctagctactgtacgtcactccactctctccatgagtcttctcgatccggtcttctctactgctctcctctacgacgaccttcgtacgtgcaaacattttccattggggcacgctcacctgatacagtccctgcttttatatctgaaccctgtactcttttttttgttcataccatacaccaaaaaccatcatacatcaatttggccggctatctcgtcgtcttctcccgccgcaccaccctgaacgggtcgtcc

SEQ ID NO: 59737 - DNA, 717 bp, Oryza sativa
tcgaccgcatcattgagagctgtcggccaatagaaaccctgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtccccttctaccagcacgtagcatttggagatgcgctggacgcgttcactcccttcgcggtcctcgggtagagtcttatctgtgaggtatacttggatctcagcgatccaagcaatcaatctaagggagctgggagcgctcccctcgggtcccgaggcctggactccgacgggcctcgggggccggtcaggcgcgtccgtctcccctaaggggtcgggtcgcgccgacggctgggcaagcctttcttcaaagggccacgccccggggcacggctcggttctgggccccttttggcgattttagccgacccgagcccccgagggcaggattgagcacgagtgacctatttcaagtcaagattcttcaaaaagaaataacagcacagacacagcctttaggaaattgaaaatgcttttattaaaatacagatataagagaaataagaatatgcatgtgtggtagcccccggccaaccctgcacgcccgaggggggtgcggggttggcccgagcccgaaacctgacacccgatccccct

SEQ ID NO: 59738 - DNA, 11292 bp, Oryza sativa
ggctggcgtcatcgtcgtttcggtggagtaccggctcgcgccggagcgcccggtccccgcgctctacgacgacgcgtgggcggcgctccagtgggtggcctcgcacgccgcgggtgaggggcaggagccctggctgaccgcccacgccgacttcgggcgcgtccacgtcggcggcgagagcgcgggcgccaacatcgcgcaccacgccgcaatgcgggccggtgccgaggagctgggccacggcgtgaaggtgaactcgctcgtcctgatccatccctacttcctgggcggcgacggcgatggctactccgagtcagacgagatgggcatggcgttgctgcgcgagctgatccggctgtggccggtggtctgcccagggacgagcgggtgcgacgacccgtggatcaacccgatggcggatggcgcacccagtctggccgtgctgggatgccgtcgtgctctgatttgcattggagggaaggatgcaatgagggatagaggaaggctgtattgtgagaaattgagggaatgtgggtggcgaggggaggtggagatctgggaggcagatgggcagggccatggcttccatctcttgtggccgacatgtactcaggcggaggcacaattacgggtcatcgccgagttcctgagccatggatgagatctctggactatgttgttccactactgcacacgatatgtccattgttcaaatagaattggatatcaaagtacattatcagttctgacttctgagttcttacaaatgtttgctttcaacattgtttttcaggacaatgttctactagcctatgaagttcatattcagactcagttagtgagctattcttatccattagaacgtttattatgtgttttacaaaaggtttaataaatctaagataccttagttcttcttacggacgtttgctttggttgtttttcagtacaatgttctactagcctatgaagtccaaattcagactgagttattgggctattcttatccattagaacgtttattatgtgttatacatatgtttaataaatgtaagacatgaatataaacttttcaagtcacgatagaaaggaaatactaaacagttttagcataaactagctcccctgtgtcaggtttatcttggagagtctgatgcacagatgtttactgctagaagtctccaattggatatacagcaaaacatcttttgtgtttctttttctggcatgacttcacaaaatattaagcactagtaagaatattcctttccatcttgttgcatgacttgttagctgatgtaatacgtcacgcatatgtgagaatgattacgtacaggtgagagaatgatcaacatacaatacaaggtgatcccagaaacaacctaattacttaagctatttgacagctgtgatgaaccagcaaatatacagaacatagttgtgagccactttgaagtactttccgtgctcgtacctcttggataatgtttttcagggaggccgtaaccatattgattatggagttccaatccccggctcgctgctttgtctatcctgcagggcatggtcgcatagatgatgtattggacaattcctttcatttgctgagtcaacagggttttgtacagttctgactttacctctttgtcttatcattgaccaaatgcagcttcctttcttatcttgggagataatgctgttgaataatctgtgagctatatgcaataaatgttattacagtaatcaaataacactggctatatgcaataaatgttattgtagtaatcaaatgacactttttttactagatgaacattgtattctcatttctgataaatggaaatgggaggagggatcacctcctcttgataaaagaaagtaatcttataatgctggcagtattatagatattacttcatcaattaattttcttttttgcagtgccagaaagattgacgtggaattgttatatggcagattgatagttcatgaggtaagcaaggttactattgtaagaactgcatgagtcatgagatgatgagaatttgagaagaggtctccaatggtaccagcaatcggacagcatcctgaactgaaatagagccatcgtcagcatacttggtaattacggcttcaatctgttgtgcgagtcatacattgcaactcacaatcttctattaaaacttattataagatgtttggttttctattagactttcttgtaagcaatcactcctctcattattaaaaaaagagagttaaaactgaccaattactgctaacgccgcaattaattttgatgaacaacattggtatgttacatatcatcattgcttacagttgtgcccataaaagtttatggtaccatttatcaattatttattgtgatgaaaatgtgttgtttgatgatgaactgaaatttgggattgggatttgttatattggaacttcaaagacagagagagtattgtagctgttgaataaaggatgctccaacattagatactttggatttgtgactagttttctgcaagttagtatttgttcttgtttcccttcctttagtaaatcattcgattattcttctgaccattctttgttcaaaaggtcttgaatccttaaatattttcaatatgtaatgtttggtattatcatgttggccttttcttggtgcagaagatcagattaggcttatatcttgatatgctgaaagtttacacttcacccctcatttatctgggcaaggaaaggacatcttttttctttactcaatttgatgtagagaatattgtttagctatagtgctatacaattgtgagtatgaaaaaagagagcatacctcaccactgatgtaacaaaaatccagctaaataaagatggcaccaatgcaatggagcttgtaaccgtttttctttcctgtggctgcatacatcccaaaatcaaatactacaatggcgcaccttcttctgagcttctatgtatgggctggtattatgatcttgttgctatttcttgatcaatttcggtcaatcaaatgaagtagttcacaaattggccatcttattcttttcgtagcgtgcaaaaatgcaagctagattggtttgaaacagagcatataagtgaaggtgaattttccaacatgaccaacattttgaacttggatgtaagaatttcctttttttttgttttgacagtacccccagcttcagggcactaaagcatcccttagtctaagggcaactgagaaagagatgtttatttgcatgaaggggcatatgcacagcatttcaaatcaaacttgcggatgcaagcctctcatccatcatggtgaagaatatctcactttccatttttataaattctcttagcaattatttttgtcacatcagtaggttcatttaacatccctaagcacagctggattaagtttcagcaacccagattcttttatgcataccatatttggttagttaatccaactaagcaataataattactgatagccaccactatcaataataatccaactaagcaataatagcccaagtaagtaatagtaatccttgaaatccagttgccaccagtttgtttattgaaaacaccttagctagccaccactattgacgatggttcaaacaataaagtgtgcactcttgcaacttcagttctatgttgcctctcatgagtaaaagtttgacatgtttccatttttatcacacgtttagattgtgcatcatgacttatcctgaacgttgttgaccttccctaccaccgatgccatgaaatttcttgtcgctgcatctatttatacttgcttcttatgttcatttcagctctcaaatcaccaccctcagaaatactattgtatcgtgtgtaacctatcctcaagagattagaaatatggagagtgaaaaacatatcatttgtagacatccaccaacttatggcaacctcataacagttctctcgattgatggtggagggattcgaggaatcattccagctgttgttcttacctttctagaatcagagttgcaggtaaatatttatgttatactatgagttccatttcgtggccaaggcaactctaacttgtcgagagataagttccaaggacaagggaaaactggtgctctagggttaggaaacggcatttgtttggtttgcttgttttaaatttaaaccatttagattcaaacttaattcagtaaccatatctttctataaattaagacatcctttcgtttcgaagtagatcttaattcttaaaaaccttttgcattagtgccagaatgagatttactgatcttttctgccatatgttctgtctttagccatttcttttatgcagatgtaattgttcaacagttgctcaggtttttcagcatttctttctgcatcgaatattccgaattcatttttgatacggctggaacagccataacaattattctgctaattgagaaaatctgattgttatgtcccatctatagatggtgaattgaatgttgtggtaccaccaaaaataaacttggcatgctaaattaaatttcccttttcatttcaatctctgtttgatctacatgctgactctctctctgtagtagcataaccgtgtgtgtgtgcacgaaatgaactgttcagattatacacagttcatgttcttgactgcttctcatgaaatcttttctgtttaatttctcaagaaacttgatggagaggaagcccgaatagccgactattttgatgtcattgctgggactagcacaggggggttagtgactgcgatgctggctgcaccaaacaagaaaagaagaccactttttgcagccaaggatattaaagcattttatatgaaccatgctccaaaaatttttccacagctaaggtgaatacatgtactgcagtttttttttctgatatgattcataacttggctggttgacattttgcttctctctttaggggtccattcggtaggatgatgaggatatttcgatcaatgtcaggaccttcctatgatggcaagcaccttcatgaagttgtaagagagaaattaggaagcaccaggctgcatcagactttaacaaatgtggtcataccaactttcgacatcaagtggttacaaccaaccattttctcttcctacgaggtatccctctttcccttcatccttctccctttaaagtctctcaagagtattttgtgtgttgttttggacacaagtgtctacaattcgtaataaaattcaatcaattcaattttaagggcacaagaacatgtattatacacaagtacttatttctctattttgctatgaaaataattcataggaattatttatgagccagtaataagaactcccatcaatacaacaatgatggagactacacaacatgaaccttatgctctcatatcataggttaagaagaagaacaacaacactatggatgctctgctatcagatatttgcatcagcacgagcgctgctccgacttacctgcctgcgcacttcttcaggactgaagattgtcatggaaacatcaaggaattcaatcttattgatggtggagtagctgccaataatccggtacgatgtctctgtagttgtgaacaactcattaccattgaagtgcactctgtgatgttgaaaatggtttggcaagtttacccagttcatatattgaagcgatgttttttccccaaaaggccctgaatatgtctatcttgtttaggctttagttgccattggagaagtaagcaagcagatattcaagaaaaatccagatttcttcccagtaaaaccaatggactacggccgttttttggtcatttcacttggcacgggctccccaaaaattgaagggaaatacaatgcacaaaaagctaaatcatggggagttctggattggttgcttgttggtgggtccactcccttggtagatattttcacacaagcaagtgctgatatggtggatatccacatcgctgctgttttcaaagttttacattctgagcagaactatctgaggattcaggtaagaaagagatagacagtttatttttttttatcaagtaatagccaacaaacatgattcctaatataaaaaaaatgccactttggaataacaggatgatactctcgaagggacactcgcatctgttgatgttgctactagggataatctggagaaacttgctaatgttggagaaatactgctaaacaaacctgtctcacgggcaaatttggagactggccagatgatgcctgcttgtgatgactcagaaattaccaacggggaagctctcaagaggtgaacatgtcaccacttatcagcctatttatgataatagtatctctcgttttataaatccatctatacttagtacccctgctatttgcagatttgcgaggttgctgtctgacgaaaagcgaattcgtgaagcaagatcaccgaaatgaagaaattcctctcttttttattcgtgccaaataggaatcttctctggatgacctccatatttgatagagcaaaatctggatcatttaatttagaacttagttgatttattcattgacttggaaatttcactgtaacatagtaaataaatgtataggtggcatactgattggccacacctgtagaatgtcaggccctgagtccctgatgtcctgctagttttgttcgtatgtaaaaaaaataatacaaatattcatttctaataaaattgagcattggactgccttttctgttgtgttgtcaacttcagccattttattttagccaaatgagtgctgaaggattgcaggtcggccatgcagcgagacaatcggaataaagacgtagcacgctgctgcatggaacaagtaccagatacgatttctctacactttgtacgtagaaatagataacctatctcttctttcaataacaagatgagcttccttttcagaacggatcgttttgcccctttggtacttccgatggccatgggcgggaagacgtccaattcccattggatttggagcgtgtacagactagacaaatgtatgcaaggggcttctctgcttcgctaactcaaagttgcccatatttattaatgacataactttctgaatgggctgcccaagaacctcatctgtgagtaccttctagcttttatcttgcacttgatgttccagttcactacctagttgccaacttagtaacttgctggtaaaaaaattgtttaacaccgaggtggaccaatttctgtgataatggtcttaactatatgccaagttgtatttgtttaactttccagcaaaccaatagcacaactcaggctcaatgagggggtgttggaagctattattttgatggatacaacagtgcgtaggcattctaaaactgacctaacctaaccatgtgctccccaaaacaagcaaacctggagcaccgaaagatctgaccagcgatcaatctcacacttgcgaggtaaggaatgcaaattgtgcatgaacacataaatataaatatacatgtagctagtaaagctgagacaattggcattttggaatcctagagcttccctttagctgggtggtagcaaaatttgtgtcaattaagtacaatgcttggacttcagccagccagacatgggggtcattgttagtgcaataatgctatatatttgatcgactatagttttggagaaagaaacacatttgacaagtatttcttgccatatagtatgccaaaatcctgaactttattgttcttgttagtggcctgcacctgttgtgtctcctacaccgttgatccagcacaactttacagagccgtcggcccgtcgcacacatgaaaagtatttctcctgtcaggtcataggccgtgcagttaataattaaaaggcaatttcctaggtcctgggagccgactaatgtgcttggccggtcaaaagactaaagagggctattcgatcgacggagcagaatgcaagttagacgccaatgcaacgagcgcctcctatgcatggtgccatggtccaagcaaagaagattcccagattgtgccatgcaaatgctgctgaccttttctgaatatcatgcaacatagcgtgtctgggcttctggcactccatgaatgtaagtgaattacatgagtttacatgcactacatctctgtaaaactttatgatagttaactttctaggttgaatttggtgaacataccattcagctttttgttagaatataccacacatgcagaggaatatatcgtttctgactacagcactggcatgcgaaaatttttgaatttgtgaaaatgacatccatggcttcgtgtaattcttcatgggtgtttgtgttagtttcttggcgcatctctctattttgacccctttttccctgttcctcgtactgacagctttgctgctttagcataccacagcatcgcaaattgcactttcttctccctataaattgtcgtagtggcatgcatccaaatcgaatctaagccaagaaactcaatagagaagagcagtcgcaatagcaagctaggagaagcaccaggagcttgtgtctttggccacctgaacagcacaagtcctccatacatttgtcaacctgcctagtacatggcaggtctcaagctctcatcatgcgttctggtcgcattgctcttcgtgtcgagccacgttgtgcgccacggcgaggcgaggcggctgaccgcgggggtggcggcgccggcgagcaagggcggcgaggaggaggcgccgcagtacgcatccgctcgaggcggccagccggcggctgctgccggtggcggcgtgacggcggcgtcgaagatggcgagcaccgacggccgcccaacctctcccggccacagcccggggatcggcaacaaggccaccggcaacgtccgttgagatcgatggacgatcacagtacagtactacacagtttcttcttggttggattgcttggcaattggcatgcacatataggcatctgccaatgtcagttcgtgcgtgctgctgcatgcatgcacactgtaatttgtttctccttttgttattggcatgcacatataggcgtccgtcagtttgtccgagctgtaatttatttctcagttcgttatgtaatgtacattggtgaacgcgtgttgtaatattttactttatctcaaataacaaagttgccgagattgcacacttttacatttttctgtcaatgttctgtagggaatcactaaacctgtaatgttaaatgcctaaactctcagcttgtacttgacacttagcttgtacttgcaggaattcaaacttaagtatgactcttactgcctcttttctaaaatatttgtcgttctacattctttagcatgtattaaggttaaaagaaaaaaattgtactatatcttattaaataatgtatagttagatgtgtgatggtggtggggggggggggtaaaaatgaggagaactttgaattagaagtggttgatgtgacaggtaatatttcaaagtggcaactattttttaaacaacttttaaatgctaaaaagacaagtattgtggaatgggaaaaatatatcatactggacattaacgtgtatttcaacgaattcactggagatcggttggaatctacaatagcacttacctctgttctaaaatataaatttatattttagctatgcacttggaaggatgaagggagtagtagctccgggtaaaagtatgtccctcaaaaatcattccctcatttttcatacatgtattggccgaattactctcactgaagcaaaacagagatgacatgcgaatcacgctatctgacgagtctccttttaaagacttggcgcagcaattattttctaaaaaatccttcctgtggttgagataaaatcagtaacttttaacttgtgctttgcgctaataaaacggtttaaattaagcagctgtgtgtttgctagtatactgccatagcctatgatgccctacagtgctatgagtagtaatatctggatatcttggctacggtatgttgaaaaggacgtgcatgtgagattatgtaccatcacgaagattcatgaacagttaaccagattatgcagtcaatatgtaatgttgaaaaggacgtgcatgtgagatcctgatatgtaccatcacgaagattcatgaacagttaaccagattatgcagtcaataagtactacgaacgagtggatatatatgtactggagtcttgacttttcctggccgtctctgaccttcctgagtgccatcacaactttcactggacacggttgtttgcctgctatttacctccattgaccggtcaaaccgtacaaaatgttaattaaccaacttgtttgctaatgctatctgagccgtttatatcgtccactgtggaaaactttgtgtgtataatattagcacgactggatgcagccagccattgtaatataccacagccaacaatgcgcatgcaggaagagatttctgaagttggaaaatatacggtgcaaaaagtgtctagggattttctacttgaagaaatctagtttgatagttgcacaaagagccagccattcgtgctttcagacagcctggctcgttttcattgttacattgttgggggtatgtctgttagcgctagtgtagactgtaaaggtaagtgtcttgtatatcccacctcttaattggtgacttaccgacatgccaacatgccgacatggataaaattatgagataacaattacttatatcgcttgttaaacttgctcttacctcttaccataaataaatatgagtactacagatttggacggggacacatgagggaaaacattccatgtagtagagggcttcagcagggggagccactatcaccatttcttttcatcctaacaatcgaccccttgcaaagaatgctacatctagcaaccgaggaagggcatccaattaccctaggtaatccaagtgcaagattcagaatatccttgtatgcagacgatgcaacagttttccttaatccttcgagagacgaagtggacaacttattgaaaattgtcggtgatatgggcccgagggtatcaggtttagagggaggagtctgccccccgatgccacgtgaccctcccctgaggggagtcaggcccgaggtggggtggtggccactcctgccccaaagactagtcggaggaggctgccccccgatgccacgtggccctcccccgaggggagtcaggcccgaggtagggcggcggccactcattcccagagactggatggaggaggctg

SEQ ID NO: 59739 - DNA, 2215 bp, Oryza sativa
ccctctctaggtcaccacgtacggtgggttaggtgtccgcctccaggtgcccacctacccgtatttatggcgacccgagcggtcgcaccacgccgcatttaatgcggtgtgcagtgcactcaaccggtctgtgaccggtcgaatgactgatgggacccaggatgtcaggcgcaccatcgcgtgtgtcaggcgatgtgcagcccgacatatcccatcaaataatgatggtgagaggttctcatcctcttatcccagccggagtcggtcctcccgctctggtcaaagcaaggcacccgtttcccggtgtaataggacccagaagtcttcacccattaaatggtgactgacaggggcaccccctgtgtcaggcagcaagatttgacaggccccatcatcaagacgacgtgcgcttggcctcccaagtcaagagacaagacatgcatttaatgcaaagattataatacttctccactggagctaggttagattgttgggcccatgtggtatccccttagagtataaaaggaggaccatgcctagcgaggaggggggatcggacttaggatccctgagccaaagcttgtccaaccctagcttgtatatcggggattcagggactttctaagcatagaagaatcatcatacacacaggagtagggtattacgcttcatagcggcccgaacctgtataagcctcttttgtctcatcgtcttggaggggcctaaccccctcaagatcacatagcttcgctcaccgagccctcgaatctcacccgctgcccccggccgaactcacaaaggggcgcctcatggttccctagtggaggagttcattctccgacatctggcgcgccaggtagggggcgcgttcgtgatttttgaggttctttcgagcgctggcgtgataagcgccgcgccgccgatgcggtgtaaggcacagcctcctcaggagtgtcgcgcgaccccaggcagggggctaggcccccgacatccccaccgggtaaggctagcggccagttctttgtggcgagtcttcggaatgtccgatggccctcaaagtttaggcctagcctcaccgagaagtacgacgacagcgtcaaaactccgagtccctccagatccacacgacgatcatagaggagacggggggtgacgaccgggtcatggcgaacttcttccccatggccctcaggggccaagcgcggggttggctcatgaacctgctgcccgcctcggtccactcctgggaggacccctgcagttgagctccggttgccgtcgaagcccaggatcccctgtgctggctcttccgtagcggctagctttggtcccgccggctggctacggtgcccggcccggctcaactaatcgtcctctcatgttttcagtattttcaaattttcaactcatcaacctagtacagcttgaaatcttatatttatttccccccattatattctcatggccctgcgacgcccgcgtgttgcgtatttgtttgctccctcggtggtaagagcccaacctctctcccatctacatgaacgattcttcgctaagtgtgggggctaagttttctagccttatcctagccttaagttgagccccgggtgccgtcgacgcccgggaccccctgtgctggctcttccgtagcggcttgctttggtcccgctggctggctacggtacccggcctggctcaactgtggacggggattgctggctctagagttttcggttctcacactcgtgcgaaagtaatcatccatgtagaaggaaaagagattggaaggaggccaccgaaaggaaagagcaaacataatgtgtagcgtgagggcgcaggctcgtgggaacctgatctcatttgctaagtggtcacaggcttcccaagatggtttggaacccatggtgggggggggggggctcttcgagctaaaggtttgaaaggtcgcgacatgcaagcaatgtttgtgtttgcttcattcatacaagcaattctttgctataagtgtgggggctacgattcctagctctatcctagccctgcgtcgagctctgggtaccgtcgacgcccggggccccctgtgctagctcttccgtaacggctggctttggccccgtcggctagttacgacgctcagcttcgcttgatcgcaggcgaagatctgacagccccatcatcaagacgacgtgcgcttggcttcctaagtcaagagaca

SEQ ID NO: 59740 - DNA, 1933 bp, Oryza sativa
catattgtagaacatgataaagtcagtagcaaatcgtagacgtgtgataaagtcagtggtaaataatggattctctctagaaagatagtagagatgaaaagtgtaaaatatgtaagttaactaatttaaagtgaaatgtttaaaaaaaactaatttaaagtgaaagattagtcaaagggtggtacaaagtgaaacttcagcactaaaagacacgttaacgtatcaattatgaaaagaaagctgaatgaaaaaacaaaatataagtttaaaagttaatataagagaatgtcagcctttacgtgacgtgttgaatcgtccagattgtagagaaaggaggtaactcacatgctgtcgacgatttagatcacaactatggtatttgtatgatatgagaatcgttgatatcaggacatatacgagattgaaataaaagagacagagacaaggatttttatacaggttcggaccccttattcatcagaatcaggtaatagccctactcttgttggacgaaactggtgttgctcttattcattaaaatcacacaaatacaataattgagataacctatctagtcgtcgtcgacttggcggcatggaaaaccaatacgtagtcgatgacggggtagttttcctcctcaaatacatactcggcgagatcagagatagcgctagatcccacttgacggcctccgatggcaccagattgggtatgtcgacgctaatctccgatgtcgatgtttagcggtgtgtattgatgtctattctgactgttctgtgtcctctcttcctctttctcttaggaggtcttatatttatacccatagatgtccacttgtctaagtagaattagggacacaaatatgaatacaatctgagtagtctttatagtttcaatatagaactctacttgtccttccttattcggaactccttttccatatgaggtatgattccatataagacttggtatatggtggaccccgccgtgcttagtcgactactgttgggtatgtattatccataaccctgacacatgctatgatctcttagcgttggtagacacaacgatgagctcttattctcgagtgacagcgaaatggcggtggtgagttagagtttcgtttttaggtggggtcaaggtgggataggagtaggaaagaggggaagagggggatttcctcgagcttagagggatgattgttggtgatgacggataggtgacaacacagaggggaggggttgccttagtttggaggacacacggagagggagaagcctagttggctgggctcaccgcattgacaagctcgagggacttaggagatgacgggagagggaagccgcatgtcatggagtggggaaggagaagagattaggggagagagtaagggtctacacgaatcttgatgcagttctagcattcaaaaagttgaataaaactttaaaataactgaaaagtagaccatcctaatttcttaaattcaaaaaatgttttggattttaatacaacgaagagccaaaggactttaattaagggagctattagccatcctataaataataaatatgttatgtcaatctatgtctacgtaaaatagagaaaaaaaagagcgaaatatagattacacccttccttttaccaatgttcagtaaaaggggtccaaaataaaggaaaaggtacgataaaacttctgtaaaatcttctctaagatagttaagacaactgatacgacaaggatcaatttgatcacatccaagcaagacacttatttttgtttctctatttcttaattgtgctctatatctgtcggagatatggacccgggggtatgtgaagtagaggggaattactttccctccggccacgtgactttgcaagttagccccattcacgcgtcacgcgagtcgttgaagcgggggggggggggagg

SEQ ID NO: 59741 - DNA, 3649 bp, Oryza sativa
atccccttgagctataaaaggaggaccctgcccactgagacagggggataacgcccagaaaacctgaactccagaagagaggaagtgagcgcgctttctagagtgaagaaacctttgtaaaactcatccataatcccaaacacaggagtagggtgttacgctccatagcggcccgaacctgtataatccaactgcgtgcaagcttgccggtaatcttagggacgagcaagtgatttccgagagacgagcctccgcccccggccgaactcacaaatggggggtctcacgattccccgctattgaggatcttccctcgacaatatcaccatataaaattcatgtaacaccacaataattatatatggaagtaattttgttgattccatgattattaatctataagcaaaaagggaaaataaaatgaaagaaaaagtgtggaactttgcttgaaccaaacatggcattgccaccaccaacctattattgtcaaatgcgttcgccgcggcggtcaactccacacccccgcactttcctcactccacactccccgcaccatgcaaaccaaccatgcaatcccccactccccctccccctctttaaagcaagctcccaccaccccatgcaccccacagcccattgacccccacctctcgccatgccatcgtcatcgtcatcctcggtcgccgctgccccttctggcagcaatggcacccgccgcgacggtgggagcgggagcgtcacgggctgcctcccggctgaccaggcatgcttcgcgctttcgtcgtcggccagctcgccaggctacctgcacgcctcggccacaacgacgcgtcgcgatgcttctgccaccgtggcgcgcgcgtgctgcaccaccgcgtcgtacgtcgtcgtcctcgggatcagcttcggctccctcctcgccatcctgctcatcctctgcatcatccggtggtacctcgtgtggaggtcggcgcgaccacggcgggacgacggcgccgcggatgaggcggttgggtcagccaagaagcggtcggctgggctggatgacgacgccatcgcggcgctgccggtgttcgcgtacaagcaaagggaggagggcggcggcggcgcggtgggggcagcagaggaggagaaagaggaacgggagtgcgcggtgtgcctccccgtgatggccgacgggaaggcggcgcggcggctgcccagatgcatgcatgtcttccaccggggctgcgtcgatgtgtggctcagggagcactcgacgtgccccgtctgccgcgccaaggtggttgttaggccggccggtgcggcgcgcgttgagaagttgccgaagagcagcgcgtcgcgggcattgacatcgccggtgccggcaccggcgccgaggccgacggggacagtggtggacgacggcagggagagggacctcgaggcgcagcagtagattattctgtagtagtatatgacatgagtgtagatttattagaaattaattattgttgtgtttttttcatgaattgcttactctctcttttttattattgtttttcttcaattatttatgggggtaagttgtagctttagggatgtgagaaatatgagtctagatcaagacgcttacgcaactatttatagggttgtactatgtgacaataaatagaacgcagataatgtctgacaatatcgcggtatcttaatggtgagatctctgaactttcaatcgcttaaagatttgtgttgtggtgggacatcatatttcatagtcagctgcatgtcttcaatggtggcaacacgcttggtctttcctctagataattttttcgtcttctctccgtgattgtgaatcttatatatagtgctttcctgactatctttcctcggtggtttctctcataagtatgtgattgtgttatgcgctttgtgtccatggcgttgttgcatgagtggaaaaatgacattctttggatggcgcccgtccagctctctctttctttttgcttcacgggtggtccatccgacagtggtggagggcttgtcagggttgtgtgcatgtcaatgaatggcggtgcaaaagtagatctagtttaggattggggcatggcctagctgatgttttttcagcggttttatggattccatcattggagcggtcgagctattgcggtctttaaaactactgtgcaattagcgctatctagattttgcttggttttcttgtttgtcctcacttccactaatgattggatgaatggggatatgaaccaacataaagtgatcatagttacgactgaatgcggtggaggggaaagctttatcaaatttaattataatttttatggttttttctatactgattcttgtttttcataatataaatcagatataaggtgtccctaggacgtcgttgttaaaaatgaaaacatgttaggtctttgccaggctataaccaaaagcagtgagagtgggcattctaccttaactattatctcttcatttaagaaacaccctgccttatttataagaaaataataagctattgaaaaaaaatcttgatatagtaaaactaagctttatgcaacattttgatcccataagcatggtattatattgcttcaaattctatctcgtacctataaaaccgggtaccattggtctctatatacatcaagtatgcatttgtactgctacacgtactaattattttttacaaaattcttacaaacaatgatctcaactgtttgatttaagtagatggaagttataagaaacctaaatgtacttataatgtgacacatagtaagaatttagtaatataaatacttgtcgttttgtacaagcctattatcaaacttttaaagatttgattataaataacatctacaatatttatcttagaaatatgatgaccatatatatatatatagattggtcttaaaaagtatttgataaattaatatccaccgttgatttctaaaggataatttagaaatctatacctaattaaaaatacataaggattccggtggattttcgtccatcttcacctaatattttcgtccgcaacgtccgatatgcgagtccaagacaaaaaaaaatcatccagagtccgcatcaacaaccaaatgcccgagcgatccagcgaaaattcatcacaagcataaatacaaaatccaataggacaatccagcgaaagagaaaaaaattaataaaaacatcaccggaagcctctgacgccgtcattgccaccggatctacatgcgggtagccactggatccaccgcaggaagccgccgctgtcgtcgccgtcggatccgctgccatatcggcccacgagccggatctgcacgcaggtagccgctggcgccgtcggtgctgctggatccaccccgggaagcagccgccgctgttgttgccgtcagatccaccgcaggaagccgccgtcggtggcggatcagcccgcgagctgggtctgcacgcgggtagccgttggcaccgtcggtgccgccgaatctgccgtgggaagccgtcgctgtcggatccaccgtgggaagagatcgggccgcgggaagccgtcgcgctccacccctatctctccttatccactcgcgaatggagtcgtgccctcgtcgtcttcgtgctttgccagtgagacagg

SEQ ID NO: 59742 - DNA, 2011 bp, Oryza sativa
gagaatcacaaaccaagagtgataatgatctacaacaccgcaccaaagctcgatcccctccctcacgaatcgaatatggtggaggagacccacaagctcaaatgattcgatcggcgaaggataggagacacaaggggggaggcgataaggggatgcttgcacacaaattctctgcttttttttttgtgtgtgtctgtatttttggggctataatggaaggttgcgcgtaaagcaccactactgtcctgtgctttttcggtgggttaagcgttggcgctcgcaaatacgcatatttatcaccaggtcctcatgttcttggtttttgccgcatgtgattctcgtttttttttatgcttgcgaaacaggaggtgaaaaatctttgaatagaaaggagtatatgcggtcgttgatccatggcgttctatcctggaatcgcccactgtctatttttaacgaggttggagaaccacgttggttagcctacccatgattttgcggctagtaaagcgtgcacttgttttttttaatctccaaaaatgttgtatcgatgcatgcttttcaacttcatatttgcatatttcactccgaaaaacattgtgagacggacacaaaggtttcgaatatgtgatgagttccatcaaacgctcatatgcaaattgactatactggtaagatggctttatctttatagatcttcagtgatatgtagggcctattcattttgatgacattttcaaccttatcaaattttgataaagttgccaagtggctacatttagtttgctgccaaattttggtaactatataaaaaatcctcccaaaattttggcaagttaccaaaattttgacaactatgccaaaatttgttaaggttttttttggcatcaaagtgaacaggcccgtaattgtcttatggtttcttcactatctacctgtgatattttttttcttccttatgttctcattttgtcccttcaatttaatgtttttatttagtagccatgattgctggaaataactcatgggatctattgtttgcactcgtaaataaactagaagttactcctactcctcagcctagatccttgaacaatatacggtaatgtgacatataagtaacatattatagaattgcctgtgttttgaaacttgtagtttcaaagaggcgaatgaaaaattatgcgattgtgatgttttattgtacacacttaggtcgatagacaaatggcctagtgtctattgtttgtgatgattgtcgcttgttttggctttaactctaccatattgatttctatataattttcttaccaaccgacgattggtgtattgaaatagttaggtttaaaatacaaaataaaacaatacaggagctgaagaaaggtgaaatgcatcctgtaaaaaatatatttttactaaaagatggtaagtttgtctcttcattttatgcacaatatctttggcactaccaagaacactggaaagtggaaactactagcactacgaagtttagaacactctgatcaagctccaaaatgcacatctaaaatgaccatatggttccatcagcctgcactgatcccttttgtaggtattgctatttgctaaccctgaaacctggaggggctatttgctaactggccacgttttcattttttttttcttcctttctcagctttttggaaaaagaggggttttgtagtgggaagtggttcgagaggagctcaaccagaggcgtccttattcagcttttgcctagtggaattcagattaagaattaagccaattcaccatctttggtctggaggactagaacaaagcacagacacaagtgcacaaattgcagtagaggtgccaataattggacggaatcgaggacactgttgccatactgcataggtctgcgaggtgatggatgggatgggagatttaacctgaaactgtggatgctcaaatttatgcacctttgatgtggcaggaagcaggatcaacaattttgtggatgtactatggg

SEQ ID NO: 59743 - DNA, 1351 bp, Oryza sativa
aagtttggattttggttaaattgaaaatgatgtgactgaaaagttgtgtgtgtatgacaggttgatgtgatggaaaatgactgaagtttggatccaaactttggatctaaacacagcctcatttcatctctcaaccacatatatatttcttccatctgtggttatcacctttaatttctacacgtacgtatcttcactccacagtccaccccattacttgtcattttttgtttttgcataacaagattatcgaataattatttcaataagaatatggtgggcgaattggccagtttgtagaaacatcagagtactgctaactgcagtgtagatcgaccgacttgacatgttacttcctttcaaggattcattagaaaagaacctacaaaaatctactattgaatcttctacagtctctagtttggcaacgccgcaggccattattttcgtcatctagtagcatgtgtattgctttgttactgtgtgttgtgattaatagcatccggacagtaccattctttccagctggtagatagtcagatagccatggacgtgtggaaataatcagatgtgtataggatcagtgagcagcgaccggcagttgggcgagtcgttggctccagcaacgacagggatatctgatgggactagtgcccctggaattcgttcatatacgaggacaatatacaggcttggcagattgcaacaaaactgtttgctgctgatcgaaatactgtcaatcaatgtctccatatgttatatagcgcttggggaatcgctcttaatcttgcgtttacttaagtctctgcaggcgcacgatcagtataaattaagagacgacagacgttgcctctgaatacaaaatcgatctcacgcgtagttagcatacatatctgcacccacaaagctaggcaagctagccgatcggcgcaaagatgagctcgagcttattagtggcagcttgcgccgtctcttttgtgctgctgtgctcggctgctacgtccccagcatcggctgcagtctacggagttggcggagggctcttgtctatcccttctaatgattccctggctcattgcccctctcgttgcggagatgttggcatcgactaccccttcgggatagcgccgggctgtttccgggaaggcttcgagctcatctgccgcaacaccgccaaaactcctaagctctttctgggtgatggtactactgagatcacagacttgggttataggtatgttttggcccagatatacttcaacattacggtgagaccaggtacggatacctacaacatatcctgggtggccccaacagagggtattactattgatcattacaacacatttta

SEQ ID NO: 59744 - DNA, 1558 bp, Oryza sativa
gctgttgactttgatcggtgaatcgggtgacggctgctgctgctcttcagctttgttgttgactttgatctcaagtagccgctcaacgggctgtcggcagatcgggcaccgggtcgtctggtacctcaggaccttggcacactcgctgcacatacactgtaccagagtatacaaatgtcagggtttactggagatgctaaaaatgcatggaaatggctgacagtcagcaaaacagcaccgatttgtttgaaatagttttcagaatacgaaatgtgaaccaggtaagccataagcataaaaagtatggttttagaaacagaataactttgtagctttatttaacttgatcatggacccctaatgctgcacatgaactagtcaatacacaaatcggatacttaccatatgcctacatgggagaacggtagtatcccttggctccgagaggcaaataacacattctttcccaggatcattggcatcagcatcgccttccaccgagtttcctattccatatatttcctgcaactcatacctagttccattgacccaaaggatctggctagcaactcgaacttgataatcaccgctttctttcttttcaaacagagcctgtgtgatctgtgagtttggagttttcatcttttgatcttctccttccaacttttgatcaacaggcatggttgtttcagctttaactgcaagtggatatacatccatgtccccctgcttcaataactcggaatcctcaaacacggagaagttgattccagtgccagaaggctgtctgaacttctgaccaagaccctctttgaagcttacagtaacaggcttaatcaggtcttctttcaccgccgttagattgcagttgagctcttcttttgcaaagaagtaaacagtcatgctgtccaaagaagtagaacaacaagaattgtttaaacactttgtttgttcgtattaaaaataaagatttactttgtttgtagtaagatattcacaatgcttgacacatacaacatgaatagtaatgatgacacaagccataagagcaggtacaatagcatactattagccagctataaacatattttaatgagataaaagatgagagagaagagcaacgggctacagatctgtagccagctgcagcacggactccaagacgtaatgtgtgtatgacaggtgggaccatatattaatagtatattaagtaactattgtatgaattggctattagattggctatagatgaagtggagctagtagtaggctatactattaaacttgctctaattaacaataacacggctttagtacaaaacagtaggaattctctataagaatatcagtaccacattccgaggaaggatgagccaaattgtgctgggtaatgtgattcccactaccacggacaattcaatggagaaaaattctaacacattcaaatatttaacaccctatcgcatttcaaactatttgtgagaaaactgtagcaagaagcaggatataacagaacgttattacagcttctggaacataaatgcttgataagggaaaa

SEQ ID NO: 59745 - DNA, 785 bp, Oryza sativa
tttggatatcatgctcctttgttagcttgggttataacatgattagactttggctaggacttgcttaccatgcttagttcaactagcacacattggggatctcatttaaaacctagactataggtttatatgataatgttggtttaataccaccactctgatgttggttaaataaaatgaaccacatggtgggctgtgggtgcatggttttgctagtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggtctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaatttggatagtttaggtggatggttgggcctgtcgcaacgtgggttagcgttggacagcggatgtttaatactgtttaatttttacaactgttttcg

SEQ ID NO: 59746 - DNA, 770 bp, Oryza sativa
aacgaaggacaacccacaaattatggaagtggtgtaataaatctggatcaactctgaatttatattgcaatcagttctgcgatctacacttatctatatgatcacacttatctatgtagtacgatttattttatctacaatctgaatggcctcgtaatttctggttcccaattttaagccatttttgcccgaaatcgctaataagcgactagtcgcgcgtgtgagcgcgcgcggcgagttcacccctactacttctagcctaacactgtttctataaacccacgggtctctgttttttgggcttcttcgtgtcgtgggctttcctgaaatgggctaatagccctcccgcgcgcgacacgacagaggaggcggcggtcggcgcgtatgggcgtacggtttcccttttttttgtttttttttccgtatcttttccggttttatttttttccttttttttcttcccgtatatttttgtgtttgtccgttttttaatagtatatgtatgctaaactctgtgtacgtataaatacaaactttatatgcatgtatacaaactttgtatatacgtatgcaaacttttatatacgtatatacaaagtttgtatgtgtattttttggtttttatacatacgtataccaactctgtatacatgtatataaagtttgtatacacatatatatgtttgtatacacttattttttaggttttttatacgtatacacacaaactttatatacatgtgtatatctttttatacattaaaagtgca

SEQ ID NO: 59747 - DNA, 6194 bp, Oryza sativa
ttttgactgacaaatgggtcccgttaaaaatttttcctttttctttttttcttctctttttttccctttcttctcctttctctatgacccgagcagaagaaaggaaaaaaaaagaagaataagaagaaaacgaagaaaaataaaaagaaaagaagaaaaaaaaagaaaatggcacgtcatccatgtggcatgccacatcagcgccacgtaggatcctagaggggatgtgtcgatttgggacctagatgatacacttttacaagttctgggacctggatatgcattttgagagtttagggacctatatgagacaaccatacaagtttaaggaccgccaatgcactttactcttcattttttgccggatgaaactgtggattccgttaaacttaaatttctggtaatggaatcgggggaggggtctcctcccttgctcaaaagaaaagaaggcatagtgagataagacgtgctaaatcgtattagacaatgccctttactagcgtgtcattcaaaagaaaatgtgtataaaattgtacgacctgttattatctaggaaattggggtttgttttgtgctttatgaaaaaaaatcatgattaactgctggtgccttatcgacatgtaatggaagcttgagtgatacacagtaagataatatgttctgaggtagataatatgttctatctagtataagagaatcaaagtgggtggaattgtgcaccatctgtatctgctagatagaaaaaaaaatttaacttacattattctttcccttttcttgtctgtcatgtaagcgatatcttgtgagagggagtgcagtcgaggagaagattaccgcctgataaagctttccataattgattttaaggtgagaaattctaacttgtccaccatcaagcacctactatttttgtgctatatatttccttggagttggatctataagaagtatctttgctcataagagttaaatatcctcatgaaactgcgatgctcatttgacagaacaagcgagagaaggtggctgtggtggaatgcaggggccatgatgctgctcggttgcaaaacattgaccatttgcatgggtaactactttttgtcatggatggatttcattagaactaatgcagaatttactatctatcaacaatttctcaaataagaggattgtactgagatactgtgaatactcattttctgaggctctgtaggcacataattggattacaatgaacaccaaagcaacatactatagtagcatacttcgaataaaaccgagaaaaggataaatggctcattgtaccaattattagtgctatcttgtgtgtctttgttctctgtttttcattaaaatttctgttggatgcaacacactgtttcgctgtggcattggttctttgtggtactttttcaagcaaccaaaatgctgttaattaatgcataattgctttgggtcttactggcatgaagttggagttgtagattaatgctgtaacacctttcatattcccaaaatgctatgatgtgtgttgattgtcttatctttaatcagatatctttttgagaatgcacataaggattgcacatcttttgtaattagatgtcttgcataagttctaatgagtaaaggaagtgtgaaaaaagtaaagaggggattaagcagagtgagatctagggtctctcttggttgactccggtgaatgatggtaatggttaattatagtctgaggaaactgtggactcggtgcttttttactatcatttatttgttttatgctgagcgtgaatttttaatccaacctcaattttcctgaaggaataaatattttgtgcagttgggaagatgacattgttggtttggttgaaaagaaacatgggaatcggaaattctcgatctctttcgaatgtgagacactgaaggctgataaagctgcagatgagcacattagcaagtatatgccaaatctaagtggaatggatgccatcggtaagcacatacctatgtcttttgttgtttggggagtgcgcaagagagattcttggccttccaccatagtattttagttcctgcagaagtgttggggacttggggtttagtgtcaggttgtagagaggacatgtatatcggcaccacactagtaaaggatggatggtttaattattccgcaccaattttatcattgatccagcttacatttgagtgcaagtttccactgtgttcagtgtgcaacctgttgaaaaatttctactactaattcattctattttacactgcagtaaatatagggaaaatgagtatctctggcatcaatctggacgaggacgacgaaccaagtggagacaactaaaagcagaggcacatttgtcatggtgtggtagcagtggctggctggcccttgttctcctccctccttagcttttgaaacctcgcttttgaaacctcgaagaaggcgtgactgtgtggttaccatcaaacgccaaaattgcatccaaaaattacgtataccttggacagtcgtctgacattctcagtaatctgctaatgttaagtcaatgtggtttgtggaatcgtgggcaagatgtttcaagaattcaagtactcctaatcaagtgtttagcgtaatgtttgttgctgcatccgacaaaaaccctggagggattgtacacttcggtttggttctggtaagaagtgcagtccttgtctctgccgctgccactactatttgccatgcttgtacggcctcactgaacaaagcttgtctggttatgtgtcttcaattctgttgcgaccgtgagctcgtgaatggggtccggcttaggccgggggggctcatctagctcgttcggctcgcacatggcttgtgcaggacacaaaggaacatgcgtatctaccgaggattcaaggatcagcggtggtagcaggctcggattggacattttctaataccacgaatctaaacaggctgtatatgtcgccatgttggttctatgctcttatattttatgacggagatagtagcaaccaatctacagtaccaagctgcaacaggagtactgtgcatgcttccgtacaactgcttcaacgtgtccgtgttacacaatagtaaaatgcttcttctccaagagcacccaaagcatccaattgttacggagcaatatcatcatgaagctttggccgtttggttggtcgaagaaaaacatgtactttgctctggaaatcatttgagaatcctggattgatcatttcttcttcagccaaaagtcaaaactccaaagatatcgcgacagataagcacagaaaagaaaaaggcagtagtatgatatttgggcctatgcccacgaacaaaaggaacaaaagtctaggggagaagataagatttttcaaagcagtggagcccagctaaaccatagataccgttcatgggccccacaaaacggaacctgtccctcccgtccacgacatgcctcccactacgcccgcacgcacggcaggacccccctcgatcggatgccacgtgtcgcgcgacacccaaacccacggcccagatcgcttgaccccgtcggaaaggaacggcagaaagggaatggaattggaacgtttctctgacacgtggggcccacgctacagtgggggtgggacgcgtcgtcagcgatttcgttggcctcgccctccccccctgtctgccaaaagaagtccccggagaaagtgcgggcgagaaggggaggaggaaataccgaaatagaacgagagagagagagagagaggaggggagaaacggaaggttggtggtggtggtgaaggaggcggtggtgggatcgatggcgtcgcgcgtgcttccgtgagatttgtgatcgcgttcgtggtcgcaggtgagccgcattgccgccgccgccgcctccacttgtgttcttcaaccgcatgacgcattgttgtttcccttagtttgtgggggaggaggggggggggattgacttctcgcatgtctgcttgatatggtgaagtgaatctgattctgcatgcggatcgctgggggtgcagtccgaaggtttgatccataggaggcgtgtgttttgcttaattgcttgtgataattttgggattgtttggtgtacatcgtaacttttgttcatttcatattttataatatgtgcttcgctgcgaatttggtgcctgttcaagtggggtgcctcatttgatgaattctatttagagcttttagcataactacgtactatgatctctgtataacttgagttatctgctggaggcagaaatttccatgtggttcctacatacacgaacataaatgcattccgtaatgccattatgaaacagagttctcattacgtgcggcataacagaaccaaaactgtagggcgtatgctagtagtctgccatatttactctgtctgtaactctgtaactttgtttatgtttgtttgttatctattgaacatacccacctccaactaacggattaatagcttataggctgatatttagggtggatgtggaagccaactcaacagatttgaagccactgcatgaggggctaataaataagtctacatgcttcactttcttgtggtaaacccttattcctattgttgaattttgagtttcacgggaactcacttcgttctggattcctgtcacctcatatactttactagtagtatttaaggaagagactgggccaatcaaatggttaaatcacatgtatattttcactttagctctgaatggagagaatcattctgcattcagcgattaattattgaagtttgatttttttaagactattgatgtttgagtcgataatatcattgtgccacataatatttttgtaagaaatatggtgtaaatttatcacaggtaaccttgtatgctgtatcagtctctagagaaatatcaactcattggtggaaaagaaacattctggtgtgttcataactcagccatttagagaagacaatgtcagcttcggagttcaggattccttaccagcaagtaagaggggatatgctttccttacagtcattccagtatatagttcaccatttaaccacttaagtaaaagttcagttgattttgagtatatattgaaatattggactagtgcaattcattcaaagtaaaaaagtaaggtgaaggtttcattttgttgatagagtgaatttctgttatatgtttcattacagttatgatgttatttcaagacaatattttagcagtaggccagttacttcttcaggcataaagagtgaatctcattgaaggaacaaaatgaacatttcaatttttttcagcagtctcggtaatcaaagttatgaatataccattgctctatagcacctctctctggcaaaatattagcattttgtctcaagacctccttatgacactatattaaacactatgggcacacaatacctatcatgtaaaagttttttatttttgctaaactcaagtttcacaaggtcaattacatcactttactgtggcattagtgagtattcactccattttgttccatacttttgataggtatcatcttcacagactactgagaatgcaggccagttcaagatctgccgatgtggggaaggagacccaaatacaaacacatctgaaactggtgataaatcaccaactagttgtcctaattgccaggtttgtgagatttcttgcacttaaaacttgtgatatgtatttatctaaataacctggtgaacgacttattgtaagctacttgagcaagtgatacacgacttgacacatcactggtttgtagctaaattaccggattgtctatagatacataagcttccatttctatgcatatttgcagcttattcatacttgaaacttcacttttgatattgatatgtatcatttgtgctttggggagcatatgaaaggggggtttgttgaattcttatcgtaaaaccgcataattagttcagagctatgttcagtggaaaaagaagtagacatgattgcttttatgcttcatagtcgcatgcacaagtttccatgaccaattttaggtactcttctgatgcaggttcttaagagtggacatttactgctctcatctaaaggtacgatttgcagtaatatctgtaacggttgcatggattctgtttttagcattaatagatactccctccgtcccataatataagggattt

SEQ ID NO: 59748 - DNA, 624 bp, Oryza sativa
tgatttaacttcattttaataagaatgttttcaaattactagccagtgcattttgtcacttttttatatagaagttgttttaaattataagataaatatttttttaatatttaaagtaataaccctcaattaatcatgtacctgcagttatctttcgtccaccgcaagttctgtggttctgtggaatatattccaagtttgcaactgaaaaacttcatgagcactgactgcatttgcactgcagttcagtggatgcatcgacggagaatgaatacgcattccatgacagaactaaaacgcagggaaatacagagttacaaatcatatggcacgaaccgatacacatttcgtggcataaccatcattttgatgcaggagccagcagcgaagttctgccgggcaaaagtagtacaccattttggaacccacggttgcatacaaagttactccagaaaatacattgcaatgcagttaatattgctcaaatcagctacaacagaaagaaaacacatgatgcatgcgtgttctcttctgctcacagcgcactagcgcagtgccactctccttcctactgtacaagttacaagaagcaagcggcctcatcagcttcagccaaatgatatc

SEQ ID NO: 59749 - DNA, 4077 bp, Oryza sativa
gatccgagccgttggctcaacccctctcgtgctcccctttgtaccggtgaactccctctcgatcgaatcgctgcgtcgtgctccagtgaaaccccgccgtcggccaccgttggttggagctcctgttcttcttcctcctctctcccggcccgcgtggctgccacgtaggcgccacgtcggcgccacctcgacgcgaccgggtcaaagctgacctcggtcagccgcctccctccgtcccccaccctcgcgcgcggtccacggagagccaacatgctgcgcgtgggcccgccgcacaccgcgtccacccgcgggccgcgcgtggaccgcttcccccccgaaccctagcgccaccctcgcatgcgcccatcccaccgtgggccgtatcaccgacaagtgggccccaccgggaccccgcgcggtggaatcggtccaccgggccgtctctctctcccccgcgccccctctgttgggccgcctccccgtggccgcgcccggcccaatggctcggccgagcctccttcaaccctttgggccgcaccaatgccacccgagaaaagtccaaatcacatccctcatccctttaattttccaagggatttaataaatccttttcctttgtttcataaataaaattctttattccaaaattctatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttctagtaattccgtaaaattgagatctatttaatggcactattattcagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccccttcaaccaattgctcctataattggaaaatcattattattttgtttgcaacttgcattattagaatcacacacttaacttgcttggcctcggtttgcgtgccaaaccgacggacctacccagtagtcgcactaattcctataggttgtactaccctgattccttgtcgctccactcttgtggtacctcggtatccgtgctctctgagcgcgtataccaaatatcccacatacaccgttgattgtcgaaaaattgggaaatgggtttgagaagccttgaaaacccgacatgtggtgtcggtgtgtttaaaaataaaatgaattgtgaaaactcacgatgcggaggtggtgcctgcgtggcgctgtcccgtattcgcatataaggaccgattcctgtgggaaactcatcaatcataacaaagtgcaaccacaaggtggaatgggacaccctagctaagtaactagtcggttcagggaaacctcgcatgccaatagttggggaacgccggggcggggtcggttggagccaacccgggttcctggtaaggcaagaacgcgaagcttgccagattaccgatcgaggtggttggagtttgatttgtgaaaactgatctggcctatatttatgtgaaggatttgatccttctatgtggcatgaggtaaccctgggtcggcttgggaaaggctttgttgcgaacctccgataccgacaggtgttcggaataagttcgtatcttgtgggtaaagtgtacccctctgcagaggttaactaactgttcgaacagccatgcccacggtcatgggcggttgtgaggtggttcccgttgcgtagatttgtttgcttgtgctttgtgaaaagttgttgtgtgggaatcgtaaccagaatcagcctatgtggcagatggatgacctgagtggtcagaaacgaatctgtgtgattcgggatgtctgcgggcatcatagactaggcttcccgagtggaagtggattgttgtgctgctgggcagctggactctgggagtccgagaaaatgaaaaaggctctgggagccgatttaatcaagtgaaatggctctgggagccgagaagtaatgatctgacccgggaggtcggtacattatcaattgagttgttgaaatttgagacgcaagtctcttttcgacccgaacttaaaaagaaataaatcacttagtgatttcaaaatgatttcaaacaaaagatttaccaaaacaaccttgcctctcttccaaacttgcatcaaacacctaaattcccgtgacttgctgagtacgaaagtactcacccttgctctatatatgtatatatagttcctctgtcgtgaagtgaagatgaagtgaagtgaagattagggtttcgtcctggttcccagccgtcgcctgtggtgttgggtgttagaccgttggttccgctgctgctgctattgttggtgtttgcctcgtccgtgtcgtcggttgcattctcgggctgtctgagctgcaacctaagttaaggtaaataagtcctctatttattttaaggattgcaatgattcatatttgtcaccgtgggtaccagcgctatgtcctgggactggtattgagatcgcggtttcgtaggaagcggttcgcgccgtttttcctacgacacgctcctgtcaggtgccgttgtacggcagtgccggatcggggtgtgacatatttagatcgtctggtaaaattttacacgctatcacatcgaacgtttggacacatgcatgaagtatttaatacagacgaaaaaaataactaattacacagattgcgtgtaaattacgagacaaatcttttatgcgtaattgcgccatgatttgacaatgtgttgctacagtaaacatttactaatgttgggttaattaggcttaataaattcgtctcgcagtttacagacggattatataatttgttttgttattagactacgtttaatacttcaaatgtgtttccgtatatccgatgtgacacgccaaaactttacacccatgtatctaaacacaacctttatcccgtcgatagcgaggcgtctgtgatgacttcgtcaatctctaggatttgccgacccagtcttcgaagatgctcataggggtagggtttgcgtgcgtgtgttcacaggggtgagtgtgcgtgcgttgtgggtgtcttgtgttgtactgcgtaattcttaaaaaaaaatgaaacttttaaaagttttatgtcagcgggtttatttccaaattcataaagaactagtactcaaaatgttttgagatgaattatggggcaatggggcttctgaagaaaatctttattattaggggggttacactaggctgtgtttagttcctttaaaagttaaaagtttgatttgaaattggtacaatgtgactgaaaagttatgtgtatatgacaggttgatgtgatggaaaaagttggaagtttggatccaaagtttgatctaaacacagcctagcaaaagtgcagaactccaccgttttttcggtgccaaataaaaaaaaaaacccaccgtcttcccgtcttccgcttcctgggcggcgcaccgcggttctttggcgcgtggggaacaacgatgagctcagtctcggacccccaggcgaacggcgaccaccggccgccggcggcggagatggaggacactggggtgaaagtcgaggaggcggatgcgggtgagacgatggaaggcgtcgcgtccatcgcgctactgccgtccggcgccatctccggccacttcatccgcctcccggactccgtctgctacggtctccacggcacacgtatccatctctcttcgttgcctattcctgcacttgctggtgcctgatcatggggggctggctcttactgcatatttatagcctgaatcgtctgcggtctcacccaaaaacccttttgctctcaccaaaaccctctcttgctcatcgcctaatgagaagcaagtgatatacttttttttttctgttggcgaaatctgtgttggaatcattgcaaatgtccacattctgtcccagaaggaaaattgattgaaaagattaagggggtg

SEQ ID NO: 59750 - DNA, 579 bp, Oryza sativa
aaatgcattattaaatgatttttaatcccgaacgaaaatcagggcgttacacgtgctgtatcctccttaaactcggactcttctagataaattttctttaattgatccgactccaccaagaacacaactgctggcgatttgacgattcccatcggctgattccaagactctgaagccgatactaactctagaccgatgattactttgggcttaccaaattctggcgttaacaatatctaaaaacaacattaatatgcttgcgtgtagttatatcttattaataacttcaataaaaaataatatgaatgtgcttcgatactgtataatcatatcctaaacaatgtcaacttagatgaagaatggaagtatattgttagtgaaaatcagctcaccgccatggtcgaacccttaattcacctttaattctatatatggtttttatttataagtgccaatagatcaccgagggtttcgataaagatgtcactctcgttaagttcaggggcaggggtagaatgaaattgagaaggataccacttgcttaatttactctactttagatcaaatttaagttgatgt

SEQ ID NO: 59751 - DNA, 37860 bp, Oryza sativa
  unsure (1)..(37860): unsure at all n locations
atccacaagatctttagaagctcacgggcgacacctaaccgtctaggagaagatctccaagagtaataagcccaagtgacaacccacaaggtatccaaagtgctcaatcagacctaatcttcaagccatctccaaaacactcctactctctcatctaatctctcaatctcacaagataggctctagatttgagtggaggaagtaaaggaagcttgggagtggctagaaaaccctagaacaagaatgaacagaagtggaatggccaaagggtgacctggggatgaaatccatatatataacgactaggtgacgtcatctagccgttactcacaagtttgaactggaaacctgccaggaggttccgggcaaaagtgccaggaacttctgggcagtacttaggaaattttttgcaaataaacggcgcccggaagtttcggccagaacctccgggtagccctctctgtcccgaggagaaaatcatttttcaaaaatgattccaaaaatattttgactcatggatatgactaagagcactttgtataccctagaaccacacttgaaacccctcttaatagtacggttttttctaaactcaatttcaaaagtgaaaaacctagtctaatcaccttcgttgttttttgcacttaggaacattcaaattggggggtctccttgcattcttagccatcacaactagctttgggactaaactcctgtgaataaacttgataaacacgttagtccgctttaaccaccttgtcattaatcaccaaaacccactagggggtttaagtgcatcttcaaagtccattccactaaaaaaattaaccagttgagttacactcacttcgttgcttcggtgtatcatgataatctcaattcaacttttagacattttcatgtttgccttggtggtttccagaaaagtgaaaaagttcttagctttttattatgatcttttaccaaacaatctgtagaactttttcaagatcatttttcggtatctgatttacctttggcaaaatttgctaaaggacactaaaagtttatggtctttgctatgagacattcaaagcacgcgtatctttttatggacaccgtaaaaacatggtaattagctgttggacacccaacatattatattttattatatccggtcaagatggagagcgaaaagagtgttggaagtaccattttccccctcgggtcgatcggcttctgaaggtgattgtgactatctcgaatcagaccaaattcgatcccctctcctcgaaccctaagttttggggcaatgatgatggtgcggcggcgagttgcgtcgacaacggtgagctctggtgagagcggtggccgattgaagcaacacggtgttggcatcgatggagctatgagctcagatcacatacgacgatggctggaattaatgtggccccccaacgaaagtcacccgggaaggggtcacccaaggtgaagaaggtggcggtgaagaaaatggcaagcactatatctcttttgaatcaaccgccactccccactgcttgaatctgccatcaccgcaacttgctgatgcaccgtcctcaccatcattgaccgcttgtcactgcaccattctcgggagattgagagtggaatgggtctagttcgaaccggtcccaatcagattaaacaaagatagccccaagggcaaacttgccttttatttaagtttctctcaccttcttgactgaatataataaaataattcatcgggtgtccagcaataccaagtttttgtggtgtccacgaaaagatacgtgctctttctgtgtctcatgtctcagtaaataccacaaacttttcagtgtaattgtccttacctttttcacccaatgctcaagcttgcaattgacatttggaatgcaacgtgcaagggcttttactcaagagtggaaaaagtatactttgactcccttaactatgacccgagtatgattcataaccttcaaccataaaaccggatatatcaactcctccaactatcgaaaccagtgcaaaatatatccctgagtggttttggaagcggttttggctgatgtggcacctacgtggcattgttgacccggtcttcatcccacgtggcgttgatgtgtcgcttatgtgtcattttataataaaaacaaaaaaacaaaaatatgtgggactgacctgtcattcacataaaaaatagtgggacccaccgacatgtgggccccacatgtcatccccttcctcctccttcctctcccctcttctctctccttcctcttcctccttcctcctcttgcgccatggcaatgcttgtcgctgcctccagtgtcgggatggcgctccgatatcggtcacacgtcgtctctgccgccgacggagtcaaaccacttgcgcacggcgaagtcgtcccgcgatggcttgaggacgagcgagaaagagacgacgccggctgtgttggccttgatggccatggccatggctgaggcggtggcgagtgagaagctcggcggcggccggctctagaaggaggcggcggacaacggcggctggggcggacacgacggtctcgggggcaacggtggtcccctccccttcttttcatgctgatcttggtgtgtccttcttccttttattaaaaatgtgtttctctctcttttattggctttctgggcgcatatgttgctttttttctttgagattagtttcattggtttaccctgccaagtatacaggttcttccatctgttcagttcttgttcttccctccccttctgattcggctcctgggaattttctcatccctgtgaattttttttaccatttgcttgcacatcatcacaaggctctaaattaatatgtttttgtttaatcgtttggtcttaaggtggttggacggttagcattgtaacgccccgattttcgttcgggattaaaaatcatttaataatgcatttcctagaaattaaataaaagttaaatcaatttaatcaagtgaaataaatgggagaattaaaattttcctttaaaaatcattggccgggaatattttgtaatattctttgtgccctaatgtactctccggaattttccgtgaattttcggagctcgagaaatagttttaaagtcacaaagttcattaaactaatttaaataaaaagaaaacaaattaaatttccccttcctccctttcgggctcggcccaaaaccctccctccttcccctcccgcggcccggcttgcctccccttatagcgcaagtctgtttttcctccctcccggcctcccctctcactcaggccgacaggtgggacccgtggaccccacctgtcatccccaacctccagcccgggccggcaactgccatggtcgcccgagccgccccctgacgccgccgtttccgcccaccttctacaccccgcgcgcgcgcgctcgtccgtgggacctcgccacccacgtccgcgccgttttcccccacctttcccctccaaaaccgccacccacaccccacgatgccgcccacgccaccggcggttgccgccccgactccgcctctcccgggctcgatcccgccttccctcccctataaaaacaatccccggcctcccctcatccatttccccaattttccccaagccgccgcgccctctaccgagctctccacgccgatccccttcgccgccgctcgccagcgatctccagccgcccgccaccgccgctcccgtcgctgccgcgctgcgccgccgccacctatagcatcacggcaccccgccgcaccccggcatccactccatctccctcctccaccgccggaaccaccttcccatcgcgaggccgagcccctaccgccacacaccgtcttcagccggccgctgccgccgcgttagtcgtcgccgcacctcaccgcttgcgccgtcggcaacgtcgtgccaagctctaccccggcccctactccatctcccctctccgcctccggaaaatcgccgcctcgcgcaccacctctctcgcgctgccgccatctcgcctccctccgtcggccgcctctctccggcgtcgccccatggtgagcaccccggtttcctcttcctctccctcctggcgccgtgcgctgccgcttccgtgcgtgcgtcgccgccgtgccgtgtgctcgaccggccggctgccgctgccctgctcgcccgggccgatcggtcccctttaccgcgcctcccttgcatgcgccgccgctccctccgtcgccggcgcccctcggtgaggaccccctccatctcctctccctttcccctcttttcgtcgcctcccgcgcgtgccgtcgcgccggtggtcgtcgccggcgaccatcgggccgtgcgccgtcgctcccggccggccgaccggtgagccggctcccgctcgcccgtggccgcccgatcccccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcgtgcgtggactcggtccacggtgcgcccgccacccgtgagtcaccgacaggtggggcccgcttgccggcgccatctctccccgtcggatgacgtcataattgatttaaattgcgcaataaatcgagtttaattctagaaattcatttaaatggctcaaaacttctaaaattcatatctaattcattcgaactccgaattgagccattcaacttgcaaaattcatctaaaattgagctctacatgtttgtttactttttatgtactgtttccttggtttttattagagtttttccttgttttgcgtgccagcgtgtagtttccgtcgtttcggaagtccgcggtcgcgaggaaaagagttcggaagatcaatgtgaagaagcaaggcaagtcacacattccccttgagcatgttgatcctaatttacaaatgttttaccgtttgcaaacaaatatgcatgttttgctaattacatgggatcagggttttacctatctgctcgcttgtgccatgtttacttgatatctatcctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacacctggccatgcttcatggtcgtaattatccaactaaaatgcgactgaatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccacggttatgggcggtcgaccagattcaccgtgattagtcccacctcaataaatcgacctaatacactgtagtttaggtgggttggttgggcctgttcaacgtggtgtagcgttgatcagtggagatttaatgttactttaattactcaacggttttactgttttgctcaataaaatgttttacaaccgcctttatgcaaatagccacaaaccgtccttgtgttccccttgcacgtctgcatcgttggtgtggcttgctgagtacggtggttgtactcagccttgctattatttcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgttcggaactgtttattacttgtcgttttgtgtaccctggctggtcctggacagggatttaatacacaaaatagtctggaaatttgggctaaatttctgggcgtgacaagcatcttcctcaagctgaaatctgggaggggtcgttaccggcggggtcccggatgcgacgacagtgggaagtcgaaccctgtgcgcggcggtgctccaggacaggcggcggcgttaagaccgaagtggttttcggcggcgtcgcggatagaaggtgaggcgggcagctccggagctcggcggtcaggcataaaccggtgcgacgcagcaggtgggcggcggcgcttgggccgagagaaaggagagcgaggggagcgaggaggacgcagaaagaggaagaggaaggggaaaaggagagaggagaggggagaggaaggagaaaggatgaagatgatgacatgtggggccccactatttttatgtgtgaattacatgttggtcccacgtatttttgtttttgtttttattctaaaatgccacataagtgacacgtcaacgacacgtaggacggagaccgggtcaacactaccacgtaagcgctacgtaagccaaaaccgcttccaaaaccacctgggatatattttgtaccggttttgatagttggaggtgtcgatatacccggttttgtggttggaggtcatgaatcatactcgtgccatagttaagggagtcaaagtatactttcgcggtcacgaaaagtttgggccgcatggcccacaatagaggatgacacggtttatctgtgggctgaattgggcctttttggttgactcgaatctgcctttccccgtcctcccttcctgtagcagagtagggagagcgcagacacacaccccccatactgccacaagggccgccgccgccgccgggagcgatggccgccgccacctccatcaacgccgtcccctgctccgctggtcggccgaagcggaggagccagcgccgcggcgcctctacggtcgccgtgcgcgcgtccggcgacgctagcagtaagccccactcggaccactctccccttcaattccggagctcgaaggcgtttcacttcacccatggcctcaccgccgcgttcgctttgcttttgcttcgcttcgcttcgccgtcggttcgacgcgacagccgtgacgctgctggactacggcgcgggcaacgtgcgcagcgtgcgcaatgccatccgccacctcggcttcggcatccgcgacgtgcgcagcccggaggacatcctcgccgccgaccgcctcgtcttcccgggggtcggcgccttcggctcagccatggacgtcctcacccgctccgggatggccgacgcgctccgcgagtacatccgcagggaccgccccttcctcggcatctgcctcggcctccagcttctcttcgactctagcgaggagaatggcccgagtaaagctccttctcgctctcgcctcatcgtttgcttgattgctatttgttccattgctagcctgcgaatgaacgatggcctcatcgtttgctggattactaatctgttccattgctaacctgtgattgaatgaaccggaattgatggtatttattgtccaatgcagtaagcggccttggtgtgatacctggagttgtcaggcgatttgactcttcgaagggtctcattgtgcctcacattggctggaatgctttggagatcaccaaagacacgcagctgctcaagggagctgaaggccaccatgtgtactttgttcactcctatcatgctctgcctgtaaggaacagctcttttttagatgctctttcgttagtggacttatggaatgtgagttatttctttcttttcacatgcttagtcagatgaaaacaaagagtggatttcttctgtgtgcaactatggcgagagtttcatatcatccatctcaatgggcaacattcaggcagttcagtttcacccagaaaagagcggaggtaaaatgcagtttgatattgaatgtgttatgatatgccatagccaagtatgtacaatgtattttaagacaggattgaaacatgtagattcttgagttctgataacttgactggtcttgatcaccaaggtctgttaatacttaataatgcagaatatatagatacttcagatttttctaagcatacccattattgttttactgcagctactgggctttcaattttgaaaaattttctcagtccaaacacttcaggatcaaaggtagctgctatatgtatgcttattgttgctagttccttttcattaacttcttcgatgtaaaagttcatacttgcatttataacacaggtcccatctcgtaggaaagcatcgaaccttgcaaagagagtaagctttgtatcgccaaatgttttagcgtcaatgcaacttccattctcgcccttcttattgccttaaaatttccaggtcattgcatgtcttgatgttcggtcaaatgatagtggggatcttgtggtaacaaaaggtgaccagtatgatgtaagagaccatagtagtagcaaagaggtaccaagctctattcatttcccctaagaattgttcaactttttacacttaagggttagatctaagttcgtgatcttgagtagtttgtggtactttagggataattcatctcccaagaatctgatgagccaatgtaatagttttatattataaatgcttggtatgactgactagttgtgtagaaacgttatttgcctggtgcttgaatatctttgcgttctatatctgtaggtaagaaacctcgggaagccagtggatttagcaagccagtactacatagatggtgctgatgaggtatttctctacataatgctttattgttttctgtatgtgaacttatgatctgatgttgtgaaaaaaattctcctttaggttagcttcttgaatataactggtttccgtgactttccgttgggagatttgccaatgctagaggtttgttcaagacgtaaaacctccaaatgttttcatcatttcccttatccagcgaggtgacatgttgatatttatttctaggtattacgttgtgcatctgagaaagtatttgtgccacttacagttggtggaggtataagagacttcacagatgcaaatgggaggtcagttccatttatgttcatgagtaccatggatcgaaatgtttttctgccaagcaatcccttctcttactgacttgatgagatagttttttctgcaaatgattcccaaagtaccttttccttctctaggcagacttttttttttttgtattcgatctttcttaggaattaagatagcctgttattttatttctttttcgtttttttccctgcaactctgcatatttatgttctgatgttcaatcttacaaccttaagtgcctctcccccatctttttgaggtgttatttgttgtttgtcaatagtcaatactgagaaggaaaaggacagacagagtaattatgtattcttcccttgtcagatactactcaagtttggaagtagcgtcagagtacttcaggtctggtgctgacaagatttcaattggtagtgatgccgtttttgctgctgaagcctatttgcagactggtgtatgtattttatttttccatacaatcttcatctatttcccaattatacagttctttttgtgtatcaggtaaagacaggaaaaagcagcttggagcaaatctctagagtatatggcaaccaggttttccacgagaaatccagttacaatttgtttattaccgtatacaaccaaaacattatttttagtattcatgttagcagctaatcttcataatatatggaaaacattcctcctttttttcttcctaaaaaatatcacaaaaaagtttttgttcttccatccatgtgccactaatttcagaggtgtatccattgttgggaactctgctatttatattgaattggtgactgataagttttttgaataaaaacatataatgtatcttctgcatttgctcaagatacttggtgtgattacttatgttcaaccttgttatatagcattcaccttagtcattggtataccatatatctattcatgtcctactattatagttattaacctgtcaatcactaattgcagtgatgatatttctcttattaggcagttgttgtaagtattgaccctcgaagagtatatgtcaagaatccggaagaggtgcaattcaaaactgtaaaggtgtccaataaaggtgcaattcaaccactcatcctgaatctccatttgcatttcaagcattaagatctcatgtacttttttcaggtccattaggagaagaatatgcatggtaccagtgcacagtaagccatttgttttccatttactgctaatttcgcgttactctcttatccatgcacataaggggtatttttgtatattcatatgaaaagtttttcccagtacgcaggaatattattacccaaaacgcccataccaaatttcagactgattaaaacatgtgctttcttcagatatttggtgtactaccttttaggcaacattaaatgactttatgctggcataatctactgtggcatgctgtcctttaataagattgctcttttgttccaacaagtgttgtttatgtcttttccaggtaagtggtgggcgtgacagccgtcctataggagcatatgaactagccaaagcagttgaagaattgggtgctggagaaatacttcttaattgcattgattgtgatggtatgttcatggttttgaacagttcaatattatgctttgcctgatttttatttacgcaatatttgtagattttctgctaagtaatagcaaagtggaacccactaacaataaccagaacattctagttatgtttttctttcaagaatccaagttttcctttgaggcgtacaatcacagtaaactttgtcgtcattaatagaccagtggtaatcacacatgcattattgactattggtagcagtttgaccatgtatgtaacaccttaaaagtttcggttagggtggtttttgccagttgactttaattttcactgtctccattactcatgttaagaggtactccctccatcccataatataaggcatggtcaaacttggcacagtcttcaaaactaatctttgacttataatttatcatatgctataacatttattgcagcaacattataaccatcttaaagtaaatttaaatgtcaatccaatgatattaattttaacaaataaaatttaatttatattataataattgttggtcaaatgtttttaaagttgaatcttggaatatgtgcacgtcttatattatgggatagagggagtataaaaaacaggtgaataaagacaagacgaatgccaatatgccatgatgttgttttatttttcaggccagggctgcggatttgacatagatctggtaaaaatggtgtcagatgctgtgactatccctgtcattgcaagcagtggtgctggtactgtcgaacatttttctgaggtctttgagaaaacaaatgcttctgctgcccttgctgctggcattttccatcggaaagaggtattgtcccgccttgtactttttattcagcatgctatgcctggagctctacatgataatcctttattccttttcttgcaagttctggaaaactttgacctagcttacgttatttgcatttgctcagcagtgttagtctgttctatatgatcaacagagctacgtgctcagttaataatacttgcccacgttatgttagaatctttgttcacgttccatagtacctgtatagtaagattatttagggttgttggacgtaactgagcgcttctgctttatcacaggttccgatttcagcagtgaaagagcatctggtagatgctggcgtggaggtcagagtgtaggatggaaatcctttgatctattgggaaaataaatcagggctttgtaacagttgtgtgttctattttgggaataagatggtaattcataggccatggattggaaatgcaatttcgtaataaattgtttgaaatcttctgtttgattttttttctgcctgtatattactttttgtcttttcttatatcagacaaagctagaaaaactaattcagtcccaattagttgctactcatgcaaacaaatttggattctgtttggtttactgcaaatattgacaagatagtctggtaacatcaatattgtgtgacgaagcaaagtggacgaaatgatccatttcaataatccggtgaatgatctgaaaaggaaaacgctcgagaaccccaacctttaaccagtagtccacaatgtggaatttgcacgagcctttgaaaatactggcagtgccaagggccacaataaagaaacataattaaatcagaacaaccagtctatcaggacctgaccaaggataataatacagctagctgctttgtatagatttttatagcctatctctcaattcacttgtacagtggttaactcttcactataaatatatggtctacctatctgttttacagattttcttggttcatgtgtctaagccagctgtaaacttacaacccgctttttatctctcctctcctctctcatccacctcagcattcagcctttttatagccctctattatacttgctcttaggctgtgttcgagaggcctcacctcccgcacacgcaaaacggagagacgtattttcttatgattaattaaatatttacttttttgaaaaatggatttatatgattttttaaagcaacttttgtatagaattttttgcaaaaaaaaaccgtttagcagtttgaaaagcgtgcgcgcggaaaacgaaggaggtgagttgggaaatttggtgaaagaacttgagtctcaaaagtttcctgctaacaatagtaaaatttgaagtttcttgctgactgtagtaaagtttgagctaaaccagaacttttagaggcaattcgtttcgaagagagtatgaaacgggcgatcggaattcttgcttacgatgttttatgcaatatcccactcccccgagccgccgctgccgtcatcgtcatcatcgtcgctgtcgtccccgtgcaccagcgcgtcgaccagccgcgcccgggccgtgcggatcaccgcgctgtggcgggacgtacgtgtgcgggtcctcctcgcggaacaccaccaccgccgtcccgtcgccggcggcatcggcgtcgtcgtcagctcagccgcggccagtcccacccaacggcgcgcgcgctgtccactccggtacgctgcgcggcgccttgacgggcaggcagccccagccgaccatctcgtcgctgaggttcggggaaggataaccgtcgcccggcctggcgcccctcgtacccacccgctcatcaccggctgcgtgaggacgatgtacagggtgcagcacccggtgcgggtggccacgccagccgagcctctgcttccgtaccatctccttgctcagcctcccctactgtccaatatgagtacttcatgcagtaaaaaaagttaatgtacagtacataatgtaaaattgcatgtatcaatattagtagaccaaccgcatagcacacatttctctctttttttaagactgaagactttattaaaaaataaagataaagagtccccggatatgaaatcccattctttcaaaagggaaaggacagtctgggcgaccggggtttgactccagtggaccatcaaccaaaacaagacatatatgtgtgtgtaaattcattaacatctatataaatgtggacaatgctagaaagtcttataatataaaacggagggagtaatattttattttcataaacctcaatgtctattcaacatcgatacatatgagcatggtttcacaattcacactaaaaaaaaaccacataactcgcactacaccatgacatggaattaccaacagacatctgttggcaaaaataaacaattagtgataacatatctgtcggtaaaggtttttggcaaactatatgtcagcaatagtgcataatgagacatggtatatgtcagtaattctaaatatatttttggtcaaaatatctgtcagtaattgtaagagtacgagctaattatatgtcagcaaaacttagagggtgtatattagactattaataatactatattgcaagcccaaaaagcccatctagcctatcatatataaaccaaaccctaatttccccacaaccttatccttttcttccctacccagccgtcacgcactcacgcttcctccggcggcggcaaggcgacggcatcggcggccaaggcgcgggcggcggcggcgagcaaggtgcgggcgacggcggcggcggcgagcaaggtgcaggcgacgtcatcggcaaccaaggcgcgggcggcggcggcggcggaagcgggaggcggaggagtgggagaggcggaagagggggaggaggaggaggaggcggcagagacgagaggaccccgtggatgtgctcggggaggaggtgatggggcgggtgatggagctcctggacgcacgcagcacctggcgctgggtcgccgccgacgaccgcctctgggcacccaaggtccccccccccctctctctctctcattacagcctgcacggctcctgttcgacgaattgcctgcgaggggcactcgattccccctcacgagcggttaatcgagcagtggctactctcgtgtcttctgttaggatcgagcataccgtattcgggagtggtgttgattaggagcttttatagaattctcatttattgattgtccaatcatggttgccaaaagagaaagagcgcacattcggttagtgtgttctaaactgtctaattttcattggtattttgcaggcttatttgatgagagctggggctgtcattcatagccatgggatggaaacttgcattgcaaccatgcttaatactggtgcaaaagagtttagggtgaacctacttgtctcttttccccatgaatcttagctaaatgctccaggttctgctttatatttctcatgaagttagctgtaatgtttacagaaatgtggtagtactaagaaaatgcactatttctcatgtagtgtaccacattatggacattttctgtctgatctaatgtatcaaattgaaaaacggataattgttcatatttttagatttccgcttacttttccattacaagaacttcaatggtattaacaattaagtgctaatcttctatatgatgcactattcaataaattggagattatgtttgctccatttccttttcatttcatggcagacattattatatatgtactagaaagagtggtgaacattttttttaagatttgatctattattgatttcacacagacatgcatcagctatcaggaccagttggaataattgaaatgctaattgagaactttgcatgcaccacatagtacagcaactactcaagccaagttctatttactagtgaagccatttccaacttatatcaatccatttattagaaatatgcatgtacattgtgtgtttactgagtttttacttgtagaatgtaccatcctagtataattattttaaataaaactcccttagttgatctctgcaaattaggtggctagctgtccttgcagtgagttgtcgtagtacaaatttgaaacagtcttcgggcttcagattttccatctacattaattatgaaaatgtcacctacatacatctcaattctaatataagttaacatttgcaagtgggagccaattaaactgtacttcagcacttatcttctttttatttatttactagctatgatttgcgacctgtgggtgagcaatcaacttcttgctgaagtgtcagagaagggtacctgaaggaacagaagatcaacactaacttaaaggctcatacatcatgtaagctaaaatcagtttgttcccatagtttgtgagataaattgcaatccttgctgcttgtaaattgtaattgaatctgttacgattgcaattatactgcttcaacataaatttctcataaaatggaactggtaatttaatattggtggattgtgagaatatcgaagctatgctacagattgaattaaatggaactacatcagttatgttattgacacttatcctgcacatttgacactgatcttcaattctgtattgaaatagtaggtgttgcatagattacttatcattgaatggagtattattataatctatatatctgacccttaatacttttgtctttctgataatctgattcaagtttttagatgctcaacttatcatggcggtcacaagatattttggaggggctttcttttcaaaggaaattgccttgctggtggagattgccatcggtttgtctcatttgtagaattgtataggagaatttctctttttgtacaactaacctatgtacatggcatttgtaattaaatgaaattggtatattcagtactagtggaatgtggatgcatgagaactgttggtggtatattcaattctagatcagtaggatttgattccatgaactatattttttttaacccaatgcagggcacactaacagaatatctgtcagaaaaactgatatatgcaaactgcgtatctgtcagtaatccgttaactgtcggtaaaggaccatctgtcggtaacttccgtctgtcggtaattcatttgtaggactgtcgagttatctgtcagcaaacatttatctgttggaaaagacctttgccggcagcacttggcctgacagaccctatctgtcgggaaaagttatgctgacaaataatttgacagcatataggtcctttcctgacagatatgtagtaagcaaacttggggcatggtgtagtgtcggggaacatattttgctaaatttttctatattcaagagtaatagcctaatgggtgttgccatttgttcaatctctcaaatagtatttgggtccacatgtatgtgagataattcggtggcatgtgtgaataagaagatgaatgcaaaatacgatgcatgccacaagttattagtggtaaaaacattttttcccttgtctttcatttacatgtttaagtgttacatgcacaaggttttggggttgatacttgacacctatagcccgtttctttcttaattagtttgtttattctacttttggaatgaaagatgatatgctttgaataaattgggggaagctctaatcttcttgtgctagtaggaaaacataactatacttcttgtaaaaatattcttccatttaaataagagaaatttatagttggagttatgaattatagggacagaaataaatttaaaataatagtggtggtagtggtgaatctcctgccatgccaccacctctgctactattctttctacagaattctccctaagcatgcattttcatattatttataggtgttttacgccattcccttcttatttcgtttattagaaccacaatgtaacaagaaaaaaaatctaagatgttccaagtattgtgtatatgtggaattactctatggaaaaaagagcgaacaatagatttgatgcaaaactagatgcagcggctaaaagatatacatttggttattgatgaaaatataggcacttatattcttgagatcttgggcataatactaaaattatattgtttatacatgggaatatttcatcaacggctataaaaaaattgtgtcgcataattagatatttttgttggcattggtcacactacttcataaaaaaatataaatttttcattacttcaatgtttcttcaacatcgatacatatgaggacagtttcacaccaaagaaaagaaatcacataactcggaaatcaaactctaccaaaaattgtctatatacatacccttgaggggtgagacagcacgacaacgccctcaggagggggaatgaaccatcgttgtcggtccggccaaggccggactgagttttcacccgccgctcaccacctgcaaatccacggctgacgcaccaatgctctaccaccacacaagttttgccgacatgtgggacccctgcaccggcgtcccccgccggccaaccttcgtgcgccgaagaccgcaccaaaaccaccggcagctcctcctcacacctaggtcgcctcctccaccattggccacgcctctcgcgccaagccggcctccatctctgccgcccgcgcctctcgcgccgagccggcctccgctgccatcggctacgcctctctgcgccaaagccggtctccgatccctccaccaaacgatgccgcgccggccaaatgcagccgtctcccacaccctcggctagccgtccgaggccgccatgcctccggtgaccacagtcgcggccaccaccaccgcagccgctgctgttgaacgcccagccacctcgccgtcgtcatcctcacctcgcacccgactccttccccgcctccacttgcttccgccagcgacccgcttccaccgacgtcgccaccgtctccacagtcacggccaccgcaagtcggacgccgtcgtcgctgtcaccgatgccagccaccgcctctgcgaaccgccgccactgccaacggccacttcgctgtcgccctccgccgcgccgccgccaagttctccaccggcatcgtcagccgacgccgccgccgtcaactgccgcgactaccactgccgccgncgtcgcaagccgtcgcaagtcgaccaccaccgcgggccaccctcaagatccggccgagaggcacagatctaggggacaccgccaccgtcgccgccgagcaccgagccgtcatcgcgcagggaccaccgctgtcgctttcacgcccttggccgacgccatccccgcggccttcaaccaccactgccttcgcagccgtcaccccgccagatccggccggagcagcccggaactggcggtcaccaccgccccgtcgtggacgctcccttgtccgcctgaagcgaggtcggtgagacgccccgccaccgccgtccttgcggctggccggctttgcgttcgggcggtggcgagacggagggggaggaagggaggggcggccgggttcgtcgcctcccatgccgccccaggggagagcgacgcaagagtcgacagtataattccatgacttgcttacaaactacttgcagtcacatgatcctatgtagttttctgtagcagtgactatttgttcaccatcatcccgaatatatatatgatctctaattaatatattatattgtgtcatagtaattgatttgaattgcaaagcagtaaaagaaaataagtcgaagtaattcgttttcagagagaacaatgacaaatccttaattcttgctacgctgtcaccaatcaaaatactcctacgttcttcctcttcatcttcaaaccacgaacgcacctcttcctctccgcgcctccaatgacatgtgcacggccaaccggccgcgcacgacgttggccggcggcccccgcgccgggaacctccagccctgcagcttcacccattcaccgaactcccgggtccccttgaccagggccggcaggccgtccttctccctcctcttcctcccgcggtcctcgtcctcgtcctcgtcgccgtcgcgcagcagcgcgtcgaccagcgccacccgcgccctgccgatcaccgcggtccggctggacgtctgcgggtcctccctgtggaacaccctgaccacgccgtcgtcctcgtcgtagtagacgtcgcggcgctccacctcgaggtccagggacaggcgcccccagtgctcccgctgcaacgggagctcgaaggcgaagctccagccttctacgcggagagggtggtcgcggccctcgggaagcctgcaccatcccaggtgctcgccgccgacgtacgcgtgcagcacgcagcgcgacggccagacgtcgctagaaacacggatttcagagccttcgtagatcgggcgctcgtacttcggacgctcgatgcggacgtgcaggttgaagctcctcgcgccgtcgtcctcgacctgcgccattgttgttgcgggtatcgatcttgcgcatgcagtgcaggcggatatatatatagcagattcgtatatataatatatgaagtcggatgtagatctcctttaataaataagaagaggtataaccatgtacggtgctcttagtagtatatggtttccaagatgagatgagagcttatcaccaagtacggtagtttatctccaaactttaaatggtttggtagagatgtatatagatatgcgtatagcagtagaagaggcgagcgccccagcgttcacgtgattggtactccctgtttagttaagagaatatatattaggtatgtgcaggtgcaaaatatgattataagaatataaattaagtatgtgcgtccagttttcgatcgtatatattcttttggccttcgaaagtgaaagagagaatatattaagtccctatttattagttaagagtgggactatctatatttatattgtgtcaaaattcttataaaaattaattaaatttccggcatgtatttacacggtaaactatatatcttgtacaataaatatcatgcatttatttaacacacaagaaaaataagaaataatgtcaataagtaggagatacatatgagagacgcaatatacttaaatatagaaattggattttctaaatatcatttcatgcacttgaagcctacaattatattgtagggctatgcactgcaactttgttcggacgcgcctacggatcggtcacccgatccggggccggggaaatcgggcgctgacatcagcattacgtcagcgcccgatttacgtgcaaaattactttaaactaatttttctcttaaattacttattcaaatcatgatccgattgcaccattaaattcgttgcaattaaatctttaaaacaagaccacacatggatatattccgacggaagttttttttagcttattactgaattatttttaaatattgcacgatgtttcaccaggtatatcggaattgtttcactaagtagataaaaaatgtttcactcatttaaatcgggtgttgtttcaccttatataaaaacaattttcaacaaatagcgaaagaatgtttcagttcactgcaacatttgatccatacatagaaaaacattataagtacactaggtgaaacatttttcagtggaacaaaaaaataaaacgaattcccttaatagggggtttccaaaatatgcggatttttggttgcaatggaatatttcagttcactgcaatattagatctatacatagtgaaacattgtgagtacactaggtgaaacatttttggtggaacaaaaaaataaaccaaatacccttaataaaggtttccaaaatatgtggttaatttgttgcaattgcaggtggggcaggcactatggtggggcccagcagcatgcatgcaggcgcctcggggggagggctgcgtgtggggagcgcccgatccggctcccccggcgccggtcgcccggatagtatcattttccactttgtttctatgaaaaaaggattttgtatttattaattaatagtaggagcgatgaaaaccattggaatgacatccattggatgaggaaaatgactaaaattttagtcatacgaaatttagacgcctctaaagaatatttagcaatcacatgcatggtgaaaaaaatagtgattgcagtaaaaaaaaaacatgggcgtcacatttttagaaaaatgttttttcaactagtcatcccttattacaagttgtagagaacgaatgaagcatcgggatattgagtcaaacttttccggtacatgaaaacatacgaaaataaacaatggtcaataatagaactcatagctatgctaattagaaatatttgttgacatgaaaaaaaaaaagaagagaaatatcattacttcggttaacacaatgacttaataacgactcttagcctatgaaaaaatgaaaagagtagcaataaaaattatcttttggactaatggttagaataccttataaatgaatatgtatcgtctaatagtttataccgagctctacctttaaatgttacttaaaataggacatgggaatccccaaagataatactccataaaagacttgtgcccactccatatgttaatatgtacgtacatcagaacatcggcggaacatagtccaataaagaacataatgttccttcgacaaataaactattgtgaccgttgtacatatacaaatgagacggctacgcttgttcgtgtttacctatcgtgtcatctctttctatctctatactagggcattatcaatcgaaaaaaattacgggtgagcgttcaccccgcacgaacgtcctgatcatttccattttttttactactacgtagtttctattttaaaagtttatatacccaaacttttatacatgtaaagtttatatacacaattttgattcaggtttcggatttaaatgtttatacataggatgcttttatgtataaaatcctatatatacagttatagttatatttatatgtataaatttttgtttaaaacatatatgtgagtctcaaaattatgtggatgaacttacatgtgaattgaaagccaaaaatctaagtaaaaatatatatagtttctggattttgattttttttaataataaggttttaaatacatatttgtgaatagaaatatgcaggatccacatgaggttggctatccgcgcccactgtcaacgggcagatgcatgttaagaaactatcgtccatcggatatcacttgtattaatattgtggaaccaacattacgtgcgaatattaaaaacaataatttatatataaggtagtccggaaaaactagaccggactagctccatccattagagttcttgtcaaatatatgtatacaaagttagttataaagtactccctccgtcccattttaaatacaaccatgagtttccatgcccaacttaagtcgtccgttttatttgaaaatttttataattagtatttttgttgctatgagatgataaaacgcgaatagtactttatgtgtgacttatgtttttaattttttcaaaaaaaattcaaataagacagaagataaaagttgggcaggcttcactcaaatgggacgaagggagtaggacttaggccgtgtttagttcctcctccaaatctttttttgatgtatacggacgcacatttaaagtattaaacgtagactaataataaaacaaattacagattctgtttagaaactgcgagacgaatttattaaacctaattaatccgttattagcaaatgtttactgtagcaccacattgtcaaatcatggcgtaatttagctcaaaagattcatctcgcactttacatgcaaactgtgcaaatggttttttttcgtccatattaattgctccatacatatgtccaaacatttgatgtgacggaatttgtggaagtttgaaggaaactaaacacagccttaggtttcgtttgtttgtgctgttgaggggagcttctctcgtttatcgtgggcacacgcttttcaaactattaaatggtacggtttttcaaacactttctacgttgttttcttttaagaatcgaatatctcaattttcacgtttatatttgttaatatttaattaatcatgtgctaatcactattgtgttttccgtgctactgattatctcaatcaattaataatctttattgagtggcgtctcagtaaacttataatatgcatagtgcaaagtaaaattagtgtcggattctattctggacacactcttaaatatagaggcacacccatcggcctagctagttgaggattattgataacattgatatgtaatatacacttcggttgagcctgcatttttaaatatcgactctagatgtcccctgattaaatttagatctattgtttattcgcgtttgattacggattaccgatgatcttattggtgccattttttatataagaccacccaaagagtgtttccacaccacctctgccttccacacccttctgccatctctcatctctgcctcacggctcagacgacgcacttccttcctcgtattgccgcctcatactcagctagctgcacaaggctggttgtttagtgtaattaacaatccccaacttgggtcgattaccggcggtggacttgatcaggccatcagaatagttttgggatcgaaggagatggattcattattcgtgtgtagtatagttcttcatcttgtatcagctgtcagcatcttgattgcaattgtaggtagccatgtgtagcccaaaaaagaagatgtctggctcagatccccgtgcaagtaacaagttgactaagctaattgcaataaggtaatgagacactaatgaatttttcacgattgatgaacatagatcttacgaccttagcttaattcttaagtcgaactaaacttatagcattttttatatattggaaatggattatatcttcagcctctgtccgtaggtacacagctaaaaaaaaatttagaagtgaacagaaaaaagcataaaatggacgagatggaacaaagccccaacttctaccaataatatgatctactaaaataatatttctaaaacatatggtattgatgaacaaaatcctatgatcctgccatctcgtccaacaggcaacaggaggaaagcaaagagagagtatgtgtggcagcgaaggaactatggcgttgcattgaacatatgttagctcaacaaaagcaagattggaatttgcaggtgtcacatcagaaactgtagtgatgttgagatcttacttactccgtatttagcaaccggttttctgaatcccaggttgagaagtacaggtttgtggacctgtagtttgtacgtactccgttgaacgtttcaacggaacgcacatttgcagtgtactgtctgggcctacataatcatagagcaaattgctcgtggtaaaacgcggtttagacttggcagcagacacaggcaatgctgggggagaacggcatgacagttgacttgacccggacgggatacccgagcgatccaatctatataaccggctccgccaggcgccagcatctcctccacttccacggtaatcacaagctccatccctcgcaacacgcacccaacgggtcagagccatctgccaatcaatgttcacttgtgaattgtgagctgacctggttgagaagctaagcaaaggccgtgtggcgccatggcacagcaacatccgtgcgcgcaccgggacccgggcggcgtggagatgggcgtcccggccgtgtacccgccgctgccgaacccgaacgagcaggccatggaccaggagcggctcggcgggggaggccccaaccactgggtgggcaacgacgccaacacgctgctggttgtggccacgctgatcaccacgctcacgtaccagctcggcaccaacatccccggcggctactggcaggacaccaaggacgaccaccgcgccggcgaccccatcatgcgcgacctgcaccgtcccaggtacacgtactgtccacagctacgtacatgcatcggaagggctcgacgacaacgatcgaattgaacggcacgcggctgtgtaatggtcaggtactgggtgttcatgggggcgagctgaatggggttcgcgagctcgatggtgatgacgctgagcctgctggtgcggatgcccgtggactcgcgcaacgtccggtggtcgttcgcggtggcgtactccacgctggtgctcacgttcatcgtgtcgcagcccaggacgcacctgtcgctggacatcctcgtctgggtcgccgtcctcgccttcctctggttcaccatcagcctccgcccggagcgccgcgcgaaaatcgcccaggcgatctgctgcggccacaacagctgaagaaaccgcgcgcacggcgcaccaccactgattccttcattagcctgttgcgattttctctctcactaatcgacgattcgtgaacgctcctgtgcttacttgatggagatggttggcaaattggatgaattgatgtctctcgtccctcgattcccgttcctgtgcaaattacaagtttacaaccgggagagcctgtttgagaaaagccaatatcctgtgctcctgggccaactgcaatgaactcagcgtctcggctggcaggatgggccagggctccaaattatgaaagaggtaaccaacagtacagtagttttttaaaaaaagaaaaaagaataaaaaaaaaactccacatgacatggttacactgaccttgcgggctgcggcacgtgaatatgcacgtcagcacgagtacttttcattgcacgatttattcacgaaaagaaaaggataaaaggttagagggaaatggaaaaatggttaagaggaaaatggagaaaaatataagggattcaaacaagagaaaacaaaccagctgaaaatatcaactgacaaaaaatttggttacctacagtgcaaatggtctcatcggtgacttcaatttttcgattcagccactaccacttttgattccaaccctcatatttttctcaatttataacgaaggccaaattttacagtgaacaccttacaatggagaaaaaaaatacaaatctaacccaccaaccaccaccaccgggtcacaaccctctctacttcaccggcgctgccgctgccttcggcctctccccactccccgcgccgaggcgacgaactctgccgccgtcggcctctcctccctccccatcggcgcttctccactcccgacaccgctcaagcccaacccacatggggacacagtggcggtcgaggaggccgagcgaatcgacgacgatgagctcctcaaagtgcgagagggcgacaacttgatgagctcctcggtgcgcgaacgggggacgacggtgagcgcgagagggtgatgactcgacaatggcggcatggatctggagggcgacgaaccgacgactcgacgaccagatacaacaggtacctcaactgtcaaaaccgatacaaaatgagtcccaaggcagtttggacagctttttcaactgacgtggtgcctacgtgggtaatttgacttgatcttcatatgacgtggcacatgaagcaaaatttaacaatttaaaaaaataaaacaaaatatgcgtgcccacatgtcagtcaaatattaatattgaaaaataatgggacccacatgtcagtgggccccacttcttccccctctgtatcctatcccctctctcccaccatggaagtcccatgggagcaggcggagcggtggtgcaggaagtcgacggggcggcggcaggcagagtggggtgacggcagccggagcaacgacggcgcgcgaagccgaaggggcgaagcagggcggcggcgagcgaagcagcagcaatccactgtcggcgccgatctccacaatggaagtttgtgtcctcctcttcctccttctcgaacccatcgccatcgtcttcgtcatcttcaacggccacaatggcggggaagcaggtgggaagcgggagctcacccgttgtcgcccacggcaaggacgctgtcaaggtcagagagcagctcggaggatggcgaatgtggcggcgagggccgcgatggtgatggtgaggtgcgcgtcctcctcctcctcgaactcgttgttgttgtcttcggcggcagctatgatagggaagcaggtggggaagcgagagcttgccctctgttgcccctttcctccgccggcggcctgctccagccgccgccactccgctacgcccgtcgctcgctccactcagctggccgtcgccactccaatcggcccgtcgcccttcccactccgccgcccgagcgctcctgtgttttcgttgtagggagagagaggagattgagaggaggggtagggaggatggcatgcgagccacatgggccccatcatttttttttgtgtgtaactaacatgtgggccctacgggttgtattatttctcaagattgaattgacatgtaagcgtcacagcaatgccacgtggaacgaagacttagttaaacgatccatataaacgccacgtcagctaaacccgagatcaatactatcgagggacctcgtttgcatggttttgtaagttaggagatacgttctatccagttttttggaccgaggatgaagatcagactcgatgacaaattagggattccacgatttattcaaagtactcggtggattccacgatttattcaggaatagaaaaaggataaaggatagaggaaaatggaggaaaacagaaggattcaaagcaaagaagacaagtcaggtgaaaatatcaagtgacaaacagcaaaactggtaatatttgttacgaaacgtgattaaaaaagtgcacatcttttcagatttataattacgacacatactcccggcagtcccggcagagaaggccacgcaggtgaaggaaggaccatgtggtcgcgtctggggcagctagactttgaggagcgctgtcgtcggctcgagcagtgtgctgagagggcaagaggagagagagaaagaggtggggtcacgtgggtctattttgctgattgacatatggagctcaattttttttccattattttttatttatctggctgaccatattgccacgtaaccacccgtttaaactcaacgtaggaattgtttaattttggacacaaggaacatgcgacccgaaagcaacaaaacagaaaggactcagaactctcttcttgctcattgcttgggaaatctggaaggaacgaaatgcaagaatctttagagcaaaggaggcgaccgtacaccagatgattagtcgcatttaagaggaattaggttggtggagtatggccggcgctaaacacattgggagaatgttgtcacgaggagctaggaagtctacgtgcaagcttgtttgcatgttgtcatatatagtttttctctttcttagccctttggctatctgtactttttctccttctatcaatataacgccaatcaattctgaccggctgttaaaaaaaaaaaactcaacgtaggacagagtgacagactatcaatgtgccatgtgagtgttatgtagttggacaaaaccgctcagggacgtaaaatgagccagttttaatggatgaggctggctgaggggtgaaaatcatcttgggcgttagttgaagaaggaaaaattaacttattccttttggacgttgggccgtgttgcaatgggatgggttggatgcaaccgctatggtgcagagggactccagcaggaccgtcacgactcgtcccaaagtcgtcggactcgtccgcactcagcgggcccttgttcagattttcatgttgaaagacccgatggtaatttgttggcccaactgtccaagaaaatcccatacgtctgcaatgcacgatagcagacaactaggaaagtcattagttgcccatatttcctaataagtcattttaacttattaaaaataaaaattaacttataagtaaattttacaaaactacgaatattttgatcgaactatcgcaaaactatatatttaaaaatttatatcacaaactacagattcagcgctaaacttatcacaaagcaacagatatagaacatcatatcacaaaactacagatttagtgataaaattataaaaaaactacaaactttagagtttatatccgtagcactattgaattgcaaaagttattgttttgtgataaatatgataaatttattttttttatattataccttaaatatgtagttttaggaaaaaaatacgatgataaatttgtagttttatgatacacttttttaaatctgtagttttgtgatagattgatcaaagtatatgtagtttcgtgaaattttctcttaatgtataggtaaaatttttatatatgtgttcctagcgacttaaaaggtgacaataaaaatagaactacattaaaaatatattaaaatcaacttcaaattgaaatttcaaaatttatcttttgtctttgacttatcagggcaaccgatggagctctaggttaaaatcaggtgcaattacaactataaaatctgtatgtaattttctcaacaatttttgtagtgtgggggtacttcacgatgttcagatttatcgctatagtaatattgtggagtacccccacactacatcacattgctacagtataacaaactgtgaactgtgctagtctggacagttttatttgcatccgatagcgagagctgatactacctacttcttctgtcccatacaaaatcagcctagtactggatgtgatatatttctattactataaatttcgatatacatctgtttagattcctagtatagaatgtgtcatatccaaggtgtgtttaaggtgtgtttagttcacaccaaaattggaagtttgattgaaattagaataatgtgatggaaaagttgaaagtttttgtgtgtaggaaagttttgatgtgatggaaaagttagaagtttgaagaaaaagttagaaactaaaccaagtcccaattctagattaatttattttgagatagagtcagttactacagctgatctggatgacaaccactcggcaggtgttgatttggagtaaccatcgttccatcgtaggtggtaggcctgcatagttaactgatggcatcccaatccaagctcaacagttggtgcggggtgtttggatggggctaaattttttttagtctgtgtcacatcagatgtgtagacactaatttggagtattaaatatagattaataaaaaataataatttcataaatgagagctaatccgtgagacgaattttttaagcctaattaattcataattagcaaatgtttaatgtagcatcacatagactaatcatggattaattagactcaatagatttgtctagcgaattagtccaaggttatagattatgttttataattaattcatatttaatactctaaattaatatttaaacatcttatgatacgaactaaattttagtccatctaaaccacaaacttgcggagggcctgtttgtttcacggcgactggggaggcaagcttgaccagcaatatatagctgctcatttcggtcatggagtggagactgcgaggtgcgaacagtgagacagggcaaacgtgagaacccgtgtgaaacagtgaagttctgtcggagaaacacggcctcccccgggcaacgccttctccgctgcagagtccagcccaaacagcgatgaattaatcacacgaaaccaaacacgacaatgagctcgcgtgaggccggtgaggcggtgacacgctagtactcaactcaaatatccacaaggatagatgcccactgcccccacggttctcatacattatccaggcagggccctagtttttgttattctgtagcagcaccacaagccgtcaaaaaaagacgataaatacagagcaaacctcgctttagtatctcggcgtttggcaattaggcagcatcatctggatttgatgggaaccgaagaatattcatttacgctaagctcgacgcagaccagcgagcaagtcagcaaagcagttacgcatttcacctccccccggtacgcctctgctacgcaacgccggcgagcctccggcttttgtttcgagcgtttttcctctcttcctcttccggatacaagcggctaggcggctagcttgttcaaagtttttttaacatgttcagcgcagggtgccggtgttcgagttgctctattggcacgttgcgttgtgcaccttccattcaaggaaaaaaaaaacagcttctaaggatgaatttagatatactgatatgcatttatcgagattcatatgcttatttttttggacagcgggtgtaggtcatatctatttttttagttttgatatatatttatcgataattttttccttgaaatttgacaaatttaaatatattgtaacttacatataactacaatataatttgtatgcaactttacataattttgaactgtcatatttacttaaagattcgtgcaaacgaaaaaagtaaaaaattcatagtgtgcgcaccagtggcggtgaggggattcggtcccgcaacctccattttgcgaaaatattgtgttaccatatgtttttttgaaagttgcatgcaacttacattgtaaatataacaagttacgatacaattgcactatatcatcaaatgattgattgattcaagttacaacaaatataggttttccctttttttaatgcaataagacattatattaatcgataaatgttgttacatactattattacttgttacatagaacaccaacacagtctgcaatgcacatatttcatcgttacttttagtaaatatatttattaaagctattacaatataacaacgtaaaatttattttcatgacaaatttaataatattattttctcacaaattctgatatttgtttcataaattaatcatttaatgttttaaggtttgactgtacatgttttcagatgacatcaattcaggaacggaggtagtaaaaaaatagaattgactcctagccatcctaacatcattaataacgatatgaaagacaaccctaaactatcttattactccatctgtttcaaaaacagtaacttagacatagattagacatatcttaagacaatgaagttggatagatcctctatctatacatattcattatcctaagatatatctaatctttgcataagttgatactccatattttaagataaaggaaataggtagatacaaatatttgaaattttgttcataaaaggtttagatccccttacccttgtgaccttgcaacaatgtcaggacttattcggcttgaagaaaaataaatgatttggattcttaaggattaatttctacgagtgtcattcggtttgtaggtataaggtatagaaaaatcaaaggaaattttctttttcttcaagttgtttttgagaaatcataggataatttccatacactcaaatatcttagaaaaaatcttatgaattgatgtgtgcatacctttctattccatcatttttttttctatttttatgggctaaaattccttcaaaccgaataagccgtcagcagtgagaacactggagttgaagcgcgagtccacatatttttttatcatcgagagattacaggttttttctgatgttacttactgttttttgaccggactggtgttagtacttactgttgacttctactgtagaatttctttttcgaagttattgaagactagaacggtactagaagtaatcctcgttgtgcggatcgaaagttagctgtcatttctacgaagaaccacaccttgcaaggctaaaaaccataacaagattaaaaaaaaggcttaaaaatcataacagagaaaaaacatggagagtatatcttgcttttggtaaatccgggaaaataaaccatgtccgtgtgctttactttagtgctgaatggtcaggttacaagttccagccatttttttctcagcgtgagcgttattattctcccttttcctctggaatcgttgtctattatccgtcctcactcggttacgccctcctgcatcttcaagtcagcatgcacacgtagctttcatcgagatcactgactcactcactgacccctgcctggttggtgcaagcaccttgcgtccattgaatttgatcaatgtgaacgaattgattcggcctgaataacttgtgagtggcaggctcaaaggtcctgcccgggggaggcaccaccggaccagaccggctatagaaaagaaagctggcctaatcctggcgtctctgcagttcaccactgcttgatgtgcccctgcaaaagtcgactcaagacaagtagccaacacgctcttgcagggaaaatatgtttgccccttttgcactttaatcaagcggctgtcgttactcgtctggtcgatttactgtactgctcttactcggttaaaatgccaaaaaaaaaattccattcgctctagaattagaacttctaccggtgatttttttaaaaaaaaaatctgaagtctgaacagctactatttgagattgtttagcatggcatcgttcggagacgtgcaatcactcgatgctccaacgaaaaccacgaggccacagttgccgtcagccgtcccaaaggcaccccgcactagcacctgatccaccccttacctgagacagcgagccttgtggagggggaaaaaacaagaagatcgcgcatagtacttctctagcaatatctctacactactttttagtaaattaatccccgatttggcagcgaaacggcgagtccacgagggctgtgtttagataaaagtttggatccaaacttcaattctttttcatcacatcaacctttcatacacacataattctttagtcacatcatctccaattttaactaaaatttaaactttgcgttgaactaaacacagccaaaaacgcatttccccccataaaaagctgccccttttatggcccgtcgaaaaacataccaacaaagtaactgacggactaggactgaagctgcacgtacgtacaagcgtcgttacgccgagtttaacaggtagcgcgagggtttccaaaaataaaaaaataaaaaaaaaacaggtagcgtgagcgcgagcaacttccccggttgaacctgtgtcacaccccaatctgataccgccgtacaacggcacctgacaggagcgtgtcgtagggaaaacggcgtgaaccgcttcctacgaaaccgcgatctcggtaccagtcccaggacatagtgctggtacccacggtgacaaatatgaatcatagcaatccttaaaataaatagaggacttatttaccttaacttaggttgtagctcagacagcccgagaatacaaccgacgacacggacgaggcgaacaccaacagcagcagcggaaccaacggtctaacacccaacaccacaggcgacggctgggaaccaggacgaaaccctaatcttcacttcactttgtcttctcttcagggcggaggaactatatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttttaagtttgggccgaaaagagacttgcgtctcgattcgtctttaagagatgtttttcaacagctcgatcagtaatgtaccgacctcccgggtcagatcattacttctcggctcccagagccattccacttgattaatcggctcccagagcctttttcattttctcggactcccagagtcctgctgcccggcagcacaacaatccgcttacactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatccaactccaaccacctcgatcggtaattcaacaagcttctcgttcttgcattaccaggaacccggtttggctccaaccgaccccgccccggtgttcccaactattggcatgcgaggtttccctgaaccgactagttacttagccatggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagagaacccgcgatcaacgaaaaccgataaccgcaactatacgcaaacaatcgaaaacctaaacaaaagaccaaaagaaatatcctatttagacctattagtagtgccattaaatagatctcaattttacggaattactggaagtggaacggaggcgatcggagctacggatcgagggatatgaattttggaggtctaaatggatttcctggacaaggaaaaggaattattaattcccttggaaaagaaaaggaaggagggatcggatttagacttcctcgggcgacttaggcgcggcccgagggattctcaaggcttggccggccattgggccgagcgcggccacggggaagcggcccattagggcgcgcggggagagggggaggcccgacggggtgggcgcggtcctccgcgcggggtcccgagatgggcccacatgggggcggtcgggtgtatggtggggagggcgcacgcggggacgagcgagacggaccggtggattgggtgcggatgcggtgcgctggtcgacaaggaggcggcgggcccacgtgcagcctcatggctcaccggggtctgcgcgcacggggatgaaggggcgagggcgagcggctgaccggcttgaccgggtcaagccgacgtggcacctatgccaggccacgtgggcggcgagaggaggaagaagggggatgccgagatggacggcggacggtggccgagttcaccggagtttgatgcggaggtctagggccaaggggagcacaccggaacgatggctaggataagagggagtgagcctccggctcggattcgccggggggattcgacggcgacggatttcgacggtggcggccggcggcgatcaaaaggggaaatcgcggcggggcgacgagaggtcgattcaaggaggagggagcatctccggggcgcggggaactcatttccggcaccggatggggcggaggactgccgaggagggctggcgacggcggcggcctccgggagcgggcggcaacggcagcaagcctatggcgggcggcggcgagacctggggcagcgtccatgcgtgttcgggggggctagccgagctaccacgcgagctaaggaaggagaggaccagcgaaaaaggggaacggagggtggcactaccaagccgagacgggcgcagtgac

SEQ ID NO: 59752 - DNA, 662 bp, Oryza sativa
atcccccagatctaccggcgcccgccaactggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtaaagaaccaccggaacagccgaagagatgggcgcaccccaatgaacatctcgcacactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtctttctttttatctatatttaatgcttcatgcatatatccaaagattcgatataatgtttttgggaaaaaaacttggggaactaaagaggcccaagcgtgctgaaagctcgctgtgaacaaagccgcaaaagtgggagaaatcacagcagctgagctgtgcacgcagactgtagtagtagtagagcgctagactgaccactggtccctatttcctgacgcgtgggttcccccgttgcc

SEQ ID NO: 59753 - DNA, 1596 bp, Oryza sativa
cattctctgacaaaaatactctagaattttgtcaaagcaccagtattacatgttaacctgtccaaaagctcagtaacaccaatcaactcccaaaatattgatgtggttgttgttttagaaaatttcacatggcaacgagaaaccctcccatttatctacctactctagggtgcctcaggcgtgtacacttgcagccaatagaaaacaataccgaggctcacctgcccggctagaacaaaatgcttccacatgaaggtgtcatgtcctggtgaattcagtgcttagctccaccccaacatacgtactcattgtcttaaagcctcccaaacaattctacacggagatcgataaggtgaaaggatgattcctatatgccgctatgaagaactacacgagggcaaatgtacggtcgattggacaaaggtttgttacaaaaaccaacctcgatagctcatcggtaaccaaacatggaagaaacactataaaagatccaaatacgatgataacaccaaggcacgatatttgctaacgtggttcagccaaaccctacatcctggggcactgattacgtgcactccatctcgatccaacacaattaaagtgtatcagagttacaatgatcctcggcggatgctgccggcaaccattccctcttgcctatgctaagtcgccatgcgattacaacatgtgtgcctctctatttaagagagagcctaggatgtccaactccaagtccaaaactataactgactttgtacacatattcaacacaaaactctaacaaggttttgctccctactcaaatttggagggtaaggggttccaaacctagaaaattcgctagtatgcttcgtcaaaggtggctctggtatgaaaggaatgtgccaaacaaaccatggatttgaacacctatgccttgcgatgacaaggataggcattgttttcgacgtccactgtagtcatcttaggagatatcaaaaacacgagcttatagctagatcgaagggtagcaattaaggagcattgcactaaacccatataatcaatgccgacagaagcagagaacagtacaagagccattatgcaatcagcaatggctcaaagacatacgacacaacatgacattggctctgttcgaggaatacttttccatttggtgtatattggagtgagcaaacccatagctaatagaaggcatcaaagacacaataaggtggaagaggtcagcaaccagagaatacagtacaaagtcagcaaaggcgacgtcatgtatccaagtttggaaaacatgggcccccgccaaatgtaaggttttttccaggttgctgctgcaagactgactttggactgttgacagattgcagcaaagaggatggccgaattgctgtttctgttagctatgcatgaggaatttggaatgtgctcaccacttgattttggaatgctcgttcactcgtgcgtatggaatgaaaccttcaccaagttgcatcagcctcaacaaatgacaaacatgaccacaatagccttctttcatattggattggcagaatgcgcaaccatgaccgttccacgagggattaaaattctgccctagtc

SEQ ID NO: 59754 - DNA, 9380 bp, Oryza sativa
gcacaaaataataatcaatatctatatgttttgttctagcatgaaacactagattagtagataaataagttgctcaatattatcacaccaaacctgagctgccggtggagaagaaacttttagttcccgcaaaagagtttggatccaaattatttatgtgggtttggggggggggattttttttcgctagagatttgtacttagctttagtacttgatctagaaaccatagcttgcttgcgagcactccaagataccaagttgcatccaagaaaaactaccaaaccactagttgagtgccgatcatcaacatttcctgcccaatcagtgtcagaaaaagcacaaactaaagtagatgactctttcttgatctatagaccggcgccaagagtatattgcaaatatctaagaatctgtttcactgctgtccagtgatctgccattggcaactaaaggaattgacaaacattattcacaggaaaagatatgttagttctagtaagtgctactccctcagggctgataatattagtcgttctagcagaaacattgtgactgatcctttattatgaaaaatagtgaagtaatcagctttagaggaaataaaaccaagttgatgtaccttttgacttaacctttcaaaccacgctcttggcgcctgtttgagaccatagagagccttgtctagtttgagtacatgatctggccttgatttatcttcatatcctggtggttgcttcatataaacttcctcctcaagaatgccatgacgaaacgcattctgtatatcaagttgcctgaggcaccatcccctactaggtgcaccattccctactgactacaagactaaaggtatcctcataatcaattccatacctttgcttgaaacattaggctattagtccagctttatacctatcaagagagccatcagccttcctgttgatcttgaacacccacttgcaatcaattacatttcttccttcttttgctggtataggatgccaagttttgttgttgatcaatgcatgggactcactatccatggcttctttccatctttcatttgccaatgcttcatcaatattatgtggttctcctaaagcagccagaaaatcatacctaatatggccatcagtatagacttttggcttgaccactccactttgtgaccgagtgtgtggtcggacaacttctgaagcgacaaaagatctagcttggcctacctcagctgacgatctcggcgcctgattgggagcagacgcgtcctcattggttgagaaggcagccgcactctcgcttggtgagtgagcattgcgccaagggagacaggcgtggttccctaggtctgcattggcgatccaggggaagattttcctgaaaattcccctgttgcttcagggaaatcctcctcgtgtccagcgtcatcatgctctgttattcaagtgaattctcctcagaatttgctttagaaactaccaaaatttcaccagaattattagtaacatcaggacgtcgcgcgtcagggtggccatcagataatcaaggacctgttgatcctcagttacccaccgggtgaaatctgaattcaccttcttgattaccttgtctccttctttcactttgatctcctttacagggacctcagcggtgccatcaagatacccaaacatctgggctcctctaatggtgggaaggacttgcgccttccataggagatagttcccctttcccaacttctctatcaccggaacaacgaagggcaatgcaccaaccggagtggaagaggaagatgccatcggcttgttttagatgtatctctgaggagaaggctatgataccatgtggaaatagcgaagccatacctttgttgatatagccggcaaaacgcggcagagaattacatgcaagtttgttacaagagataagggatatgattatatctttggctaatctattcttatccttctatctttgtatcatatctaactatatatctaacaataagatgacaaatcatccatacgataagtatgcaactgtattttggacgagataaaattttgaaacatgagaggtgccaaagatttagcgagaatatcgaaatcatgaatacagctagcggcaagcatgtttgctgccacaggtgtaaatcttatttacattttcatatcaccacttggctactgtttttactccttttttttttacggatatttactcctaaaattaatagaacgccaagctggtctttcgagaaaaaaaattctctactactactgctgagggcaagttttatagtagatgtgactaccacatccaatttcatgcatgaaatacataattaaattaagaggtgatatgtataataggttacctctaccacacaatccccaatatctctaatattctcatatgtttattgaaatttgtgtaggggttgcctcttgcatgagaggtgactatttatctctcatccttcttctctcctccacctcactatttagtcctatatggcatcttggggctttgtgcttgatgcccatagtacttgccctccattgatatgcatgctacaaaagcactggatttttaatcatatccttcaactgttatggacttattgtgatgtttggacagttgggtttccaaaacctcctattggtgttgtccaaactccaaagaggaggcccattttgaaactgttgcccggcaaggaaaagggaaagaaagtgaatcgaaaggaggagagccatcgactgagaaagttcctccaccctaggaaccaaccatgcagaggagcagaatcttaatttctcgatagcaaatctaacaacggaaaccttttctttcgttcttttcgtattatatgaactgatgatgaagtagtacaggcacttcattgcaagttgcaattcttctcagttcacagattctgggcgctgaatgtgttcaacttggttctgacctttaattcagatttctaaacccattaaccagttcaacgctgaactggcagattataacagtatcaagctatatagtctttcctcagcactgagcttaaatttaaccaaaaaacaaactcgcatagtaggactgatcagcaagctagagaagcattcatcaaagctattaatacatgactttagtagtatattgctcttgcatagctgtcaaccaaatgagcttggttattattccttgactgtacgtgcatccaattaattacgataatcttcttgatcactcaagctaattatcaccccctgtttacataaggaatctcatgacagcttctctagttattattaggaaaatcagatcgattgaaaaggacacaacatgcatgcatgagatcctctcccaactagagatctaggaagcactccttttttgcccccggttaatatgatatggccaagattctgaaccacatttgactgaacaccggtctcagccatcgtgtgagtatattcccggcctgaattcatccgtgcacgctgaatccgtacgaaaaggaagagagctggttaatttcttgctctttcctttctctgtcactctctgaagcctgaacctgtcgacgtcgtggcgcaacttggtgtataaaacgaagagacgaagctagctagctatgcaggtttggtcagaggcagccatcgtgtggtaaagcctaatgctaacatgcgacgcacagcaagagatcctgccgatcttggcatcggcgaagcggtggcgcagacaagcctgcaggtatttttctcgtgtggatttcagaaggcgcgattttacctgacagatattcagtctggagccgctgattttgacaagaaaaggaacgaaagccataaaagcagcagaaagaaatttcttgggcttttatttttggcccataatctgcgggtagaattcttgattccatgaaattggcccataaggtttgtgctgagaaaatacctctctcttttaatttctcttttaaatcctgtcaagaaaaatgtaattgcaggatcgatgtaattgctgtggtgagttcgtcatggcgcaccaccggattaggatagcggattgaggtcatttttactagaactagctgggtggcccgcgcaattgcgcggctagcacccaaacaaaatcatatatttttttaagtatgattttacttaaaatttattaaatagctatctcattgtcttaggactttgaaagaccaaattttatcatcatcgtgtttctaattatatagtttttaaaagtcacaccagttgctaccccttatgtctcatctccttctttatttgcttgctcgatctaccactatttctattcattcttattggaacctttaaaaattggattttatagtttttagagtttattgtcacgttgggttttatttttataatttctagatgtcccgtcaaacgttgctattatactcctctacgacacgtccattgtcttatctctttattgtcattgagaatttaaaaattgaacataattatcgtttaagttcatttttactttttagaagtcccgccaaaccgttagcggctttgccattgtaatcctctacggctcgcccgctgcctcccttctttatttcattttgattttaaaatcgaacatgattatcattgatttttttacttttcagaagttctgaacctttaaaaattggacttgtagttttatttttaataatttttagaagtgccatcaaacgatgtcactatgtccctgatctacagcccatccgccacctactctttattatcattgtgattctaaaaattgtttttttttactttctagaaatcccggcaaccgccttactcgtttgcttcacggcctccctaacgtctctccttttaatcgtcattaggattctatttggtgttttattaacaatttttatatgtcatatcaaccgccaccactctacccctttataggcatgttacttaatatatctcgtcatgtgttttagatggtcttttattttaataatctttatttttatcaaaaattttagttatttttaaattgtattcctaattgaaatcttatttttctttttctaattttagaattttttttaaaaaaattatttaatactgtattgtgttattttaatgtttttattttttattttcaatttcagttgtttcaaaattttagtcctacttgaactctcttttattgttttctaactttggatattattttattttttattctaaattttaattaatctcgtattgggttcttatatggattcttttttcagtatgcttatttttaattcggaatttcagctatttttaaattgtatttctacttgaactccttattttctttttttaattttggattttattttatttttattttgaattttgattaatctcgtattgggttcttatatggaatcttctttcaatattccttatttttaattccgaatttcagctattttaaattgtatttctatttggactctcctttccttttctaattttggattttattttatttttatttcgaattttgattaatcacgtattgggttcctatatggactcctctttccatattgcatatttttaattccgaatttcagctatttttaattgtatttctactttgactcttcttttctttttctccgattaatgtgggaatttctagcccccacggtgaacgtggtgcctttgtttcgagctgtattaataatataatagatcgctggattgaagcattccgctgtcaggctgagctctgcgacatgccaacagtttgctgaactgaactgacgaagcaacgccatactgccattcctaatctgtggtggtcacctgtagattctacggatgaagggaaaacgggaagatacccacgccccaccccccaaaagaaggaaagagaaaactacccgtgcactgttttgtcattttttatctgattgatggaaaacatcagacaacatcatcgcatggcagctaacaaacaacagtagacagtagtagttcccatactatctaccttcacttccattttaccctcccatctttcaccaaagctcaggcttatagctcaactttctgagattcaccgtcccccacccttgtcagttgtcactgcccaatgcagacacacactcttaaatcattaggagctgaaagtgaggtgacagaccacaccccccaacttgcagcaatgcctgcttgccaccacatggcgccctccttgtttgtttgtttgtatggcagcaaatgaatcatccacacacacagacacacaaacttttccagggcccaggccatcggcatgggcgcatggccagctcaagctactggggctgcatctgcatgacagcatgagagagtctgcaggtgaacactacacacacgcacacacaactagagctagatgatgagagcccagccagccatatgtgctgggttcatcgatgtacccaggttgcaggggatggtggaatgccctggcatcgtgctattatctttgcccagcctgcctgcctgcctgcctgcgcgccattttccttttctttatgcgagtgatggtgttttgtctgtggcgatggggtgggggagagtggacaagtgctagagtctgaatctgtgggtgcaatttgcactttgccggttttttctatggtttctgagtctggggcaaaggccatgccgccaatgcgtatattatccatccggcaagagggtgcgtttactgttggagattaagaattctagggtctagtgaaaaccacatgacctcacaaattttcaggcttaacctataactgaactaaattactcaggatacagtagaatggcttgggcagcaaacctgatacatactccctcctattatggttaaaaacggtcgcggaaattcccaacaaattgacgctcgtttctgatttctacaaatcatatgggaaatggtaaacgctgaaaacagaaatgaaactggcaagaaaaatgataaatggaaacggttttgttgttctaccaaccgcttcttattttattgtatttattatgtggaaattaccatctttataatacattactcatcgtatttataaattctattctaggttagcttttttttgggacggaggaagtacatagtataaactagaatttatttggttatatgtgattttacagttcaatgctttcgacatttattagcggttttcgatccatactaacatgtttccatctgcataattaattttcagtaccatttttgttatcggctttaccgttctgattccgtttcggacaaaaatatggttgttgtagcaggaggcacataccatcccctattcgaccgaaacactctcactcactgatcaaagatcctaatagaccgaaacactctcacccattgatcaaagaggcttttacttatggcaagatctatacatatggcaaggttttttatttatggcaaggttttacttataacaaggtttttacttatgacaaggttttttttacttatgacaaggctcttatggcaagattttacttataacaaggcttttacttatgataaggtttttacctatgacaaggtttttacttatgacaaggcttttatctatggcaagacttttacttatggtaaatacttttggatctactgatacagtagaatggcaagacttttaccaaccaaagaggtttttgcttgtggcaaacacttctcgacttaatatgacaggtaaatactaaacgaccgatgtctagaaagaagcatttgaaggtaagtactagtcgatcagggcagatgaagcttgaaggttacgccatcgaactaggaatattcctcaagaagataccatggggactgctccaaccactcttgcaagctggcacctgaagctttagagaccacacaaatgtacaactatacccttagggtttctagcattataggggtattgcagtaacttcctgtgcaccctcaaaggtaagattgtaacttcacatgtacctctggaaccatataagtcggtcataatactgcaacaagacaagacataactaatagcaaaatatcatctcacacattttgcatttctattcgagttaattctcaagataggcggggaatttgtgttttaccgtaacccaaggtcacgacaatggttatgaaaattgttaagtttgctttccaaccattttcattcctaccttttgtcataaatatttgatgcttgagataagatttggtcattttttttaaataccaaccaccaataatttcttaaatttttagctgaaagtttagtatatataaattttcctcgaaaagcactatcttactaccataaacttatcagattctataaattaattttgatataaaattaatgatcagaatattaaagtttgatcaaaccttttctaagcatcaaatatttattgaacaagggagtacagattgtgtgcatgaagtgaatttgtcctaattttgtggctaggtataatcaacaatttatggtgtaacatatattatatttgattttacataatttttttatgattgatttaaatagaaagagagcccacttatccacatttaaggagacactcgtttgtctttgctaaataacctataattaattcatctcaagaaataagttattgcaagcctacatatggtttgaagaaggataacccttgtcattatattttaggatgcatgttgtaagtcaaatctttatgatattagatttggttaactcgttttatttagataagttctctcatttgaccactttattgatttctagataagctgcattaggcccaacaaatatgctgctttaagctttcctactaaatatagtactttcacccacaccacaaatttcgttctccaacgcgaccattagaatcaactcacacctcaaatttcctcctccaacacgaccattagaattaaccctatcttcaaagcttaaaactcctactttacagcaactttatctgatcctgctcctgtaaaataggtttttgagttaaagcatttactatccacttcatatttcttcctgtgagtcctgaggtaatacaatgtacactttgcaaaacaagacctaatttattaaaaaaatatcttttattagcttatacatatattaatttcttataatttttaccatcgtttatattttcaagagttttcatttgagttttatatattctccatgctattcattccgtttcttaatatatgtcaatttcaactttcctatttaagctttgacaattagttgctttgaattgttagaggaaagctaaaatatttaaagcatatcacactttaataatg

SEQ ID NO: 59755 - DNA, 12745 bp, Oryza sativa
cgccacgccttttacccaaaaaagtacagatcttggccacggccttgccatccccaacccaaacctacgaaaaaaatcgtttcttttcgtcacctgactcatctttcctcgtcttgatgtgacaagccagtggaacgaatgtgcacgtgcttatccatctctacattaactaaaaaaatgtcattttgatgtgctgctaagtttcctttccaaaatgtgatccatttcttgggttgcgcgaggtaggagagagagagagaggggggaggggggggggatcttacgaacaagctaggtgcggtgcagtgagagcagcagagatgggtaccaatgattgggtcgcagtgctgaagaagggaaatggcttagcagtttgtagcacccgctgggcaaacggaaggcatgatctgcaagctggccctgggacttgcagtgcagtggcctcgtttcgtttcatcagattggctgcgccgatatgcccgtccttccttcctgtactggcgatgggaaatgttcgtttgttcgtatgttcggcctgatgtgccaggttggtgggtagcgtcatccttggtgtgtacggtgtaccattgccgtccatctgttgcatctctcattggtcgactaattttaggcttgtgctgtgtttaggagatggacggtttgaaggtttcttgtttctttttctttcatataatgatatagggaatgttttctttacgtacgcggatactaaggagctgatggccacataaatagttccacaacttttggtgaaccggtgtttatataaggtacaggtgctaatgactgcttgtgttcacttactctacaaaagatgttggtggacacaaacaaaacgagaaaataatagtgataaatgatgtttccaaacaccagattgattctaattaggactttacagtttgtactgaagatgtgacctctcctttagttgttttttatggagtttctgtttgtagcggtacactagcttttcctgttcccttctatgctagtttttaggaggctgaacatacaaaaagttcgttcataaggtttcataatttgctacattcattgtattcaatgacaatatggagcatcatgctcctcttagtatattgaagaaattaaaagtcttatgcttttatagcattttttagcatgtcaatcagttggatgagtatacaggttagtgtgcctaattaaccggaaagtgtcatttgatgcaattctacgccttctgttcttattttgacattgcaagttcaagctcataggtttgaatatgtttcaggttgtagcaataaaggttattcgtaataagcaaactggacaatcggagggttatggatttgtagagttctacagtcatgctgctgctgagaaagtacttgaaggatttgctggtcatataatgccaaacactgaccaaccttttaggataaattgggcatcatttagcatgggggacagacgttcagatattgcttcagatcattccatatttgtaggcgaccttgcttctgatgtcaatgataccacattactagagactttctccaaaaggtactcctctgtcaaaggtgcgaaagttgttattgatgctaatactggtagatcaaagggctatggttttgtgagatttggagatgataacgagaagacacatgccatgactgagatgaatggtgtgtattgctctaccaggccaatgagaattggccctgcaactcccagaaaaacctcaggttcaatcacaagtatctaattcagttcttttttggggtcaacactagtacattcataccaagcattatttgtttaatagatccttaatttcaacgctagtacccctaaatttgcgagtctttctgtccattaatgtagtatagcagaagatagtatggactctctttttttttttgaagatatggactctataaatttgctgtcatgtactatggtttcctgtcactgttcactctctaattttgttagcattttccccttccttttaaatttctcttgtactctttttcaaaaagaaaaatgtatatttatttaattattttcattcagactttagttgtattatcttgaattgttcatcaatcttgcagcatcccatattttacttttgctcatatctccctaattttttttaggaatatagtatccttctccatgcttctgagtacatcatttgagttagtaattgatggtctttggtgtttgatgtcattattgtgtatatcatttttgcaatcttccggtttcatctataaggtcctacaatgcctttccaacaaaatgctactttccctgcattttcccttcagaagaacaatgaacaacacaattttagtcttttcacaccttggaaatatttttatattattttacctaattgtaattttggatgaacatcggacatgcttgatatctgttaattgtcgcagatattttcagatttaacctcgtgctcgattcatatattattctttttagaatacagggattggttttgaaaatctgagataatttaatataccaaacctgagaatgatagtgcattattgccttatagagtgaacagtggatgggataaaacttgctttgacaatcttatacaggtgttcctattaagacacttaattcctattttctaactatgtttctcggtataggtacttctggacctactggttcagctgctcgatcagatggagatttgacaaacacaactgtgagtacagatgtatttacccataaagtcttatgtgtatacgaatttttccttctataaccgtccagtaacttattgtaggtatttgtcggtgggcttgatccaaatgttagtgaagatgaccttaggcaaacattttcgcaatacggtgaaatttcatcggtaaagatcccagttgggaaacagtgcggctttgtgcagtttgttcagaggtaatttcaacccatatttgttttctaagggtaaatttcctctgttcctgtcccattgacaagatctgattaacattgtcaatgtgttcctttttccaggaagaatgcggaagatgcattgcaaggactgaacggaagcaccattgggaaacagaccgtgcgtctttcgtggggacgcaatccagcaaacaagcaggtacaatcttcccccttgctacatttccaccagaggaactgtaaaattgtgcagtaaacataggcaaaaggacctgagactccatttcttgaccatgtacagttgaggagtgacaatggcagtcagtggaacaacgggatgtactacgcagcctcgccgttttacagtggatacggctaccctgcaccgttccctgctgatccgggcatgtacgctgctgcttatggcgcctacccgttctacggaaaccaacaacaagtgagctaagaggtcacttgtgcttcacctcaaactggagctaggcacgcaagcattagcagtagctcttgctagaagaaaaaaagaacaaggtagacgacggtttcctaggtcagctagatgcagtcactggttatgtaaagtacattactacacgaactagctagcgccactaagccgccctattgactggccatggtctgctgaactcttcttccagaaaagaagttttgacctggagctgcaccttattgaagtagaacaataaactattcaaatacctactgtgcgctatctgatcttttttttttcccttgtcctcttttttttacattgagttagctcgctttgtaggtttgggggtttagaataccggtttgactgaaattactggataaaaattttaatccaaaatttaatttttttattagtaatcaaatcttactgtccaaaaataactctatatttaaatttttgtttcaattcatatttcttaagcagaaactgcaccaccagtccatggtccagttacaccggtttttgaaaccctaatatggtttcggttatccaaaaaagcatgttttttttaggataacatagtcaactttattaaccaagacagagttcagggcatagagcccatacatcacaaaaggatacagagtaaagtaagcaaccatctctaacagagaagagaccaagcagtctaaggaagcaaacttccagtagatactaaacagcagtggagaatcagatcgacagagttctacggcaaagccgtgacgactgaatccttgggcctccattgatatgctcaccgtttgacagaccggaaagctttaccacagaaatggcacaaattggaggtaagttgctgagccgtagattttggtgtaggcatcatcggactcaacacaatgattccacggagtctcccattagatctgaggagcaggaagtgctcaactcgaacggtagaccctgtatggatactgctattttgaaaccaaaggaagtaagatttcaaagaacaggtagccaacatcacaggaaaattcagatgggtgcaatagaacatctgtctttgcagaaggccaaggattgctgaagatttgtaaaagcagtgagagcccaaattcagacagaaactggagtatgacgcagcaaattgagaggagcaagctgtgaacaaagaagagattcagatcggaaaaagaagacaccatgggagattttcaccgtcaaatgaaggcagtagctggaggcaacaacaaaggtttcatgtccatctacgccaccacacagagcaacaccactgcacagagcacccaggctcctgctactacgggcgctgccgcacggtgcgatgccgctcaaagctccaaggttgtcgttaccttcacactgcttgtaaccagcagcagccccaaaagaagtctccatccattgattcattagcagaccttcaaatctctcagctccacctccagaaaccatcaccgccgccatccacgctctggcaacccaggcccttcgccgataagacattacactggacatgcctagaataacaggaaaaaaacctgacaaaactacaacctatctactctataccttttgcatgtcttatttaatgtcttattgcgaaactgaaaaacctgacattactcttattgcatgtcgatctgcaataagctggaacggttcacaatgtcaatgaactttgtaaattttgagcatctcgagctaacttgcaatgtgcatctcgaacggtttctattaagtagtcattaaatttcaagcgaaattcgttctgagatgaatgaaaaatcgacgtctcagtgagattgtgccttggggggagcaatatgcagataggtgacctgagaggtgatacttctgagcccgctcctgcaaacacttcgcctctgtcaacgacactctcctccaccaccacctctgtcagcaaacttcctacctcttcttctcttaccctagccccctccccctaattgtcaaatctgggggcttgagactagcacatgagattggcatgagcgggttgtggcggcgaaggtgacgtccagagcaacgacaatcaccgtcgatcactcaaaaacagctacatgcacttgcgaatgagatcgacggttttggggctagatctgtgccaaattatgtcggttgtagcttaagggtgcaatggatagttgtggtggtgtgtaagggagcttggtgattgataaagggcacacaactatgtgttggatatggttggcacaatgcccatttcagatgatttggctccctcgtgtgaaaggacgatgggtggggcttgtcctccacctctaggatgttttccaccccaaccaacaccatcctccccgtcgccaccatctttagtggctacctcttccatatgcctcctctcatatccgcttttagctcccaaatatatttgtctcccaggcgatgtctccatgtaccctcttatctgcccctacccctctcctctttgtttttctcttacgatcacagaaccatgcttgatgcacctctcgctgccattgaacccccagcaacacattccgtttcgctctttcctttcatccattttacatcgatgttgtgccgatgctagcatgcctccatcgttcttagccttgcttcaaccaccttggccccgtcctattgtctaggagtatgcctagttcgtgtagccgtgttccctcttttggattcactcaatttgatatgcttcttgttcaatagcttggttatccatgtcttatgaaaaaggataggcgaaagttataatatttctctttattcgaatattttatcatagattaattcagccgagcattgacccagtcacccaacgcttaaatccgcccccccttaggctaaacggtaactactaaactggcctggaatgaccagacacgtcccgagattagttgagttgtgccaggctggccgaaggcacgataagcccaccgtgctcctccttgtaataagtctattttgcctcaattatctctttgggccatgtcttatatggctggaaataagtttattttgcgtccctcatctctttggccgtgtcttatatggttaaaataagtctaccttgcgtctgtcatctattttgcctctatgaatgttggagcggcccatgccgagccaacacatcgtgcgaaggaagagacccagacacagtcgggctgagcctgcatggacccgacaacagccagggcatgccgtgtttgggctgggccaaatctccgtgccgtggaccgggtcgttgggtttggccatctatacaccggcccaggggccagggctagacgatgttcgccatagcaaggccatttccagatctccaccccaaccaactagcggcgacaaaggtacctaccatcaccactctcgttgccggcgtgccgcgcatggagcagggcggagattctataaaccccgtgaatcgcaggaagcccggaacactggcgaagtccagggatttcccaactttcatcaagactcaatagtcctgaaactgttttcaggcaagaagaatcaacattttggattcacgtatttcatacaggaatgctgcatacatcacacgacaaaaatttactgctgtttgacataaggcgggagtgctcccctcaggaaggagctgacaacgatgagtgctttctcaggctggaagtaaggacctgatggccagctccccttacgcagatgaacactagcccacccgtgtattgctgaacataccctccaacctgacgcgaaaaggacatatttttctttcagtcagaacagaacaggggagattataatttctgaatttgtgctcatgttcgtattacctctctgtttgctgtccatgggcgccatggttcagtgacggcgaggccgaggtcaccgacggagtacctcgtggctgtgagcgggcacacggagtcgaggtcgccgctggaaaaaaggttgagtacttgtcacaactcccaagcttgcattttggtatatatgagaaattttgtggtttttgagaaagtaccctgaggtaattagactttgcactaaaaattcggtatctggaggtatctagtatttagagttactaaattttataatagaaaatatagtatctcttgttatctttttaaggatggtaaaattaccttagaaatatagtactagttacagttcgatttgaatatttgccacaagcttgcattttggcagatatgtacttcctccgtttcatattataagactttctaacattgttcacattcatatatatgttaatgaatctaaatatatgtgtgtgtctagattcattaacatctatatgaatatgaacaatgctagaaagtcttataacctgaaatggagggagtattagttagtctggtttgagtatttgttagttgtcagttgtcacaagcttgcatttcggcagaaatgtagtggttacagtttgatctgagacatgaagcaatcttacctatacaaccacactggcaatccgtgttccatcaaccatttgagcgttggcaccatggacactggtgcatctttccagtgcaagtttctaagctcagttcaagaagaaattgttaaagtggatgcatactgttagctcattagtactctgctcagagatctcacttgcagcctaaccacgttgtcactctagcatggagagccttctgtaccacgggattgttaaggtaagcgtggatgtagtagttgctgcatggatcatagcctggcacctgcacaatttagaaacagaaacaattttcagaacacacacaaaagactcgagcaaatagtactccatggaggaggtgaccctttgtatctcttacaatgcggctggggaagaattttccgtcgggtgcgttgatgcaaaccggtccgtatatgtcgtagggatcggtgttaccagaatcaaatgcgtccatagcatcagagcatgctttaccgtctgacggactgaacctgcagttcttggtgatgttggccagcacctcatctgatatcaccccatgactccacaagtagtcaatttgccccttcaggttcttgaactcgtcaaggcaagggttgccaacctgaacaagtagaggcatacttagtgctaaactgctaaccatgacaaaatgtttgaaaaagttcagttttaacattgcaaaatgatcgaaatggaaaggaggacgacgcctgggttcaagatctggctttggaatcccactctcctattacagtacacctcgtcgaacaactagtcgccctatggaaagcggtccggaatattcacttagacactggagaaccggaccagattacctggaaattcacaagcagtggacgctacacggcctcctcggcctaccatgcgcaatgccaaggaacgccgagcacaagcttcaactccttaatctggaaagtctgggcaccggggaaatgtaaatttcatgcttggctcatcatccaaaatagagtctggacttcagatcgacttgcgaccaggggttggcaaaacaacggatgttgtcctctgtgccgctgtgaggctgagacggcgctgcacctcgttgccacttgtagatacactaaaaggatgtggggccttgttgctggatgggtgggatatcagcaaattgagccggctcaatgggaggaggcacagtcagtacaacagtggtgggagaacatcgcaaacacgccaaatgttccgaagaaaggactccgatcactcatccttctagttgtatgggaaatctggaaggagagaaatcggcgaatctttgaccacaaagaggtggcaacgagtttcctcctgtcaaaaatcaaagaagaggctagcctttgggctttagcaggggctaagcggctgcgcgagttaatcccgcactatgtatagtgtatagctacagtttctcgattttttcctgttgcccctaggggttgtattttctcccgctctattcaatgaaaaggcactctagtgctattttctgttaaaaaaaaacaatgcaaaatgtttcagtctctgaatttcacgcaccagtataccctgtaggtttatgatcattctcttgctctccatgttgtgagtcaggatggtggctgcaagctgtggagcgtagtgtccagcatagctctcgccagagatgtagaaggcacgtcctttgtactccgggaacctctcaagccaattgactaggaagatgtacgagtcattggctgttctttggtcgccgctcttgtcgtagtcagaagatgtgttggagtaagaaaatcccacaccagcaggcgattccaggaagagcacattagccactgaaaaaatttcggcaaagtgaaactagtactctgaaactaatttcctcatgcaacggcagtttaatcataatcatatatatgctgcttgcgcaaatttttgtgtgtgcacacattataagaggtctacaggcatggattctcttgaaaagaactgtaaagagcataagtgcaaaatgcttagaaaacacatactactaaaactgtgagtattttttcggtgatctttactattaatattctcctatttgtattatcattagtagaagcgatcttattatcatttgtataagcgatctaagtcattgatttatgacttctactactaagtaggtggtagtataaattgcaactgctattgctgtgtctaaccattgttccaggcgtactcatttctgctgagtgttttattgtcgctgtttatcctgaatggaccaagttctatcattgctccatagccaactgacgagcacccgggacctgaacatcaattaacacagtttcagacagaggacgagctgtatcaacagtaaagtttcaggcagtgcattgagaataatgtaactatgtatgccagtagagagacagtagactagcctccattgagccacaggaggagtggctttgccgcggcgtcagtcgtcgcctcgacgaagtagtagaagagagcacggccgttcatctcgtcgacggtcacgtacccgccgtactgattgaagccgacgcccttgggctggccaggcagcgccgtgatcttatcggcggccttcagattgctctggtcggagacagagtactcttctttgagtctactgctaactcttgctcctggctcatgtgcactgtagccattgctgccactgacagtaacagtgctgctccttctggatcgcacgaactctctgaatctggcctcttctggcgatccatttgcgtgcaatgctgccacgcaaatgatgagaacgaagctaaaggatagtgtgttgctcatcatttacgatgaaatggtttagttgctgtgtttctgccaatgtgagggagattagagtggtgctcgattgcttatattggtcagggcctcagttggtggaaggataatatgctcaaactattagtattggaaccttgaagaattcttcaggttagtgctcatttgaatactgaggtcgccggcagtatgttgtccagttcctttttgtacacaagctcgactcacctcacggtttcatattcttgtcttgtccttttgtttgccaaaacagttacccagaaagattccaattggcgtatagtgtagcatgcttaattaggattagtcataatattcagttgaaaaaaaaagataatccaataccataacaaaggaagaagatctgctacccgctctagattttactcctatactttttagaaaattattaaacattgcttacataaatcttttccaaaatatatccacatctgtgctataaacaaaatacaagttaaaataactcgtgttttctaagtttctatgtgtaacatatttcaacattctctctatgtttttattttttgccttttttctcactgcaactttcatctatactcctttaaggcctttcacagtgcatctatgtagcatttagcctcaaccatccagtagaagattttcctctgagttttactcccgtctgacagcctgaaccggccggtactagtaccgggaggtacaagattaaatctggccgtccatcttgaaaggatacgattgggaaacagaaaagagaagcggaacgattccggagtcacaccgccgcttttctccctcgctgtgctctttctttcctccctctccgcatcggttctttctcatctattcctccatccgagcgcagaaacggagcagttgcgccgcatccatgccccaccggacgattttttcccatccatctgccgtctacgatcgcggtactggaaaaaatggcacgctcgccccgcatccacgcctccgccggtgctgattttttccccatccatctgctgtccgcggcagcgaagccaacgacgcgctccgtcaccagcaacgccgccgcattcacgagcgaagatgtggtggtattctgtgtcccctatccctccctcaacggctcaagcaagtacctaacctcctccgctgccatcggcgcagcctaggcccccattacggctcaaacactactccaccatatggtctagttattttgtaacgaacaattcaatctaccatgtttttttaatgaatttgtgagaaaagcacaagcttttgctggaaactttaatctttgaattgaaaattttaagctcatctgtcgtctgtttttttatgctgtttacagggcatgatctatcgttgaatggagcttttgacttaatttttgtctgctgtgaacagagcatgatatatatgtcgtattgagagccattaatattttgtctgctgtttttgctcgatctcctgtaaaatacatgtcattctgtggagtgatcaacagcacaacaatggttacaaacaagtgttttcaatgaacagcaatccatctagagatgtaaaagttgaggaatcactggagtatagtgctagacacatgggcaataattactgagaaaaagtataatttacatgattctgaaagactaaaacaaacatactcgtactagtgagtaattcagagtttcagacagcgggagatagataaacagaattctgcaaattttcagccaaacagaacgaactataacttagcaagaatctaaaactaaaggataagttagacaacccatctgaagaagctgtaatttaaagtttcagacagtgggagatagataaacagaattcacatggattggttgctgagacatcaacatgctgagtgatctccatccattaattctagtaattgacatgtacaaaatcaacaatgacaagcatagtacatatta

SEQ ID NO: 59756 - DNA, 14482 bp, Oryza sativa
ggcgttttgctagtatttataaacttgatagctatataaccaacttcagcttgaacatcagaaggataaatctcaactcccaacaacttgcgcatcttgtatttcatctttgtcctattattcaagcaacacacttgccatcttttgcctgggctgccttctcatgaatatagtaacaatctcaagatttagcatttgagcttgcaaatattttaattatgaaaaggttgcctttagagtttaaatcaatctaagtaagaggtaaatatgcaccaattagttcaaagattcttatcctgcacaagccagaaaatgtaattctctttattcagtctcccactttgatggaaacagccccattacaccttttcaggacatatctgtaagcacaagacttaacgtgagtaggcaaccaaatttcaccaaatggaagtagaaagctgactgatcattcgatcagaaattcagagaacactgaaaatgcgaatactcaaattacttcgggatatcagcaggtgggagcatgcccttcaggaaagagtagaggagaacaagtgatctcttaggctggaaagatggaaccagatgtccagctcccctcactgatgctagcgtgaatcctccttcgtactgctgaacatagcctccaacctgcaaacacccccatttcataccaaaaatcacagatcatgtctcagttcagactaatcacactattaagcttaatttgcttctgcttgtccattacctcattatcaggtgtgtaccaaggacgccacttatgcgtgatagtcagattaaggtccttgacggagtaccttgtcgcagtaagtgagcatattgaatccatatcaccactgaaaaatatatagagggaaaccttattagcaaccattaagccaactattatgcaattctcaatgtgcttggaatagcatattgtacctataaatccatacacttaatccattttccaccagccttttgatggttcgcaccatggaatcaggggaatcgttccaggccaagtctagactgaaagaagaatagagcgtaagagaggattgtatggatctcagagaccttgaagggtaaaataaatggggtcatccaccattgaatcatgattaaagattagtgcaaatcattgtagcagagcttatggcacctctcagtatgagagtatcatgtggtgaattgggtgaaaatttcagaggatctgaacattaagtaggaatacttacttgcaacttagtcaaaaaaaaaatacttacttgcaacctgaccagttcgtgtcagctcgtgcgtgcaatgctttttgcacatcgggattgttgaggtaacgagggatgtagtagtcgatgcacggatcatagccaggtaactgaatcaaaaccaagatgcaattcagttttgatgaacacagcatggcagcattacattatttatctgttcaattctcatggggaaaagctgatcctgcaaaaaagttatgatcttacatagccgctggatcgaaaggttccatcttgctcgtggaggcagaccggagcgtagatgttgtagcgatctatgttcactctctggaacgagtgcgccgccacgaagcacggccagtcgtcggaggaggtgaaggtgcagttggcgaggatcttgccccagacctcgtcggagatcacgccgtggctccacaggaactccaggttaccctccccgttcttgtactcatcaagcagcggattgccaacctagaagaagagatccacatggccaagtccagggttatacttactatttcgtcaatttcagaaaatttaaatatttttttactgaattcaaataaattttgacaattcacaaagaaatgaaaagatccgaaaattcgtgccaatatagttacatgtagggagaggggtccaaaatttaggaaatttcagaccctggttaagtcgttgatttgttctaggcttaattggattcatgccattacaaattttcatgattaaaaatctaacgccactatttgtgattaaaaaaattgtgataccagttgagtgtcactaaaattttgtaaaattcaatccatgccattgttgtcgagttttttagcacctgaccaagccaccatcttccattgttgttgccatcatggaccacaactagacagccttctccacctcgtttggcgcccttgctggcttgctgccatccacagagtagaaagggaaaaaaaatagcgatgatgactcggtgagggtggggcttggctaggtggtggtgaggtcaggactgatatatccagcttcgatgacatgtggatgaacggatatggtgtccacgagatgtgcatgagcagccagacagctacccaccatcaatggcgacgatgagcgagatccggtgtcaacgatgaccggagcgagccgccggcttcgaaacatcgaggacatgtgggatgagttgccaccaccaccaccaccagacgagcattgaggacgcgtggtagcagcggatggagtgagcagaagcggtggggagacaagcgaggccgccgctcacacatcttgtcgattgccctatgcacgccgctgctcgcatgccttgtcggtcgcctcgtataagagaggaagagggagagaggaggtggaggaggcaagaaaaggagaaggtgatggagaactcaatggtaaaggcacaccgttcaaattttacaaaacttcaattgcactcaactagtatcgcgaatagtaattgtaaattttcaatcaagaaaatttgcaataacagagatccaaagtgtgcattggttcaatcgattgctagcataaggaggaataataactcacaaagatgccacggaggttgaagggggtattgccgtcaaagagatggttgataaacgtgacaatggtggcgatctgcgggacgtagtggccgccataactctcaccggcgatgtagaagtcacggcccttgtactccgggaaccgattaaaccagttgagcaggaaaacatatgtgtcctccgccgttatttggtcacctacgtcactgtagtcggaggagttcatcgagtaggagaacccaacacccgccggcgactcaaggaagatcacgttagccactgcatgatttcacacgccacgtcactcactgttggaactttttaaaactaagaagctatctagaatattattttctctgtttaacaatgtaagactttcaagtattgtccatatttatatagatattaacaaaatcttacaatattaaacggatggggtaccaaactaccaatagagagtaccataaaaatatttttagctttcgcttaccgttgttccaagcatgcttgttcctgcttagcgtcttgccatcggggttaacccggaaaggaccaagctccttcatcgcgccgaacccgagcgacgagcaaccaggccctataaactcgattaaaaccacttgatagtatcggtagagagcatcgtaaaaatactcattagcatatcaagcgtgtatacgtacctccgttgagccagaggatgagaggtttggtggaggcgtcgtagggggactcgacgaagtagtagaacagctcacggccgttcttcctgtccaccgtcacgtagccggcgaactgcgcgaagttgacgccgcaaggctggccgggcagcgcggcgatcctgtcgtcctccttggtgctctccggtgagctgacgctgcgcgtcgccaggtggctgaatctgccgggatcggcccattggtcgtcttctccaggcccgtttttgttgggcctgtttctgagcctcttcaaggccctggactccatgaacttgatgagctgatcctcctgggaatgggacgacgcgtctgtgactgatgcgcctagtgctaggaggatgatgattaggacggataatgtgatttggtgtctcatcttggttggattgtgaagaaattttggaaggtcctccgaggatttaacagttcatatgtgagtatatatgtgattagatggggagaagaacaaggaatcgaggcattcaacacggattctccaaaggagtttcctagtttgcatcactaccactgagagttcttgaaataatcaagttctataagctattggcttttgtgtgtttgatatggttttaacgtaagccatctgttagtattaattaagaagtttgaaatttgactgatcttgattagagaaaaaataacggttggttttgcagatccacgtgtgaggtagcattttcgttgcttcctccacataaactcgtcatcatcccgtacaccggacaacatcaactttctttgccgtcgatgccgaggttaacagccctcggctacaatccacacgatggcgccgagaccgaggtgacatctacgtgatcatattaacgatttggaaaagttttactggtgtggtagtgggtttgtgagtgcatactttttttagatgatgataacttttcctaatgtaaatgaatattacacgtatatacgtgtttttaatgagattttagtgagattagagatatgtaactggtttccgtctcttagcataattgttagggtacgcatttacaggagtgtgagcgtggtgttacgtatggtggtgtttgtgtgtgtgcgtccaccatgtaattggaaaagaaaaaaatgttgatttgctaatggaaataagtctactttgcctccttcaactcatgtgcctggttgaaaatatcgcacccctcaagtgcaaaacagggtatataacccatcccctaacttttcaaaccgttgcaaatcgattcccccgacggtttcgaaggcgttttcgtcctacgtgttacttacatggcgggtcgacttgtcttcatccaatgtggcatcgatgtggcacttacatggcactaaaataaaaacaaacctaaataaaaaaataaattttgaacccacgtgtcagttacctaactcctccctctttatcgtcgacgatgagtgagattgggagagtggcggggtggcattagcaccatgactgcgggagcggagaaacagtattggtgaggaagcctcgatgtcgcctcctctcctcccttgttcccaccgtctaccctcctgacccttacttcaaggcttataccatactaaacttctccggcctaatcaacatcttctcttcttcctacccaccaccaactcccttccacactcctccgccgtgctctgtctcgccgctgttgccttccacctgagagagagagaggggttaaagagggaggtgaaaattaaaggtagctgacacatggacctgaaatttatttttattgttttacttactgacatgtgggtcccatttaaggtctatttttattttagcgccacatggtataaagaccaagtcaacctgccatgtaagtgccacgcaggacgaaaccgcctggggagtcgatttgctacggttttaaaagttggggaatgggttatactcggttttacggttgaaggatgcgattcaaccacgggcataagtagaggaaagaaaataggcttattcctttgctaattgcctggggttcaccaaagaaaaggctgtggtatccgtgtatcacaaatcaatccagtccaacaaaattaatgggccaaaacgggaagatgtaagactcgagataagtttggcggcccaaagttagtggcgtcatgtactgtagatggtaagtttgagcgccatatgctctgtttggagcactgaatttctttggattcctgcaaaagtagaatgttcaaaaaagaagtcttatgtaatatttatggaactcatattttcaatttcatgatcctcattaattccaaacagggactaactaataaaaaaaaaaagtccatttggtctctcaagttgtaaacaatcattcacccagatattaccactagcttggtgttttattttgtctacttgagtaattttgagcaataaacagtgactaaagtgagaacttgagggccgagttggctgcttaaggggggaatatggtttcaggagattatactgtttgatacactctcttatttttaatatggtgtaaagatagaaaagactgccatactcatttcgataaatctgtcacatcaactattttttctgtctgaaataacttccaacactcttgttgcttctgagactcctccaatttaacgatctgggctgtattctcaatttgtcgtctcctggttggatcggctgatgattgttctatatatttggaagctgcatataaaagcacaaccaccaacttttgtttttggcaagaaccgtgatccctgtcatcttctgatcactggtcagtagactacgagagtaaaactcatgaagaacaacatgacaagaacagcacattctcacaagtcacaaccagtgcagctagcttgagcttaccccacagcattcttgaatttaaggaagaacactgctgctaccagttagcaataagaaatctaattaagcccatgacataaaatccgcaggaaaaaaataataagctgattgctttggtgataatttctacagtgctagtctgataaatgactgtttgagattaactcccttcagtaataatgctcatgcaaccatgcaaaactttatgcacagtagtggctcacactgtgacacatgacacacatcctccagatcgaccaccactaacgtgtaatcttattgtcgtgtcatggattccagttgctggtcactacatgatctgtgaaaaaaaaaaagggaatctagagctacatcttatcctatgtcaagcctgtctgccaagatgatcagcatattaaccacattcttcttctcctctgcttgactgcctcagctgaattacagatcacagagcatatgcccagcaataattcaagaagcatatgcagatatgctctctcacctcgtctctcaaaagcaaaggattttatttcatgaacggtagagcgccaagggcgctatcaatcagccacaattaaaggagcagaaggacatttgggccatcctttctgggtgatacccgagaaaccaaccaccacctttccggtgcagattctaacagcaagaacaacatatcagaagtaggagtaaaagaggatgcatataggaagctgctgctttcctctgatttgaaggccactttaatatgtctgttggtagatcaattatctttgcttccttacatatgggccggctaattggtttgcaagatctgctttagtaccacagatgacttggatataaaacgtgcataataatgccttaatctagtattaattatggagattataatgcctagatgattacactagtttcatttgattaggtagcttgtggcagaaagattgctagctacattaattctcgattcatattgcaggatattgtgatctggggcatcattcagatcttgatcttaaatcaagtaaaataaaatgctgtcagagattactgttcaacttataatcaacctttatatcacaaactaggaaggtagcccgcgcattcgcgcgggcatgcgtcatatgctaagtttaagatagttataaaagctaaatattaaccggagaacatctgccacgatttctccatacatttttttatcagcattaattgttttataattttttaacctattagctttatattatactagcatatttttatattcttcctcatcatttgaaaagaaggtagacttattttctttagaaaacatatcatcggaagtaaaagtaaggtgttttttaattgcatatatattatgatagtttattatgggataaattggggactaataggaagaaaatgagaagagcagggagacagagaagatagggacggtcaacaaaagaatatattggaaccgtgagggtatcattgcatgttttatttagtggagacacattttttattaagtactttgtatacttaaattatactaccaaattttagtagtatataaatatttttcgtcttttaaatttgatgagtgtagttggttatttgacacattgaaaaaatagactcaaaaaacacgtaatagacacattgaaaatacgtagagcatcgttatcattgttatcatggatctaatttagctacatatatatttctagattaatacagaatagcacatttgatatcgtatttattgaaaaaaaattcatcactgtcttgatgcatagcatatcatttctataattaaaatatagttaacataggtcttaacttattaatctaatcacacatattataaatattcaaaccagttggaaattagatgcacagttaagcagttatatttatttgaaaactagcatggtggcccgcgcagattacgcggttagcatcattatattttctcacgtataatagcatatatgttttctcattttattattaaaatatattacaatgacaacataattttaaattttgcaataactttacgaaactactaatgtgtaataactactctagtctcctcttctaatattccttattttttaattctgaatttcagctatttctaaattgtatttctatatggactctgctttttctttttcttatattaatgtgagaatttctaggccatgagagcgaacgtggaggctcttttttgttccgaattttagttagttttaaattccaatatggactctatactctacttctaatatttactattcattcattcccgaaatgctatttgttttcttaagggtgcggaggctcctttttgttccaaacttctagtggttctaaactgccctgtggactctatactctacttctaatatttcttatttttttatttccaaagctctatttgttacttaattggatggaggctcctttttgttccgaattttagttagttttaaattccaatatggactctatactctacttctaatatttcttatttttttatttccaaatttctatttttttttcttaattgtatttctatatggactctatactctacttctaatatttcttatttttaattccgaatttttgttatttcctaattgtatttctatatggactatatactcttcttctaatattccttatttttaatttcgaatttcagttatttcctaattgtatttctatatggactctagtctcctcttctaatattccttatttcttaattccgaatttcagctatttctaaattgtatttctatatggactttgctttttctttttctccgattaatatgagaatttctaggtcatgagagtgaacatggagactccttttttttccgaattttagttagttttaaattcctatatggactttatactctacttctaatattcctttttttaattccgaatttctgtttttttcttaattagtatctctatatggactatatactctaattctaatattccttatttttaattccgaatttctagttatttcctaattagtatttctatataagaatctagtactctacttctaatattccttatttttaattctgaatttcagttatttcctaattagtatttctatatgagactctatactctacttctaatattctttatttttaattccgaatttcagttatttctaaattgtatttctatatggactctagtctcttcttctaatattccttattttttaatttcgaatttcagctatttctaaattgtatttctatatggactctgcttttctttttctccgattaatgtgagaatttctaggctatgagagcatgcgcggctagcatcattatattttctctcatataatagcatatatgttttctcattatattattaaaatatattacaatgacaacataattttaaattttgcaataacttttcaaaactactaatgtgtaataactactctagtcttctcttctaatattacttattttttaattatgaatttcagctatttctaaattgtatttctatatgtactatgctttttctttttctctgattaatgtgagaatttctaggccatgagagcgaatgtggaggctccttttattccgaattttagttggttttaaattccaatatgaactctatactctacttctaatattccttattttttaattccaaattttagctatttctaaattgtatttctatatggactctagtctcctcttttaatattccttattttttaattccgaatttcagctatttctaaattgtatttctatatggactctgccttttctttttctccgattaatgtgagaatttctaggtcatgagagcgaacatggaggctcctttttttttccgaattttagttagttttaaattcctatatgaactctatactctacttctaatatttcttatttttcaattccaaatttctactttttttcttaattgtatttctatatggactctatactctacttctaatattccttatttttaattcagaatttttattatttcctaattgtatttctatatggactctatactctacttctaatattccttatttttaattccgaatttctattatttcctaattgtatttctatatggactctatactcctcttctaatattccttattttttaattccgaatttcaactatttataaagtgtatttctatatagactctagtctcctcttctaatatttccttattttttaattccgaatttcagctatttctaaattgtatttctatatggactattttttttctttttctccgattaatgtgagaatttctaggccatgagagcgaacgtggaggctcctttttctattcctttaattacataatagattatatttctatatggactctgccttttctttttctccaattaatgtgagaatttctaggtcatgagagcgaacgtggaggctccttttttcggaatttttgttagttttaaattcctatatggactctatactctacttctaatatttcttattttttaattccgaatttctatttttttcttaattgtatttctatatgaactctatactctacttctaatattccttatttttaattcagaatttctattatttcctaattgtatttctatatggactctgtactctacttctaatatttcttatttttaattccgaatttctattatttcctaattgtatttctatatggactctatactcctcttctaatattccttattttttaattccgaatttcaactatttctaaagtgtatttctatatagactctagtctcctcttctaatattccttattttttaattccgaatttcagctatttctaaattgtatttctatatggactctgttttttctttttgtctgattaatgtgagaatttctaaaccatgagagcgaacgtggaggctcttttttctattcctttaattatataatagattacttttaagtagttaaccacggtatactcttgtactatgtacgtacactatattttttaactaacttatatacgtacacttagagagagaaaaaaaagggttcgttatttctggatcgctccaaggccgaccataggcatgttattttacaaatctaatttaactatctgacatgcatagtggatccatcagctttagttgaaatcgacggacggatctttatctttttttttcttttctggtaacttgggagttataatctatctaattaatattttttgtttatatattaagtgttagctagaaaaatatgaaaggtcagttagaaaataggagaggagaagagatacggagggtggagggagtatggattatgtacatgcgcaaatacggtgcggggtgttgtacaccggatttttttaatacagatctaatggttaaaattgatgggtccacctatttaaaggaaaataatgattaaatgtatttcttttctatcataatttttaagattttctctactatattagagtgtcatgtgacagtttaggagcgtttgtagagcaccacgtggcggtttaggagcgtttgtagaggatttctctaatttatttaagatccacgtagcggtttaaaagcatttgtagaaagtttaatgtacttttaatatatagcagatagatttagaatatggtttaaagaacattgattgaatatttatatagatctttatttaactaaatatatttatatttgtgaagtaatatattttatctaaaatcatattttaaaaactgttatttttatggaattatgttttttctattttttttcatgtgtactttttttttggttccagcaagattaggaaagatcatgtacattaagtttattaagtttatacgtatggaaagatcagcagtagtatcgtacaaatacaaacgtaccgatcatgaggaggttattattttttaataatagatctaatctaatggtgtaaactaacgggaccaccaatttaagtgaaaatcaacggtgagattagataatgccatgtggcgacttgggagcgtttgtagagcaccacgtggcggtttaggagcgtttgtcgaagtttcatggactcttagtatataatagattttgatgcgatgtatgatcctaagatcatgatcctgttaattattaacatgaatacaattaacaatagagtctcgctccggtgccttctacttggagtagaaattaatccgagccgttgatcgtatttaatcatagggttgagatctagttcttatgcgtgctttccttagaagaaaacaataagcagacttctagtagaagtatacttcagcatgttcaatacatcggctgtgttagagtttctattgaatatatgtacaaaattgtttacaatttagttggaagtatcgttactgtcttcgaatggaagtcatgcatcagcactaacttatggctaagtggaacgagcggactttgagttgtactaagttttataatagagtaagagtcggactctattctctctttaatagaggggtagatctgttgtaaccgtataacgacttagtataggctagaggtagcggctgtcggcgatgtccagtcgaaggtcgttgtaactccgatatactgtaatatgttggatcatggagaagcacatgtaataagtactccggagatataggctttggttgaacttcgttaacaaatatcgtgtctcacatgtcatgtattattgtgtttggatctcctataacatttcttccgcatttggtttcggatagtgattttgggccggttttctaacaactggtattgaagcctatgtttggtacccggaacaatttctatagatcacaagtcttcggggtcacatgggttgatgtaaggagaagattgttggattcaatgcgtgacggaagagactattggatttagtcccatattggaggtgctcattcatgtaggatgtgtgttggatttagtcccacattagaggtgcccattgatgtcggatgtgtgtgcgcgtttaaagtagtgactgagacagagtacgcacgacaccaaccggacaacaacaactggccaagtgtatggtataaccatataggaagtggaggaagggatagagtttttaaaggagaggctatacatgtatttggtggagcaaggagattatttgatatccaatggctacaaatttaggtgattctttttccaacaaatctcacactatgagataactatgcactcgaaaattgtaaatcgcattggttgtaacttgtaagaacaacactatttcgtcgacgtgtcatgtttgttgtccgtacgtggccctaacttaaccttgcattattggcacgagatttgtaggagaggtacgtatgaattggaaaggtgaccctggtcacatgtgtgaacagctccggttgtacaacaaatgcacaacttgtcgcgttgcacttctcataacagagtaccactatttatgctcttgttggctcgattaaacagcagttaatatgcatgtttttctttgcgttgtttcgacagtacacgcacatttaatcttacgtgatcatactgtacatagaacagagaaatgatggtcggaacttggaagttggaagttagcagtaaattgaggcggcaatgcatagtgcactggacgccagtagtttcgagtggaagtacaagtgcggttcactcgctgacagagtgactgacataatcacagcatcatcattgtggcatgcaaaacaaagcacaaaaaacacttgtctcgcaaagcaaaagctgatcaagagaaacttctatcgacacaaagttaaggccgcctcgcatgcatgctggaaatctgatcatctctgccatggttcgttgatcactttgccaaagagctttgcgtggtaattaatctgaacggaatgccactttgttctccccccttccactttcgccatgtgacgagagatacacaca

SEQ ID NO: 59757 - DNA, 8033 bp, Oryza sativa
cccccccccccccccccccaaaaacgcgctcgcgcttccctgccgtccaaggacgccacacacggcgcggagctcgcggcgagacctttaatggcggcggtgtctcctcgcggtgcgtagggccgcccgcccgcccgccgcagccgccgagcattttaagtatcctgtctctgtctcctcgcttgctgtcttgctgattgatatgcatacggcgccggagatgaatggccgggctcggaggccggcggcggcggcgcacggcgccaaggcggcctccacgaagagcgacagagtatgcttctcaatctggcaaaaacctctctcgtttctccgtgtgctctgttctcccttcttttatggccaatgtgcggttattttcggttcccgcgatggattattgaggcgtcctcggtcgccggcgctcgcgggatcggaaggcggcgcctttgccgcctacttgaggccagctgttcgaactcggtgcttgatagttttttttttctttttaactctcgtttttggttcccaaggtgtgaaattctgtgcgcctattttgttgttttgcattggtggcgtaatgtggttgttagtgatttgttgcaccgtcgatgtgtttcctgtagtacgacggattattaaatgttgttgggaagaatacaaggacgaacagtgctgttttgatgttcttgcgagctacgttttggttggtggtgtagcgtgagaagatctcgccactgactcgcgggcgtcagttagctttcgagagctactccgatagggtatctcttgattgctcttgagcccgcatttcttccccttctttaaatcagccgctttatctctttatctttcggagaagaggaatctgttgctttgctttgcttcggttagcttctttcacagctaaacaacgccttctttttcctcttttgatgatgatactgttgttttacgtgttcagatgatggagaaggatcagaggaagggcgccatgccggtgaagaagggatcatcggccaacgcggtcaccaaaggcatcacgaacagaatccaagcgaggagagagcggaagctcgcactgcagcaagatgtactacctgaattctgtcccaaattctcgcaatttgagaagcgcattggttcgtccgagttgtgttttgtgacgcaattcgctgcctggattttacaggtggacaagctgaagaagaagctgaggcacgaggagaacgtccaccgagccctcgagagggcgttcacgaggccgctcggcgctctgcctcgcctgccgccgtatctgccatctcaagtcagtgccacatttgcattcgcatttgcatcaaacgaaacgcattgttcttgctctgcttgggacaattcggctctgaattctgaacatgttcctgctctgaattctgcgatgtgcgaagacactggcgcttctcgcggaggtggcggtgctggaagaagaggtcgtcaggctcgaggagcaggtggtcaatttccggcaaggactctaccaggaggccataatcttctcctcggccaagaacacgagcctccccggcggcgagggatgcgtgccggcgcagctcatgccgtcgagcccggtgccgaactcagaggtctctccggcaaattgtcattctcctcctactcgaccttcaatgaacggggtcgccggtgcaaagcaaacgccgagaaagccttctccttcggcggcggtggcgcaagacgaccgctccggcgccgggaaagagaaccagtcgtgcagtaacacaccggctagaaattgtcgccattcgccgctgctgcagaaggcatcaaaatccagactgccgacagcagcagcgcctgagaaacgcagggctactgctcaggtaaaaacagtagtaataagatccttattgctgctgaatggtatttatttacacatttttctaccatgaactaacttcttctgaaccgtactgctgctgcatttttttttatcacacagacgattagcacagtgccggaccgtaaaaggctcgcagacactgtcagcaataattcagaaaaagcttcccaagatgactcgagcgtgccgaacagattgtcggaggaactgttgagatgcctgctcgccatcttctcgcagatgggcggttcatcagcaagcggccaagacgaggagcaggcggcattgtctccttcggtttcaggttcttgcgagagctcagaggacgcataccctcaagatccttatggcatactggaattcggcacaagagacgttgggtcatacaagcgattccatgtaatcgacgccacctcgttcgatcagacggccatggagaacgacaccatgcttacccggaaactcaagtgcgttcttgctagtgcaattttccgttcagttattacaagctcggtttggttgtctgtcgagtaggtggccgcctgacataattagcatcgctgatagaggtggttcatgtctacctggcaaaatctgcagggctttgatccggaggctttcatcggttgacctgacggggctctcccatcagcagaagctggcattctggatcaacatctacaattcgtgcatgatgaatgtaagctgtcagcctgtcactcataattgagcccacccatcctgaatttcttcatcttgatcaattatatctttgttcattttctcgttagagggaaatttccatttcggtgatagttacctccttcgttatcaatgtttgcctccgatagaatgacagaagaactactgtatgctggaatatttcgggaggttaattacttactaccgcattgcatattactagtactatatggtacagccagtacaacattacagcatgggcgtggttctgacgagtacgttctttaaccatgaactctgaacatagtgctggcatgtctgtgtactgttctcttcagtcatttagttttgcttaaagaaatgcttcctgtccccatgaccataaacaaaggctttaactaacactgatcaccatcatcatcgctttggcattattatccttaggcctaactatctcatgccatctgcgatacggcctaggaaagggtagttaaggtaggtagatgtagtagtgtagtgtcatgcctagtgcctcatacttgtccctaacacttgtcttccttgtcgtactgcaggcatttctcgagcaagggatacctaccacccctcatatgctcgtggcaatgatgccgaaggtatagcactaagtaacttcttgcaagcagcacaaatcatgatgcgccggtgattaacgaagtaatcaagtctctgacgagagagtgatctccgtgtttcgctctctgttttcaggcgacaataaatgtgggtgggcgcacgcacagcgccatgtcgatcgagcatttcatcctgcggctgccctacagcgtgaagcatgtaaggcgttacagtatagttttgtcatggtggatacggccatcgtagtgatccgggtagattggtgttccggttgcacagcaccacacgctaaaactaacaacctatatatggctcgtgaatgaacaggtgaatcctggtggagtgaccaagggcgccgccgacgacgtgacgatgcgaggcgtgttcgggctggagtggcctgagcccctggtcaccttcgcgctctcctgcggcagctggtcctcccctgctgtaagatctccatgattccgtcagatttttgcagcattacagcatgtaaaaattccgtgtagtttgtgatgaggtgttgtgtgattgtgtcttgttcttggtcatgttttttttttcaggtgagggtgtacacggcgcggggagtggaggaggagctggaggcggcgaagagggactacctgcagtcggcggtggtggtgtcggcgccggcgaaggtggcgatcccgaagctgctgcactggtacctcctcgacttcgccaaggacgtggactccctcatggactgggtgtgcctccagctgccgagcgagctgcggcagaaggcgatgaggatcgtggaggacggcagaaggggtgtcgccgccgagtcgcgccgcgtgcaggtcctgccgtacgaattcagattcaggtacctgctggcctcatgaagagaggccagtgagtagcagcaatcagcgagtgaattcgagggtgttttactgcaccttgtacacaggcttccaataattgtgagttttgttcttcggtgatgtgaatgaatgaaaggaagtataaaaggtgtttccaccagaccacgactactccagtcgagatcgagtaccggtcgcttcttctttcccttccttttcgtgcttggaagagatggtactccagtactactactcagcttctgtacacaggcctgtcagacttgttgctaaaaaagcgaaaggcgccatggcatgctgtcctgtcagcagtcacagtgattaacctgaccctgcagcttttccctgctgcgtgtttcagccctgatgattgggaccaacggtagaatctacagtacgaccgagacaagctacaggatcaccgtggtcgttgaaaatactgtacgtgtcactagcttaccgccaccgacgggataatcacacggtttcaccgccattaaacgacagggagggaagctagctggcgttggagtaaactcaggccgtgtttagttcaccccaactaccccaaacttcaaactttccatcacatcatatcacatctaaaatttttctacacacataaacttccaacttgttttttaaaattcctaattttctccaaactttcaactttttccaagaataaacacaccctcaggtaagatccctggggaccctacacagcctcgtgtcgtatgagtagtagtacgacctgtgccgtaggtttatatactcctaaaaacggacagggtggctggcgtccttgaaggacaggcagggtgtgtcacgaagctgctgcatctcatggcctccgtgcccactcgctgctcacctcccaatttcccaaacgatccacccatcgttgaatccactgcacggcacgggacaaaacaccggtacgtgccgtgcgagtgtcgcgtcgcgtcatatatcgcagcttctgttggagtaaagcgcggtgccttgtactgtcgcgtcggagcagccacggttgtttggcgtacgtacccgcggtggtgtctcgtctgtacatatggccctccgagagtccgaggcgccgcgtggcgcggggattttgccacgcttgggattgctctcatggcgggtgcacctgctgttctgccactgtcatatcagtagtccccgagggccgggctagactgatcagcggcgtgcagcgccgctcttttctctttgggaggagggaaagggggccgcggggcgggtttatgggatcgtgtgaatcctgtagtgattgaatcatggaaggacggatcgatggggtctccttcgaagagctgaggagggagcaatgcaatcagatgagattgcgtggctttttgtagagggtaagtgctacttgctggagtaggtaaaaaaagaggatttgaagggacacacgaccccgagtgtgttggggattaagcgcctattaagatttagttaaaataaacattaccaagttttggtaatactaaaattttgacaagatttttttatgtattggccaaatttggtaacaaactaaacgttgatatttttttacaacatttaaaaaaaatggtatggttcaaaattgcatcaaagtgaacaggccctaaatatagaatcttgtgttgaactacacatcccttgttactgtcctatcgagtatatcttaagtgctactgttaggtgctagcacctcaatcaaaggaaaaaaaaagatcaaagatagccagatagtatcctaaaattttaacatgaaatgctgatggctgctatgtgttttttcatgtgaaggacgaacacgcacctccattatcgacagacgcctctaacatacatactcttagagtaataactttaataatatagccaactattagctccaaaaattaaaacatcaactataatcaacctaatagcctaatcacacattaattagttgtaaatacatattatataattaataccttgccaacggtggatacccgtagaccggatatagacactacaagagatcttatgataggtgacgctttatttatgtcacaaacattgaattttacgtcatgttatgtaatctgtgacgctcacgtgacgaaaattcattcgtcatctatcatgtgtctctaatggcgttctatgacgaaacctttttttttcattaatctagtgacgatccttctgtcgtcataaagttatgacgtccattttcgtcaccatcaagcccaaaaatcgtcataaaatttcatatggactgttaaggcccatgtagtgagcaacatgtttttgggctaggccttgttaaagcccatgtagtgagaaacctattaatgggctaggcctactgtaagtccaattagattttaataaattcagcccaattcatctatattgaattaaatattaaacgggccatacattttcaaaaggcccaataggcccaagcattgcacatagtatacatatggctcatgcacactggagaagcctttatatcaagcaaatttagcccagttaagattcaatataaaatccaattagcatttgatagcccaattaacatcatttagcccacaagcaccagttcacattttagcatgtcctaatatagtcacaatctcatacacaatctcatattcacggaactcgatgataccaatgagaccgtagtcgagctggttcgactagatcacccggcgacttggctcctgtaagctccaacttcgtaggctgtggtggttgtgttggcggtgagattcgatgccttgggtcctcccgggggatcccttttataccgcgggtcagtcgatctctaagtagaattcggagatattggaccccacatgatatggtaacgacccagttccgtccgagtaggactctttccatctgtgaactccgtttatgttacgtgatagatttccttaacatatacaagaaacacccgtatacgcgtgggtataccatatcagtatatatcttatatccaaggatagagggtatgccttatccgtaaccctgacatacctaatccactcatctatctcagatataacttattggagcccgtggtatagtcggctacaactctgtagcctgtagaaattgctatagagtccattgccaactccgtatacatactatgtctatgtgcccgtggtttagattatactaccagttgaaataatttgaaccgttcgttattaagggtaaatcaataatttactaataatacaatgattaagagtaactttgttatttatgttttttttctagctaaatgaaaaaagtttagtcattgaccctacctcacctacttttttcagacaataatgcccctttctatttctactactgttaactaaggtgttagtataaataaatctaaacccttcgattaaataagattaatgggttagattgctttcttctattaatataaagcaacgtagtggggctctatactagcaatggagtagagcacgtacagtacgatctattaattgtagtactacattccaaggctatccacgttaggacaggtttagatggagatcaggcaaaagagtagagggtcttaagggagtatcatgcactcgcacggtttgtacaggcctaggtagcaacagtgctacacttgaccttcgtgtgttagatttgagcctgtcgcaagcagacaggctcgctcacgccgtcacgcgggaccaagcgtggttgatagcaccggggtggcctgctcaccgtgctcgcttcggcccaaaacttgacgccttacgcggttaccttgattgctccagtttggaataagttcacttgaggtcccttaacttgtcaacgaatctgattttcgtccttcaaccggaaaaccagatacaatagatccctca

SEQ ID NO: 59758 - DNA, 45894 bp, Oryza sativa
  unsure (1)..(45894): unsure at all n locations
ccgcgacgacctcctccgcctcgtcgagccgctctcccgggaccagctcgccgacatcgccgccaccgccgcgctcgcctcgggggtggccctcgacgccgtgcgcgccgccgccgaccgggacccggccctccgcaagctcttcgtgcgggggctcggctgggagaccaactccgactcgctccgggccatcttctccgccttcggcgacctcgaggaggccgtcgtcatcaccgacaagtccaccggccgctccaagggctacgggttcgtcacgttccgccacgccgactccgccgtcctcgccctcaaggagccctcgaagaagatcgacggccgcatgaccgtcacgcagctcgccgccgccggcgcggccgggggggcgtcgggcggggccgccggcgccggtggcgcccccgcggccgacgtctccctccgcaagatcttcgtcgggaacgtccccgccgacatgccgtcggagcgcctccttgcgcatttcgcagcctatggtgagattgaggaggggcctctagggttcgacaagcagacgggcaagttccggggctttgccctctttgtgtacaagacacccgagggtgcgcaggcctcgttagtggactcggtgaaggtgattgacgggcaccagcttgtctgcaagctagcgatcgaagggaaaaaggggaagcaatcgcagcagcagcagcagcaatctggacctggtggggctcagccgccccaaatgctccaaggcgggccgccggacatgccgggttcagggcttgggcttggtggaccacaaatgggtgcgcagtatggtggccctgggagtctgtcttcgtatggtgcatttgggggtgtaggcgctgggctaggtggtcccaatccgtatgcgaatttgccatcttccatgggcggcggcggagctgggttgggttcattgggcaatcagatgccttctgggatgggtggtgctggggctggtgcgtacgggcctgggggattgggtggtggttcatttgggggctcatcccagtttggtgctggtgggatgggggcttatgggggtctaggcatgggtggagcctcatcactgtaccgcatgcaacagggttcgggtgggcttccttctggcgggtatggtgagggtaactaccctcttccagggcctggtttccggggtcaggagggtggaatgtcacctggaccaggtggtagagctcctatgtaccccaatgtgcctccttatttctgaggtaattttttgcaacccttccgtgtcttgaattttgtacctgattcccttaggctttttacacccaaatgcttgataattgtcttgttatgtggttatgcctgaacattaacttaatttgtgtttgaattgtgattgctgcatgctgtgtttgcatttatgtgaatgtgtatgtgactgaaatagtgatatgtaagaaactctcactggttacacactgacagtctgtagagatatggggcaatagagtagtgcagaatttataggatgctacttctgacaatataggtttagtatgttaatgtgctctagttgctgattacttcgttctgtatatttttatgctgagaaatctctttgggtgttccttgttttggtagcatcaaggttcagtataatacattcatagtaatattacacactcttgattggtaaaatgttgctcttgtttgttgttgcaatagttgatttcagtgcctgtgttgcttttatttgttcatgtgttttttgtagtgttggactctaatttgcatccaaagtggactgtcttgtaatattcaaggtatttgatttcttataatgctatatcatgcgtacctgtgtggtaatttgcttggtcggacaatgttgcattatatacttgaccacatttctttgaaaggttaaagtgaaggcaactgtctgaaatttgaggttgatctgctatttgagtatatataataaagtatgatccttttggcttaaaactgttaatcctgcctgtttgcagtacatcatatgattgttcgttcttgggtactctggcctgtggatattttttgtaggttactcctgaatatgttttcgcaatacaagcacatttaaaaatccatttgcctggtttgctgtttgacgatattctacctgtttcattttttgccttttttgcttcataattggcatgcagcttattgttttactcaaaacatttgcaattttgaagttgccatatttttatacaagataataagactaatcaatattctctatcatgaatcctttttttttgttatttctttgttatttctttttttttttgttatcaatatttatgcatctttacttcacttgatatttcttctcaagtttcaaagttgtgcttgatggcattcccctttaggattaggcttgtgatatttgagcttgatgtattaagcaatactatatcttttattttactttaaagttatattatcttaattttgtttgtatatttgtgaattggtgaactattgattgaattccagtgaatgtgtgaatcaggtgtgtgacaactcttgggagcatatgctttgaatggttgtgctgaattcagaagttgtctgcttacatggatgtcttgcatattctggctgcctctgatatggaaatcagttttttgctctcaatttttctgttacaagataattcaagctagcttagtgttttctgagatctcttcattagacatgtactttctcataaatatgtgaggtgtcgtttcacattgttgtgtaatgctcattgtcttatgatatccagttacttatgattacatctggtgcttggtttatttgcgtgacatgttatttggtggcaacttgattggcgaaccatttgttatcaatatgtgtctgatgttttgtaatagctatatataacagcagttttactgaatgacttcaggattttttttttatggttaccatctgcagatacgtgcagatttattagaaaacctcctgtattttgatatgactatctgctgagttggatctttagtaagaaagaatccatgttgtacttacccacttccatccccaactcttgtacctagcatttgtagtttcatcgagccatccttgttgctagatacttcattttgcttggagtgagaatttcctctatggtcagacgctatatggttctgttgtgctcttgtgatttggttttcaacatttcttgtgtatgtacatctacatcattacacgttttgcttctagtgattctttcttagatagttagactgtactacgttcttttgttgtgctcctgcatcattacacattttgcttcgactgataatttctcattttgtcagactgtactatatatgcttgtactgtgctcttgtgagttagttttcaacatatgttgtgtactcctacataattatacattgcatgcgtttgttaggagtattttcaagtgtacaatcacatgacttgttgctgttacgtgagagtttgaacattttctgccattgagctgaggggcatctttcttaggtccttttcttggagtgtagcagcttgctcccctttttttgggggtcaaatttgtgcttttgcattcactgaaattattttggcttgcactactgcctttgctattcgcaattgcaacttctgtatgcaattcaatcaccatgattttgtttagattcaaaaatttttctttaaacttccaacttttctatcatatcaaatgtttgggcacatgcatagagcattaaatgtggacgaaaaaaaaaacaattgcacagttttatgtaaatcgcgagacgaatcttttgagcctaattacgccatgatttgacaatgtgatgctacagtaaacatttgctaatgacggattaattaggcttaataaattcgtctcgcagtttacaggcggaatctgtaatttgttttgttattagtttacgtttgatacttcaaatgtgtgttcgtatacttaaaaaaaattggcacgcgaactaaataatactcatcgtatgagaatgctgctccatgtattcattgattcttgaattttgattctgtgataattaaataattgtaatgtgctagttatctatcattgtggcgctgatttgttttgtccacgattttggtgtacctgtttgccgctacaaacttacgcagtgttgattcctgacacactgacgggcttgtttatttctcgtcgtatgaacttgcatgcgtgatgctgcctatgctgtgcttgtttagtttatcctcagctgtgccattcattaccaggaattgcaaagctgcaaaactgtgtattatctcttttatcctaagctagtgtacattaactggagacctcgccaaggaggcaagcaagagcaggttccaggtatcaggcagccccggtaagcaccagtggctacagtcagcgtacaccagcggctgttgccgctgctccgtgctcaggggcttcccttccctggtgatggtgtacaccgacggatgcgcgtcgacccggagctcggagaggcgggtgatgttgaggtacgtgacgggcgtcctcgtgctccggatgttcctctcgacgatggacaccaggcccctcgggaaccatgggacgatcttcgtctcgtccgtgattggggacgtctggttgtagcaccagttttcgctgcatttgcaggtgttagatcagtcatcagaggtgtccattgtggctgggtgccgcgggtggtgcaagttaacttttacctcttgtgttctggggagatgcttcggaagaagaccctggtcctggccgagtccacgttttggtcgacccagctcgcccatgtcccaagtgcctggttgaacgcctcctcgcctcccatctcgaccggcttcccgtccgcctccagatggtcccacctgcagtaacacactcggcttcactgccctgctggagagagagagagccagagaggagacgctctggagcggagtggcttacgctctgaggttgccggtgtgggtccaccagtggccggtgttgaagacgaggacgtcggcgccgcgcagcttctccagcgtagccgggagctggtcaagcttgagcgccctcgtccggtcctgcttcgtctcgagcgtcaccaggaacgggctccagaagaactccaccgagcagttgtagtcctgtgcatgtttgagtcacatatgtaatcagaactttagaaaggtcctgcttgtcattcgatgtacggattgataactaaacgaacactggttagttgatacatagcccaaagttttttttttcaaactttcaactttccatcacatcaaatctttcatacacacacaacttttcagtcacatcgtctctaattttaaccaaattctaaactttgggccgaactaaacacagcctatctcaaatatatagcttttaaattgccacctaaaagttagggccagtttggtttggtgctatactaaaatcttggtagtaccaaagtttaggcaacttttagcactaccaaatttggatggccaaaacttttactatctaaaagatgtgttgttaaaaatttgacaccaaaccaaacaaatagaaacactattgaaaattgccaatgaattggtagggcacaatttggaaccaaaccaaactagcccttagtacataacctgacttcccaattcataacctgacttcccaattcacacactagtagttcaatccgctaatttgatactattaactttctcccatcatgtctctcactttcatctcctttccttgttactaatatggtgtcagtctcaaaataagcgtagttttgcattcttcatattcaacgtttaaccgttagtcttatttgaaatttttttataattaatatttttattgttattagatgataaaacatgaataatactttgtgtaaataatttttttaacttctataaatttttcttattttttaaataaaatggatggtcaaacattagacacggatacctatagctgtacttctttgaccattcatcactgttcatgtccaacgtttgaccgttcgtcttatttgaaattttttaatgattaatatttttattgttactagatgataaaacatgaataatactttatatgtgactattttttttataaatattttaaataagacgagcagccaaatgttagatacggattcccacggctgcactaattttgggacggagggagtacttggcaattggcatgctattcaacgtcaagtgtcatcttagttggagcatcagaattttcctaagcatgtccagaatttgtcttattttcggttattcacttatgtctatttgatacccgaggggggtcgtagactggtagcggatcgaaaatgataatatagaggacattaatacatgtttcatactattgtttcaacttaagttgggcttcccttatcgcaaagtgtaaactatttaacatttactgataaagtaaggaaaatatgaaggccgttgcatctcatggtttagttttggatagtgttgcgtgtcatgccttgtaataagaaaactcggcctgtacatatgcactaattctgggacgttgtccaaagaaaaaacacccccgtaatttcgcatgtacagccgacagagcattcttcgatttgactgatttgtcccgtaggtcaacactacctcaactctggcgacacaatcgccaaaactcatcggcggattaaatcaatcgtgtaatattctccctctagtttgtgtctatttcatactacaagtcgttggttttttaagtaagtttaatcaatttttttaaaaaaatatagcaacactttaaaataaaataaacatattatcgaaatatagtaaaagttaattgtagtgaaactaatttggttatataaatgttgctaaatttatcaaaaacttaattaaattttaaaatgttaaaaaattaaaatgatttgtaatataaaatcgaggaaataatatgaaatggaggggtagtaatttgtttggcgtgcacgtaccatggcgcggaagatcctgtagtcggaggcgacgtcgaggacgcgcgaccgcgagcggtcgggcacggcggtgtagaggaggcaggcgagcgactcccacatgttgcggttcagcgagtcgccgacgaacaccaccctccggttccggcactgctccagcgctagcgccagcgccgcctccctactcccgccgccgccgccgccgccgccgccgcaccctcgcggctcccatcgccactgctcgtactcggcgtccggccgcccgttccgccggcacgtcacctggtcgctcaggaacgggcactccgccgcctcgtacagcgggtagccccccgccgccgcgccgtcgcgcacccaccgcccctggaacaggtcgcagctctcctcatctcctccctcctcggcggccggcgaaggcgccggcgccggtgcggtgctgatggcatcatcgtcgtccccctccgccccctcatccccgccaagatcaggcgcgcgatcacgggcaccgcccggcgacgccgcttgcgccagcttgacgtacctctcccacggcgcctccccgaccacctcccgctgctgctgcggcgccgcgaagagcggccggcggaacgggcgcgtcgagccgaggaggaggaggccggcggagacgacgagggagaggcagaggagcgcgcagagcgaggtggccagcgcccacctctgccgcgacgccgccgcgacggcgagcgacggcttgttcgccatggcggcggcggaatgatccatcgctaacgacgagagtttaatccacaaagaagcacacaggtcaactgctcaaagcgaggtagtaattattaatttgtagggttaattagctcgccggagcacgggattaatcaaggcgaggaaagcatggaggaggaggggtttttggtttggttgctttcggtgaggagaggttgggtttttggttgggtgtacacactacacttcacttgggacgctgctgttttcatgtgcacttgaaaacagtcactgactcgcttcctctccatgtacgccgtgtttagttctaaatttttcttcaaacttctaatttttctatcacatcaaaacttttctacacatacaaacttttaacttttccgtcatatcgtttcaatttcaaccaaactcatgtgagtagcaattatactgccgctgatgcttagtggcaagcagtacagtttcaccaactgtaatcatgaagaacgttatgtttatgccttccagagtgaaaacgaagcaattttgatgctaaaattcctactatcaaatacgtggagtacttttaggaaaaaaaaggagtatatatttttaccagaatatttatatctttctcgtgtatccaaatcagtaattatggagagttggtgatggatgataattggatagttcaatttgtattcaaagttcgtgatcaagttgatgtggcacgtgaatgcttcttgattcgttattcttccgatcgatgcgaccaaagtacatacacataacataagccttgtggtagtacgtatgtaggtggacctgcatccatgagtagtagtagggtagtagatgagctgttgttagagtaaaaattagaaaaagcacacgcttttagccgtcagctgaatgggcacaagccttgttaatcttcacaacctccttttgccatgggcatttttctcaatcatcatgagactcagatcgaccacactactacctccgtcccacagtggatgtcgttttaactttttcttataacatttgaccattcgttttatttaaaaaattagtgcaaatataaaaaaaagataatcatacataaaatattttttgataataaagcaaatcacaaacaaaataaataataattctaaattttttaataagatatatgattaaatattataaataaaactcaaagcgataagtaatatgagacagagatagtagtaattatcagcgtgccacggtgtctgtcttttttccgggagagacagaggccatcatctgcatgtttatagcaattagcaaagtcgaatggtgagaacaaacatagtaacggagtcacgcgacgtgcacgttgcacgcacgtacggcgcgcgcggccatgatcagcgagcgatcgagcgtggccgtcgcgtaaagaatcggtgagatttgccggcctggttgcctcgtcgatctcgtctgcgtacgcgcgtaacgtcgggcaaagcgaagctcgcgctcgagtagtggctgcccggccatcatgtcggtcgatcattccatcgcctttgccgctttgcgtaacttatgtctatttagcacagctgtaactccacctttatttcttctggagttgaagtccagacgctctagacaaaaaagagcggagctagatagagcgatttccacaacttcattatagacataacttctggaactctttaccgtgttgggctttcgagtcatggggagttggaataagttcatatgaggtcccttaactttacactgagtccgattttcgtccctgaatcacaataccagataccatgggtccctcaactgtcaaaaccggtgtagatgaggtccctcagcggtttagatggcagttttgactgatgtggcgctgatgtggctaatttgacttagtcctcatcgtatgtggcggtgatgtggcacttggaagcaaaataaaaggtcggacccacgtgtcagtcattaaaaatagtgggacccaccctgctctctatctccccagcgccgtcgtccttgtcccttctccctcccggcattcttcatccttcctcgagctccctagccggccggcgagcgcgcggcggcaggcgagagagcggcggccggagctgcatgacctcgcccccctcccccctcctccggcgccgctgcatcgatctgcacgagttgcggcgacggcaagctcacagccacgggacacggtcagcgtggcgctgacggggcccgggactcgagctcgcagtcgcagccgctgctgcccacttccccaatcccctccatatgcgtcaaagtttttgatattcatggcgttctgctcttgttctggtggattgattgattggtgtgcttgtgcggatgatttgtgcgaaggcgacgcgaagaacgcccacctgatgtctctggacgtcgcctcggagaggctgcggctgttcaaggccgacctgcttgactacggtagcgtggcggcggccatcgccggctgcgacgacgtctttcatgtggcctgccccgtgctcctctccgcccctaacccaggggcacacatctctcttttttcagcaaaataattccttttcttctccattgactggttcaaactgtagactggttactgaaaatcgacaaaaatcaacagtttctactaaaaatgatttgtcgaaactattgatttctcaacaaccagtagtagctgaagtctgcagagttgtaattaaatcgtcatgttcttgtagctaaatgaattgatgttgttgtaggttcatacacttgctgctgctgtaacgggcacgacgaatgtgtggaaggcttgttcagaagaaaggttgggacttggtaaggttgtggtggtgtcatatgtctctgctgcgatagtaaatcctaactggcctgaaggcaaagctgtagatgaagattgcaactcgtgcagatcgatgcggcggcgtagcaggagtcttcgtcggcggcggggccaaggtcgtgcagctctggccgccgctccttcctctcccgtcatgcgcatgccggcctaccctccccgcccgatggctggcgccctccgcacttctccccacgtgcgcccttctccctctccatgcgctcgccggccggcgaggaaggtcgaggaaggatgaagaatggctgggagggagaagggaaaggacgacggcacggtggagatagagagcatggtgggacccactgacatgtgggtccactattttttaaactgacacatgggtcccaccttttattttgcttccaagtaccacgtcaccgccatataggactagaactaagtcaaactagccacgtcagcgccatatcagttaaaaccaccatctaaaccgctgagggacctcatctacaccggttttgacagttgagggacccattgtatctggtattgtgattcagggacgaatatcgaactcagtgtaaagttaagggaccttagatgaacttattcctggggagtttgcccgcacgggcccgaagctggttggaaaaagcagcatcgccgaccggcccacaacatgtgacgcgacggcggcccatgagagaagccggagcccaagcaaaaaccgcttctgctcactgggtccatgttgtcagcgacgcatggggccctccggcctccgctgccacgtgaggtgcgcccaatccccggggagctaggagcaaggaggcgcgcggcgttggggcagtggtactcggtgtgacctggtggaggccgtgctctccgccttttggctgcttgatgcgtcgcagccatccgatggcgcaattgctcgccgccgccaccaccaccaccacgccaccctgcggcggcctcctaaccgcgcgggcctccgcgtcctctcccggctgcttcctccgcgcgctgccgagatcccgcgccatggcctccgcctccggagccgacgctgccgctgcggcggttgctcccccgtcgctgctcgtcttctcaggtgcgtcttgctctctcccgctctcgccaatttggatcgcttggagcgtatgatagtgcgtgcgcgggcgccggggggtctcggtgatttgctggggattcgatgcgtgcccataccttgctgcgagtatgggcacgcgtgatggattggtcgaattggcgagaggaagttcctgtgatttgtgattggctgtgatttgggcgattctgtgcataatattttgtgtgtgactgagtatgcgagtttgggaacaaaaattgtcgaaattacatttgtgcattttttttccttactcaagccatggatccttcagtactatcttactatcttacccctccttgggatatgtattttgacgcaatgtggcaatttatgatttggtatgctcaactaggatgatggaaagtgtccagtgctttatgtgctcctttctagctcacgtttggatgttgaactaatatgacaattatggcatggatacatatgaacgctgctccgatagccctggtttatgtgttgataattggcacatcttaaattcttgtgatagccatgtctgaaatcctggatattctacctgcgaaacggaacactaaatggtgtttgtcttggtaacactaggttctgcgaaagcatatctccatgcagcgctggatgaaaataatgaaatgtcatttaatttccatgtcaaaattttttgtttcatatatcctgcttgaatgatggattgcacaaactataccatgctcctagagtagctgtttaaacagttctattttctttcttatggattatgcattttgcgactttgcgggatttcataaattgaaattcgcttggcacttgcaaccttaccctatctgtgtaatgaacaggtttccttttttccttttctggttggcacaggaagggatgcactaatgtcatttacttttgtgttctaatatttaacgctatccaggaggaaccgcttttaatggtgttgtagaagagctgaagaaagtgacgactcgagttgcacatgttcttcctgtttccgatgatggtggaagcacagctgagattgtgcgagtgcttggtaggttgaaatctcttgccacaccacctgctacctgagataacaatttgtatagtaattgaaaatccaacctgttcttaaatgttaggtggacctgctgtgggtgacattagatcaagatgcttgagattgtctgatgaaagcacttcagaagccctttctgttcggacattgcttgggcaccgtttgcctcttgatccttcagaagcaaagcttgagtggtagcaattagtctgtctattgcatatcaaaactcacctttgttcattcaaactggatcaagtaactggctgatgttttttatgtatgaaacaagatgtgtgatgttgttaggttgtgtacttgacaggtaccagattgtagaaggagagcacgctttgtgggatggtgtctcacagccatacagagaaacaatacgtgcctttttagtctacttccataatgaggtcagttcctctgtagtattttcttttcatagcatatttttaatttgcttaaagattttgctttgaaaatttcaaatgaacagttttctgactggagaacagaagagaatatgatttttcgcctcccccccttctgttttcttttttgccaagatttattttcctggtatagagggcagtctgatgatcaagcagtcgttccttgcccatgacatataattgcagtcgtttcgtttgtgcagatacttcgacggtcagctgaaatgttttgcttcaccaatggcaggtgattcttttaaggtgaaatttgcagtaaatcatattcttgtgattgcttttaacatgtcacccgttggtctcttgccacttctcaattcgatggcgtgacagggatgtcctttgtggcaatacttatttcttggtattggggcattttttgtggtcacaactcataataacaatactcccatcttgcctacatctgttattgactacagctttttattcttgcagcattgggaatttcttttttgctggggcacgcatattcttccagtctctggatgctgcgattttcttgttctcacgtgtgtcacagatccctgctgaaagtcttgttcttccagtgatatccacaaatgacaggcttacactgggatgcgaactatgggtaacatcacttatcagtattttagttgcacaataaaaaaaccagtagattcatttttcggactgctctggtgatctggtcttcttgttcttatgttggttaattttattgcttccatttatttatttatttattttgttatttcactgatagtttaattagccccccttataaactttctttaattattccaacttgcttctgaaaactggcatgattgtctttgttttacaatgttactcctattattacaaacattcccttactacaaaatcacatataatcatcttggacattattccattttcaggatggaactatcatccgaggtcaaaatgaaatatcacatccaagcaatggacgtaaagaagttgttaacaaggtactccagtctataaatcatttcagcatactcccaatagtagttaatatgatctatgtaacatcattgcgatgaaggctccaaagcatttctggggccacttcaatatgttctatggaacaacttttttatgttttatcttataaaagaagctatagaagaaaaaaaaatgttactcctacctttaaaattgtgttgccatatccttctctggtggactgatatttacaattgtgcaaactccatttcgttatgacaatatcggctatttttgcttcatttccgtttttgttcatggcatggttgtcattgattcacatgttatcttgaatctatgtttttctcctttttacctgggcatgcttgttgatttcttataatatttgtttatctgtcactgatttattttttattttgctttttatttttggaaaaggattgtaattcatgtagtgcacttccttcaaggattaagcgtgtcttttacatgtcaagtgaaggcagcaacctgttgcatgaggttagtacattcattttatcgtaaccacctagactgaacctttcattgcacatctatcatgaattcttggttgggtaagactttgatttttgttaaaacaaaagctactagtccctctaagaattgattcagcctttctactttaatttctcagcgtaaaatttttttcttgaataccacacatcttcatgttcttaataatgatcatgatataataatcagaaaatgtagtctatatttccatttatcatgcttatctaatcagtctcatggtgttacttacaacattgtgaactataccattcatcaatagtgggtttttagctcttggttaacttaattctttaaagagtacgcttactccttctaagcttagtaggcatgagaagggacaactccttcatatagtaggctgttatgttttgtgaatatcatgggcttaaaagggtgtgcacttataaccatgtaagcatattgggatgacatgtatcaaattagccacttcacaacagtatatatgtaaacaacccttttttatgttttaaaactcctaactgttcctactaaccttgcaatgcaggtatttcctgaagctaaccgtacagttttggagcagttaagtaaggtggactgcattgtatatgctatgggatcactctttacatcagtctgtccatcattggtaaccatgctgctctattttttgtttgtacataattgtattgacttgatggtcttaagtcttaacatgatatcagatatgttcatttttatactacatgcagtactaagcaaacatgggtgccgtgcacatctgattactgatactgactttaagcttttttacctgtgcctgttttccacatcagcttgtcttcttctgaaatttaaggctgtgcaggtattgcgtggcattggtgaaactatagcatcaagatccattccgaaggtagtcatgttaaaaaaatattgtcttgttttcatatgctttaatacaatgttctgtatttgtgttgattcattttttcttgattccatcatgtaaataaaagcattactaagacctgacattcttgttaaaccatattgacttgcttcatgctcttgatttcattatgctagaatgggtttaatagcaacctagaatagtggattcacctccatagtagtggactcatggggttatttgatgtgtgaagggagtttttcttcacataaaatgttgtttttcttggtttttagccccttggttgatcatgcttgtggctattggtgcttttgtctaaaattatttattctgaatctaggtacttcttttgaatgggtcgcatgacagagaaacaactgggttgcctgcttctggctttgtgactgccattactgattctctaaaccgtacatatggatatcctgacaaaagtctaaagaatcttgtaagttcggtgactgtgcctttgaacagattttcagctaatgattggaggaattatgcatcatatcatttactagctttagaggatgggaatatcccacagatcagcgtcccctggtccacatcttgaatgattcagttaaagatgtacatatgcccctgccccttaacattatctgtgtgaagattttccatctgacagcttctttttcattttgtgcagcccaaagactatgtgaatgctttattggtaccaaaaggaggccaaattcctttggatataaaaaacttgtcttctaaaggaatctttcatgtggtaagtgtttgtgtttgctaaaacagtgatcattaagtgtaaaatgtgtggaaaaatgttatagttatccatcgagtccttaactgtgtaatattttcgagaatggatagaaaatccagcctctatatccatgaatggatatatacagccaaaggttacatgaatacttagattctaggtcttttactgagaaacaatcacgaaaaagaaaatgaatggtcgagatgctccgaaattttaacgcttctttcctagttggcttttctgtgtgcgataccatgttacttccgtcatttcatccccaatgaaagaggatatctagcatcagcttattaattactactacctccgtttcaggttataagacgttttgactttggtcaaagtactgtttcaagtttaactaaatttgtagaaaaaaataaaaatattttcaacccaagacaaatttgttatgaaaatatattcaattattgatttaataaaactaatttggtactataaatattactaattttgtctataaacttagttaaacttgaagtagtttgacttcgactaaagtcaaaacgtcttataacctgaaacggagggagtacatgataaaactacaataattgcagattttgcacggtgggtcacattgagctctgtagccttggttaaacaagcttacttttgcatacttaggcatttatccattacatgttagaaaaaaggcacactgttatttacacaagataaatatgaaaactcaatgtgtaggtcggtattccagaagtacgcgatactggtccacgttcttctgtattgtagcttgtgcataaacagtattgagattgtcgttttaatgtgctaacttatgaagtatattgcaggttactgtggactctatacacgatggaaagacgggcattatttttgatccgcattcattgattcaagccctgaccagtctaatatcggataggcgtttcgtggaacctgatcttctaacagaaaatgtagagtctgtatgctgaaatctcagttctcaaatgttaggtatatatctcgctcctattttttccctgttcaatacattgtatggggaaactgtagcatcagttgcccacttgcacttcgtcagctagcttcattgcttcattcattgaaaacaaaatatacaaaaacaattgtgctcatagtttaatttcaccatcgaatcagatttcagttcttttatttcttgtgttattcaaggcgatgataatctcccctgttcttttgtgctgagtggctgaatgaataactaaatgatctgtgataattatttgaaggtacgtacgaacgaattaaatattataaagttgataaaaaataaattgtagtattctaagaaatctatatatagatttattattattattttgtgtgtgtgtgtaaaaatcgtacccttcgggagctcgggaagcccgggtattctttattccatttctctctaaaaaaacagggccttacagttgaacaagtaaaaccggaggggtcaaacgacgtcaatggaggagcgatgcgagacgggaaccccacgcgtacgcagcagtcggggatacggccggcactagtcgcttccgtccattggcgctaccctaccgggacggaaacggcatggagctcgagaatcaagatggctacaaagaagaaaaaaagaggaaaaaaacagagagatcgatcgggccagccagcaacgttccctcggtcatcggtacgattcagagcgtgtgtgttcagttcggcttcatcttcaattttgtatgtaccagtttggtccggctcaattggccacaaattatgaaattggttaatgcacaacacacgagtacggtacacacgcacacaccaattaaatcgagcaaggctttaccattacgaccttgaccatgatggacagcgagaggcgacgacctttgcttgacttcttcactgacccatggttggagctcgcctacccaatctcctatatataaaaagctagagctaccctgcatgcatgcacagcacagcccaagcgaaccagcagtccagtccagcacgggcgcacgctcaaggacacccagtgtacgacgagagatggcctctgctcgccgctggctctgcctgatactcgccgccgcggcggcggcggcggcgtcgggtgctccagctccggaggacgacccgggcatgccgatggcggcgcggcaccggtgctggatggcgagggtggggcgcacgtacgcggacgccgcggagaaggcgcgccgcttcgaggtgttccgcgccaacgcggagcggatcgacgccgccaaccgcgccggtgacctcacctacaccctggggctcaccccgttcgccgacctcaccgccgacgagttccgcgccaggcacctcatgcccgacgctgacgtcgacgagccggcgaccgcgagggtgttgttcgagcaggaggagaaggcggcgaagcagcatctccctccctcacgcccgcctgcggtgtggggcagcaaggactggcgtgacctcggcgccgtcacccctgtccaggatcaaggcaagaataattgcagtaagcaccaattaaactgttttattaataataaaaatggattatatcttctgtctcagtgagtacgcagccaaaaaaaagtcgtagaaaccaaaaaaaaagtctttgaagtaaaaagaaaggaataaacaaaatgatgtgatagaaaagaccccaacttttgcaatgaaaatattaactgaaagggaaactcttttaagcatttaggtggacgtctactggtttcttacatcccaactaaatgttagtatgatttttttttaaaaaaactgataagacatattaataatatatcgctccataaacatgtaagttagaattaaatttttataaattataaaaaaaaagaaatttgactattggatgtacatatactggagtttaatttgttatttttattataatttatagaagtcgaatttaaatttgcatgtttgtaaagtgatatactacctattaatctattttattattttttaaattttttttaataatcatttgattggcatgcatgaatcacccaagagatttacaacccatcttccaaccgaattacgtttccagaatcacataaatcttgcatcttcatcatgtcgttcatggcggccggggtgatatgaatctatgatgtgtcgtgtgtgtgtgtgtggtgcagacagctgctgggcgttcgcggtggtggcggcgacggaggggctgatcaagatcgagaccggcaacgtgacgccgttgtcggcgcagcaggtgctggactgcaccggcggggacaacacgtgcaagggaggccacatccacgaggccctgcgctacatcgccaccgccagcgccggcggccggctgagcacggacaagagctaccggccgtacgacggggagaagggcacctgcgccgccggctccggctccgcgtcgtcctcgtccgtcgccgtcgtcatccgcggcgtgcagaaggtgacgccgcacgacaaggacgcgctgcgcgccgccgtggagaggcagcccgtggcggcggacatggactcgagcgacccagagttcaggggattcaagggaggacgcgtgtaccgcggcagcgctggctgcgggaagaagcggaaccacgcggtggcggtggtcgggtacgggacggcgagcgacggcacgccgtactggctgctcaagaactcgtgggccaccgactggggggagaacggctacatgcgcatcgccgtcgacgccgactgcggcgtctccagccgccccgcctaccccttcgtctaataactaaggataccgtgcgtcgatcgctgtcgcgtttccttcctcgtttcgtactaagttaccgtaatttcgtccattatattcgtatacatgcttgaaattcggaagcatgtatataagagtatatcgtagagtcaataacccatttgtactaagcaagtgtatgtatatgcatgcgttgtatccttcttttttccttgaatacatatcacagacattcatgatgcgtagtggtagtagattatgccgcgcttcttgcatgtgtacaaaactgtaacgtgttagccccaacagacattccaactcatctggacagtcccgtccgtcccgtgtggcgtgtgctcctgaacgactgcaaccttaattgccggccacagacggccggggctcattggaggaggatcaggggccaaaaattagcgaggcccactactattggaaaaggctaagtacattttacgttcctcaactatgggctgcgttatttgtgaccctcaactgtaaaaccagctattgagtgctccctgtcttataaaccaatgcaaattgagtcattcaatagtattgattgtggttttggttgacgtgacatcctagatagaaaaagaagaaaataagaaacgcattagaacctggctaccccaccttcctcttatcttcaccccccctctctctctctctctcattgtggctcgccagcggctgcacccatgggagctcgattgaggaaggctgcaccaaatggaggaaggctgcgaagacataggagctcaaagaggctagcgagaagggagctcgattgagtagacactcaccatgccatccctcgtctcccccatctccatcgccatgtgcgcaaggaacttgaagctcttgatagccacatcccatcagcacgatgacagacttcaagtggccacttgccctctcatgatgttgacgtcgaaggcaaagaggttgaagaggatgagaagggtgtagtgcttgctgaagctagacgaagtcagatgtagagaggaaagcaaggagcagcagaagaagcttagcctccaatttagagaagcagccatgtgcgccgccgcattcgtagggagtggaacaggagaccaagaagcaacatgacggcaatcgaaaagcagccacatccaccacaccacatcgttgactaccacgaagcatgatctacgagtcgtccagatcagggtctgcatccatggcttgcttgaggatgccaccgccgctccatgtaggcaaccacttgcataggagaagctcgtcggtagttgggattaggaatgtagagtcgtggggtgaagcagcaacacctatggaggccatgatagggagcttctacctgctgatgggaggtggctagcggctaaggagctcaagcacccaaaagccgccaccaccaccggcgccacgcaagagtactagacgactggtgtaggagagggtggtggtcttcggctggtggggcggtggaattgaggatgggtgaggtggtggaattgaggggatgtgcagtggtccaaacaactggcggagagaggaggagacatctgcatgtaaatggagaaagaggggaagagaggagagggaaaagggaagagagatgggtatgccactgacagatgggacccactaactattttaaattctaggcaaattttgctatacgacaccgtgacttcgcgttttagctgtcggacaccgcatgcattaaagtaataatttccggttgaagaggagagagaaatcgtgtgaaatatcaaaaatgcccttgggcccacatgtcaactctcctatctatcctctctctatcactcatcttctctctctatcccacatgttagcgacgatggtgggcaggcgaggtccagtggcggtggtggcagaggcagaggcgtgagggcaagggcagagcggacgcgaccagcgatgtgcagaggagcgccggcgctggccggacagcgggcgaggttcggcggtggcatctgcgtgtggaggagcggcgtcgtggttggacgacaacggctgcagcgcgcggagtgaggagccgtcgcccacgcagagtgaggagggaggggcgccgtcgatggtcgacgccgctgtctgggcgtgccgttggccggagccgtcgtcctcccgtcgccacggccactcctccctcgccctcacgccaccgccagaccttgcctaaccgccgtcgtcactgacatgtgggatagagagagaagtgaaggaggggatatagagagaagagagataggagagctgatatattggccctattactgacatttcatgtgatttctctctcctctctaacaggaaattattactttaatacgtgcggtgtcgaccagcaaatattcaacttttgagaatgtcttccccaaaaatcacttcgtgcggtatcttatagctaaaaccgtaaattcatgacgtactttagcaaaatttgcctaaattttataatggtaatgctacgtaagcgtcccgtagacaccatgttagatgaaaatcagattaacatgccacgtaggacgaatcatccaattccaaaccatcgagactcgagagattcaatttatactggtgtgatagtcggggacgtaaagtggatataccctcgtcccctgtcatttgcctattttgatccgctcagccacttctccatcacccgcgccacgcatgtgccacatgtgccactcgcgcatgcaagtggcgctgctcctttgcacccatgcatgcaggccggagcgagcagtagtagtagttagttattgcaagcaacctcagcgatcgcattcgcacgccgagttttcttccaatatcaggacaacaactcgtccaccctgcccattcgctcgctcgctcgccgtgcgtagctagctgctagtagctcgtttcatcacgttgcatttgcgcccgatcgagcgggccggagcgcgcgtgccgccggtgccggcgtgcgcgccgtcgtcgggacgggccgtggttcgatgcacgccgccgtgccgtcacttgcgagagtggcagacagggacggccggggcatgcgcagcggcagctagcccatatatgaacggagcccacaacccagcatagtagtataatgtaatgtgcccgccgccaaggaggagtgtcatcaggattgatcaggctagcaataataatgtacaaatggactacgcgcgcgcatgcttagtcaggatggggatgcatcgatctggtgcaagcaaacgctgaaacgcaggagtgcatcttcctatcaccttaattgattgttactcctttgctattcgtcaggtgacatcgttttcaaatttctatactgggggaggcgggaatagggcagagggaggggtattgcggactcggtgccggtgaaccggctggcttatttttattagggttttaggattgaaggtgggagggggtttgggaggcggagagggcgatttaaataagtgttaagggtggtgaaaaccagcggcggacgttaaggtgccggggccatgagaatagaggagggtgatgagcggggtttacagcggatctagcggtgtgagccgccggagatagggatgagaggcatggccggagaaaggcaccatagtttatacagtgtttatggatctaatcttgggggaagggggaaaggaggagggaagtggccaggaaggtgcgactgattggccttgccgctaatgtcgataaggtggacggaggtggcgacggttgggtatggaggaaacgatgagagaggtggagttttggtaataacgcttaacatgaatgttgaatcaatttgaattgttaaaaaaattgatttatgttgaaggaagaaattcgtcggctgatatatagtactctttgtactaaaatatagttaacttcatataaaaaaatatagttaaatatatgttatttttaaagtagctatttactactccaccttcgtctcaaaatatattttttttctatgaatgtttatgttttaggacggatgaagtatatcttttatagaaaggggtaagcctctaattgttgttatcagtgtaatagccatatagggatgggatggaataatcgtgctgagcctgagattgaaaccggccgtccacatcaatgggatcacatctgtcaccatcgacggccgatatattgttgcttcttccatcctcatggtgacaataacatgcactgtgtagtttgccactcatggtgataacgagatgcattgtttagatcgctggctaaaaaaaatctacgccgatttttggagtcggtaatgatcttggccgtgcaggttactggactgattgacggccgtgtgcatgccatctaaatgattatgagtatgaggatggattctaatctctcgggtggacgtccacccgtttcttgcataccacctaaatgattatgaaaaaatttcaaaaaaattcacaagataggttaatatgtaatatatcactttacaaacatgcaagttcaaattcgacttttacaagttgtaacaaaaataacaaatcaaactctaactagtatacgtatattcacagtcaaatttattatttttgttacaattngtanaagtngaatttgaacttgcatgtttgtncagccatatattacatattaacctattatgtcaatttttttgaaaatttttcataaccatttagatgacatgcaataaacggatgaacatccacccgagtgtttaaaagagtttccccggtgtgcatgtatggttgaagttggagtattgtgcgtcgggataatgggattttttcgatcggttgattggctccggcgctggtcggctttgttgctccgctgcctgcttgcttacggtatgcgtcccacttcctaagatagaatcaactaatcctttctgataatatatattaatacttctttttgcaattggagacacttcgtcagatgcatggtgtttcttccttgccgagaatcaatgatcatttgagatgttccatcactaattgcaacatttgagatgctttaaccagatgcaaaactcaaaaatatactaatgcaacattaaaaaaaccaatacgtacgagaaacaatcaacaacatgaagaaaaagaattattgacaatcaacttcaatatggtgagcgcacgcctttaatgcgacaatacatatcatttgcaagtacaacaatatgtaaaaaaaaagaatataataagatgaaacaagataaacaatgaattgtaacagtatctaaaaaaactgttcaacataatcctaccagtctagattagccttcttcctctactcagagtggccagatccgctttcttcctctactctctagtggctagatctaggctcctcatgaaaaacaagtaggattcctcactttgggtaaccactctactctcggacaaacatagtgagggccgaggacttggaagatttggaaggcggaggtgcagcccacctatgagtaagcaaaagtgtgcggccctcctatgagacatattaattcataaatatgcaaagttaaattcactatctacaagttataacaaaaagaacaagggttggtttggtttgtggcctagataggtcttaccaaattttgtcaatgccaaattttggtaagttttggcatgactaattttgataaggtaaagttgtgtttggattgaagccaaaatagtctaagttcactattgaaatgacctattttcttagggggcttttaactatttgccacttttagatttggcaaataactatttgccacctctatctcaatgacatgtgggtccacatatgtctatgacatgtgggcccagtggcaaaaagttaattgccacatctaaatatggcaaacggttaaatatctcattttcttaggcatgtcaaaattttgcttcaaaccaaatagacactaaacactattaaaattgacaaatattggtaagcctaatttaggccccaaactaaacctgccccaaatcaaagtgaaactagttaacatacattcacatttatatttattagtttaggtacgactcgtagaagtcgaatgacttacatgtttgcacagtgatataactcattaatcttacttattaatttcttttaaatattttaataactttttagatgatatgtaataaacctctcgaggatgaaaactctttcccggatgcacgccaatccaccggacagtcaattcaatgaaccatcccactggacactggcgcatccgcgcatgcacaccagagtgcaatatggactgacccgaccatgcatcaaccgtgcgtcgtctataaatacgaggcaaatgcgccacgatcctcagctcacaagtcacaagcaacacagagtgaaaaaaaatggcacgggttcccgtctctcgccaccttcgcgtcgcgctgcttgctctcctcgtggtcgccgtcgccgccgcggcggcggcgcgcggggatcagccgcgtcgcgggcatagcatggccgcgcggcacgagcggtggatggctaggttcgggcgcgcgtacgcggacgccgccgagaaggcgcggcggatggaggtgttcgcggccaacgcggagcgcgtcgacgccgccaaccgcgcgggcggcgaccgcacctacacgctcggcctcaaccagttctccgacctcaccgacgacgagttcgcgcagacgcacctcgggtacagctgggcgccgccgccgccgtcgcaccggcatggccaccgcgccgagaatggcaccgccgcggcggcggcggatgacacggacgtgccggacagcgtcgactggagggctcgcggcgccgtcaccgaggtcaagaaccaacgcagctgcggtgagaaccactcccgaacacaaacacgtcgatggcatagctcacgcagtggcgtatctcgaaaattgattcgttggtatcataacgtatctactaataccataatatgctaattatacttagatcatgatgttataatacatggataaacagtttaactacaggtttactgaaagtcgtcggtgtcgtgtcgtctgacaccggccgttacactgtagatcagctcatgtgtactgtacggcgttcgttgcagggagttgctgggcgttcgcggcggtggcggcgacggaggggctcgtccagctcgccacgggcaacctcgtgtcgctctcggagcagcaggtgctcgactgcaccggcggcgccaacacctgcagcggcggcgacgtgtccgcggcgctccgctacatcgccgcgagcggcgggctgcagacggaggcggcctacgcgtacggcgggcagcagggcgcgtgccgcgccggcgggttcgccgcgccgaactcggcggcagccgtcggcggcgcccggtgggcgcgcctgtacggcgacgagggcgcgctgcaggcgctcgccgccgggcagccggtggtcgtggtcgtggaggcctccgagccggacttccggcactacaggagcggggtctacgccgggagcgccgcgtgcgggcggcggctcaaccacgccgtcacggtggtgggctacggcgcggcggcggacggcggcggggagtactggctggtgaagaaccagtgggggacgtggtggggcgagggcggctacatgcgcgtcgcgcgcggcggcgccgccggcggcaactgcggcatcgccacctacgccttctacccgaccatggacagctagctcaactgagcactggacagtgaacactagactgatgcaaatatgtactaatattgataagaatgttacgcctaatgcaaatatgtaatatgtgtgggcgtctggcttctaagtgataagctattaagccatagttaaggagtatatagtagataaaatgattatgaaaccagaactgtatcgacatatgcagttaaagaaactgatgtcggtaatggatggagcaaataagcacttgtacacattaagaaaagatgattcagaaaattcaggacatgcttattgcgcacaacatttttctgtctttttactgttccaacgaagaggaactattcatcgagataatattagtaaccaacataaactgctgcgttcactatatagcaatcatcgtttttatctcccattgcttctaggcatacgccacttgaacagatcatcccaccgtccacaacctcaaagctgataattttaccactgcaaacaatgagaaaatagcataaggcggcgcttttgctacgtcatatgtaaaccaaatcaagatgcacactatcagtatcatcagattaaggctataaacacgctgctaatgatcattctggacaaatgagatccattgagtatctcagacattgtttgattacgagttgttgttagcaaagaaatgctttacatccaagcagctgagtccaggccattaataattctggtgtgttcttccttttatatatttgatcatgcttactgccacatctaaatatctaatattactgtaaaatgcaaccatgaatacgagttcatggaaactgtctgcgcactctaaatatttctcttgctgatctttcattttcagtaagtcgtgaaaatcgtatgagtccatatggctttcttttgtatggctgctttctatctcagcaaacatcacacagcacagtattgcaactattaaacattcctacaacgctaatgtgaatcaatttgtcatggcaacatggatttacctgcttgttatgcacactagttagcacaaaatgttatagtttgccactttggcttttgtctgagatactgtaagctgtaaccatgtaatactttcacatctgaaggacattctggagcactggtgttgaacattcaaaaccctcttatgtagtaagtatagtgctgaccacactgtcttgtgtacttgataaaagatggtatttatttgcctaagacgctgtgatgactttaaggatgaagtttttatagaaatatgatcaaaaggaaaagcaggtggtgatagaaaaaataatcaaatatgctaaaaggtgagactgtattgatcgagggtcactgaactacccggttctactttattatatacataaaaaatcttagttagagatcacagctacactcaataagcattcaatttgaaggtaaacacattggataaccacatctatcttttgtagttatgggaaactggttacaattttgaaagaactagaacacattaaactttttttttttcaaatctaagcccttgactgcctcagattttgttattaaagagctaagggctcttttcaatacagttagcttatgaaaatcattagtgttggaaatagtgagcaactgagcaatgttgggtaatgaagaggatccgtacttgatcttgccatatggttatgaacataatcacaaggaacaattgtactgaacaaataaacatgatagctcatgttcctctacaccacatttgttcaccatgtccatgagttacctaacctagatattgccaatcataccaaggttcaaacttactactataatgcgagctagtatggtacacaaccgaccaaaacatgctcaataaacttgtaggggtactcattgcatccatttctgattcagcgttccaacaagaagatcccaattttactaataagcacgaagagaacacagaaagagtgctcactaggggaagacggccttgactctctcaacgtccagcaagtgctgcgttggcctcggcaccccgagcttgatctgcagcttcatctgctccgtgttcaccccaggaatggatccttcatacaccaaaaacagctcagttaatcaacgataggaaacaaaaagaacaggtgaagaatttggcgtgcggatgaggtgttcgacggaatgtctcagagacaggagaggcgagctgtgggggaggctaccgctgcggaaggccgggatggagttggaggtgatggcgtccctgcaggcgcgcacggcggcggcggtgacgtcctgcccgtgctggtcgtacccgacgcccatctccacgaacagcagcctcatggcctcctgctgcccctccccgccaccgcacgcctgggtctgcgccgcctccatctccatgggagacgacgaggaggcgaccgctctcgctactcctgcggcgggcggcgccgggttctccggcctaagggatctgatccggcagcgaggcggccggcggcaggaggaggtggaggggagcagcggtggtgttggtttggtcgggcgggggaggaggaggaggcagctgggggatgatgctgctgacatcatcatcatcatcatccttccgctgtttcaataagccgacgaaatatagccatcgtgtgaccattatgattgttgatcaaggtcaaatggagttgcagaatacaccctctgttttcaaattaagttccatcttatagttttaaaacgaagggtgtagttggatctgctaaaacatcactgctatactacttccgttttaaattacttgttattttaattttttttcttagctaaagttatgatttatgaccactaatttttaaaaattcatatagtttaactatatgtgaaatatgtattataaaattatttctcatgacggatcttaaaatataaatcatctaaattaaactatatgtcttctaaaaaatattaaactatatgagtttataaaaattactagttaaaaaataaaatatttgatttaagacatatcttaaatgactgaatacgaaagtcgcgacaacatggtatccagaaaattaagtcaccgattatgtgcttacccgtgtcatattaatcatattgttatctcctacgtacgattaataacgaacacggcctatgcaaactgcgcggctaactaccaatattccttattttctattctaaattttcatttttttctaaattgtatttttatatagattgtaaactcttattttagtatttttttaatttttatttttataaattaaagttataaattgtatttctatacggactcatacgtctacttctattttctttttttaatttcaaattttagtatactgatatggattgttttttctttcaatatttttttaatttcgaattttggctatttaaaattgtatttctatattgtctctattattctttttctctgattccatattttaattaattataaattgtacaccagtatgaactctagccttctcttccaatattcattattttttaattatctatgtaaattgtttttctatatggactttaattaatatgagaatttctaggcccagcaaacgcggagtctaattttcttaggctgtgtttagatccagggtgaaaatttttgccctgtcacatcggatatactgacacacatttgaagtattaaatgtagtctaataacaaaacaaattacagaatccgcctataaaatgcgagacgaatttattaagcctaaataatccgtcattagcaaatgtttactctagcaccacattgtcaaatcatgcagcaattaggcttaaaaattcgcctcgcaaattagtcgcaatctgtgcaattagttatttttttcgtctatatttaatatttcatacatgtgttaaaacgttcgatgtgacaggatgaaaaaacctgttagcggatctaaacatgtccttattacttaaataagttaatgcattagttcttaatccaattggttaaattagaaataaactttgtgaatgtggtttgtttggtcatgtccatctcaagctttttttactccgattcctatagttagtttaagcttccgtaaaaaaaattatataactatataactattatggccgtgtttagttgtttaggtgtaaaaattttgaagtatacggacacacatttgaagtattaaatatagactaataacaaaacaaattatagattccgcttgtaaactgcaagacgaatttattaagcctaattaatctgtcattagcaaatgtttactgtagcatcacattatcaaatcatggcgtaattaggcttaaaagattcgtctcgcaatttacatgtaaattgtgcaattgatttttttttcatccgcatttaatgctctatacatgtgtccaaacatttgatgtgacgtttttggcaaacaaattttggaatctaaacacaccctatattaaatctaaactgttataatctggatctactatgacccaatggttattttttctctcttttttcttgattaaaattggaatttctatttttcttgtccgttttcactattttctatctttcttgtccaattggaatttttttgtccgtttccaagtttttttttgtccgtttcagctcttaggtttatcttttttgtccgtttctaagttttttttgtccgattggaatttttttgtccgtttctaagtttgttttttttgaaaagtactccttctatttttctttttttctttaaattaacgtgggattttctaggccgtgagagcgaatgtggagactcttttttctattactatgtagatataatagatttagctacctacatcctctaaaaaaagctacctacatcagatccatgtcatctaatcccagccttaccaaataatttggtactactagactagtagtagagttttaagtaggacaatatattctatgtgcacacatcctaatgcagttactacgttatacactcactcactgggcactggcgaccataggatctcaatcggatggattggatccaaacgggacaatttcgtagaaaactgcccgcttcttcacctgtcgtttgttcccgaagcaatcgattgttgatgacctcgggatggcaagcagccagccagccacatttcacggcagacggcatcctgcgtcaccgacgccgtggtcggtggaaaatggccgtggccgtggtcggtggaaagcggcggcggatccctctggcatttggatacaagcggcagcggacaggcagacgacgcccagcagcggacgagagaggcgatagctagcgggatcgcaaaacaggaataggggaacgacggaaaagaactgctaagaagaattgcttgattgacagttcgtggatcgatccagatcgagccgaacctggagcgagcgccgcgcattgacatctctcgcgtgagccgagccgagcggggtgcggatggagccgtgggggctggccgtcggatgggcgactcatccacgcgtacgtcatgcatctgcgtagggccgggttgaacggaatgaggtttgcacctcgtatgcacataatttttttccgaccatgcaatagggagaggtcatcacgacgaacccactctgatcccgccgatgccgtcgccaccgccgccgctgccaccagcatcgatcgacaaggaggaggcgtgcaacaccttcgatgaggacgacactgacttcaatcttccattgattgtgagcatagacaccttctaacagggattttgattgcgggaggcatcttgattattcatcttcttcaagcaatctcccgtgagcatggtctaccgagaagattcaatccgccgccgacgtcttgccgcacgtacggggaaggagacaattaaggtgggggagaagtagcaggagcctagataaagagaagagagaaatctaagggttatttgcgaaaccactggtgaaaaagcggggcgttttctacaaattgccctgattatatcctatccatccatccgattgagatcctagctacgactgacagcaagtgagtgcacaaggcaatgagacatttacagtttgaagatgacgatatgctgtgtggtagaacttctatagtgaggggcgaaggactttaagagatgctacggtgtcctgattgtttgcttccgtagatttattcgcatacgcgaatacggaacaatatataaatgcatacattcttggtcaatgataggagaggacgacggaagaggacaggacgtagctccacttaggtagcaaacacttcctccatttctcatttacttgaaacatttgattgatgctgttttaataacctgatcacactttcaaattgttctacagattctgatgaacaaaaaatgtatgattgtattaccaatttatcatgcaatatattttggttgcatggtatattattttatatatttgtaaattaattatcgagataaggggtgatcatttttttaattaataagagaaaacataggtggtgtgatttttagataatcgattaaaaattacacccttcactcacgtagctacaaccaattattaaaaaaaatcactcaacgatgagcacacaccaacaagtggtatggctaagattagtaggtttcttatgaggttagggagttactgttatttcgttttctttttttcgagggattagggcagaagctctgcaaattttattatagaagaagagagaatcacaaggttcacctcttagaaaggtgtcacagcgaaggacataagggattacaagaattgagcttgtcatacgctttgcatacatggcgatgatagagtcaaccacctgcagaaccgtactatatgcaccattgaaaattctatcgtttctttgaagccaaatacccaaagtcatgtagatgattaagccattgaaatttcgtctttattctttgatcagttctcttcagcaagcttcccaccagtccagcatgtccccattgaagaggatgcattcacgagatggcgggagtgcgatgcgcatccacatgcgtgtaatgagagaagaatggaagtgaatttttttcctcgaggggacatcccctcgttttgtgcatgtcattcaaaaagttatcaaaattcgaaacaaaaataacaaatttgaccgtgaattacgcgttctattcatagttaaatttttttatttttatttctacttgtataagttgaattttaattggcatgttgtaaagtgacatatcacatattgatctatcctactaaatttttttaatttttttgatgactttttaagtaacatgcaaaaatgaggggatatcctcttatgtcatgatttgagttttccgagaaaaatgaattaagataatacatgatctctatttctatggccctttgatggtaccagggttaccacgcattttttagcgctaattaattaaccaccatctgaatagaaactgccaagtgttacttgtatatatgtacaatatataaatatataattatttgaatttgacacacaaagggtaaaaacaaacacaaccttaattttctcggttcttttctccctccttttgaacgcttttgcccttcgttttctcgttccaaacgcatgcaaattcatgaatcccatataggcccgaacgccgggatgccggccttcctgcacccgctcaccacgtccctgctcccctccgggttgctcgtcaccaccaccacctccgcgccccaccgccgcgccgccgccacggcgagctcccgcacgtccggccgccccatcaccgccgtgtcgtgcaccaccacccgccccgccatgctcttgccgcccgccgccgccgccaccgccgccctgatctcctcgccgtagttcgcctcgacgcccttcgccacccacaccagcgacagctccgtcgccgtcgtcgtgctcggctgcatcagcagcgacaggaacacgcagatgcccgaccccgtcgccaccatggtcgcccgccggtacatgccgatgaggtacgggaggccggcgaagtggacgccgcgaacccagaggtgggtcggcgggtcggcgacgaggccacgggtgaagtcgccgacggcgccggcgagcatcgcgtgggtgcgccgcccgtcggagatgatgccgaaggcgtgccactcggagagcggcgagcggctgatgcggccgaggaggcccgccctgacgccgccctggaaggtcaggatcgccgcgtgggtggacggcgcggtcaccgtcaccggcacgcggcgcacggtgagccacgggagggtggtgaagaaggtgatggcggccgcgagcctgatgtcctcgcgccccgcgaggacggcgccggcgagcgggacgtaggacctggcctcccggtcgtagccggcggagagcacgacgaacgtccagagcagggcgagcgcgccccagccggcgaaccggtgcgtccgctcgaacacgttgtggtggaggtggcgcacgagcgggaacgccgccgcgcaggagagcgcgagcaggaagaggatggccgacgcgacggcgacgatctccggcggcatctcgtcgcggcgccggagcgcctggacgagcgcgtaggccagccacgcgacggaggacacgccgcagccgctgtggacgccgccgagggactggaggatcgccgtgacgcccgtcttggcgacgaccggcacccacggccggccgaggagcgcgacggcgagccagaacacgacgcggagcgccgcctcggagcggcacagcgtgagcgccaggatgttgcccatggcgaagacggcggcgcgccgctccgcgtacgggaaatggccggacgccgcgagcgcgaccgccgccgcgttcagcgcgacgcagagcacgaagaggcgcttgtacacggtgaacagtccctggtcgaacagtatgacggcgagcctcgatcgcctggcggtggccggcgccgccgccgccgccgccgacacgctcggcttcttcttccctttcaaatcatcctcgacgtcggcagctgcggccgcggcgacagccatctcctcgtcgtggccgtcaaagacggacacgccatcatcctcctcctcgtcgccggcgacgtcgaggtcgcagaagtggctgctggcgcggctctgcgaccgtccaacgccgcagtccggcttcgccggaatgatcctagagaaggaggagtaacggctcgacgacagtagaggcagccagatccaccttccggtgctcggcgccgccggtggcggcttggcagggcatgcggcggcggcggcggcggcgatggcgaaggggctcgccggcgagggcttgggctcgaaggtgacgccacggcagctcgagaacttgatctcgatgggcttcgttgtcagctcgtctcgcccatccatggcgcgaggcagtaagcctaagaaactgacttgaattaactagggtttggtttgaaatcgccagtggttgtagaattgcatgtgtatttataagcagctgaagcaagcaagcatcagcatgaatgcatgggtagataggcttgatgaaagtgttttcaactctatgtcaaggggatataccagtatttttcgtgcaactcaaatagtcatcaaaatattttttaaaaaataataagataaattactatgagatatgctccaaacatacacgtttaaattcgacccatgtaagttcaaacaaaaagaacaaagcggacctctaaaaatattattttttagttatatttattatttttattctaatataacttgtatagttcgaatgtaaacttgcgtatttatggaataatttatctcatggtgatctatcacattatattttttttaaaaaataatgactatttaggtggcatatacaataaaatatattctcctaaggaatgaagatccatctgagcttgatattacaagttggcatgaaggttgtaaaatatatggggagtctttgtactatattttgtactttggactttcaacgtactttccaaacgtatacaactatacttcaataaccgtgcggagtcttttgataaggagtactactatctgtctatctttatccaattagtactactgtattctcacagcattatcaagctagttctactccctccatttcataatataagtcacaaccacttttttagatgttctataatataagaacacccgcaatagttatctatagtctctctacaagagatccatatcagcatattttcctacttggaagagattaaatgaagagagagcaaaactatctactaacctggagatagtctatagtaaaaaacgatgcaatgtattagagagctatagatacccatgtagacatactattgaggtgatttactattaatctagtctattgctgagatgtacatgttttatagagagcaccttactttaccattgtgggtgctctaaggtatgcatgcatgtagacaattaactatggccccttctccattaaattattacttttttaaatcctccactctcatgttctctaattctattggatgcatgaattgtatttattatgataatccaaactacaagatgataataattatttcttggtctttgagttaaaggtgattatgccttatattttggaatggagggagtacttttatttttacgaaacgcaatacacaagcaatgctcatataaacatgctcacgtttaccttatccctataaatacctccgaaaactaaaccaacgtatcttgagaatcataaagtcaccgcagacgcctcgcgctcaccctatacatatagacacctcggaatgctgaaccaacatatttttgagattcatgaattcatcgcagacgtctcgctgtcgacaaatatgtcacttacccctgaaagaataattagccataaatgtgggcatcgtaccaagtcttagaacttaaacccggatgagtagattccactaccagaaacttaatcagttgagctaagttcactttgcatatttcatttacatctcttagcacaagagaatgtgtgcaactgtatgcacagttcaattaagaaatgatgacataaacatgaaatgcttttggaaatattcattttttatttcactgaattaaaaattacactcatatgaaggacattgatgccggttttttaaataaactgacaccctcagtaggagtcaagctgatgagccagccaactgccacgtttttaatttggcttgttgctcgctgctctctcgctctctcgaagagcgctgctatgagtgtctcatcctactcgcatccaccaccgtgccatgagcatcgccacaagcttggagtcgctagatccggccgccacaagctcaagggtggctacatccaccgtcgtgagctcggggacaacaccatccccttctcccattcggcggcagagcatttcactccctcggcctccacctcaccatggcctactaaccgccacgagcttggggctggatcctttaaacagtgggtgggaccatgagacggaggcaaccactaacagaagcggcggctgatcttggggatttgggatttttgatggatccggttctcttatctgttggattatttcctctacctcccttgtcgattccctaattaatgttgtttttccctttgttgttgtagtggatagttagttacggattgggtagtagatggattctgatttgagaaataatgcatttgtgccaaaatttgtgtttcacttgattttttatgttgaaaataatttgtgtttgatgaagaacaatttggagaacttttgtgggcaacacatcggcctgaattgagccaatccactttttttttaaatcgtgcacctcatcggtgtcgattctcaattagacactgatgaggccgtcatcaacgccgccttcatggttttggttgaggaatctggcacctatgtaaggtttccaccagcaccaaagtgaggttttgtagtaatgattaatttgacttacacatttaccaaaaaacattgagtatatgtaagagtgcatgtaaacactcactgcaccatgccccaaaattctttaacttattttcccactagtcagcaaagaggacttatatgctgccaaactatatgtcgggaaagctttggcgatagatgaagtctgtcagggtaagtacgtactatactgctcatcatgtcaaatttatccttttctctctctcttttttttctctctcgatatgccgattgggtttggactttcaattctgttactagatattatatgtctgttgtatctagatattatgaaataaatttagagattttaatattaatttggttcacacagaaccatgcgagagcacatctgcacatgcccttatatacataaaagatattaagacgtgaaaatgtaatcagaaaaaaaagaagaaaatatatgtccagtataaaaaaagaccaacgtaccatgcatggccgtttgcactttatgaagatgatgaattacagatttaataatttatgacgttcataattcatacaactagacgatcgacacacttgtttcacttgtaaaaaataatcggaataaaatgtttccaaacatattagtgagaataattagcaataactatactgagtgggtactttttttttttacgtctacgcaagggagagggggattattagcaacaattagcaacgtacaaactattttgtactacgatacatctaatgtgtgcatgcagtttttcgtaataactaggtttaaataagttaacctattataagatgtgacacatcctaatactatttatctgtatagaagcatgtccatgtttatagtactagaatatctcatactagattaacttattttgaaacaaatgaatcatatagtagttattaattagtggagtacaaaataaactagatacgagggatttatagtaataaatagggagcaataattgcacataacatatcaatggttgagatcgagcctaactatacattcggtcatgaacctaacaacaatagggaactataagctagatatgagatccaatgtactcggcttcacccatgttgagctttcagtcccaactatttaaaaataataattcatcaagtaattggtttgtacaaattaaagtactaagtgtacatctaaaataattcaatcaaaggcccactgcagccaaatacagttttgtggcctgtcgatggcactgcactgtactacatgattacaatgtatagatggttgaaataatgtgaattctattccaagtacttgaataaggacttagttgtagtgtgcctaacgatagaaggagatattatccatttccattacattaaaaatgtatttgaagaaaaaacataaaatcctctcatctgccttgccaccgccgagctagctgctgggcgcagcaccagggatggtgggggcggggttttaagagatgaactacgaataggcgatggcatctgcaagtggtggagggtggcagcggctgaagcgccgcctcaaccggatgtggtgccgctatgccagatttagccagctacgaccgaagcacaacttcagagacccgatggtcttgaggctccatccctacgtgcctccagaggcacttgttgaatgtgcatgtggtggtggctggtggttgacaacatcttctgtgcagtggcttcagcacattcctctcatgcttagcttcctccagggcatggtcgcggggagcttcgggtaggcaatgtacaggctagttatagatgtggggttggtagggaattgctaacgaaagccttgctatgctattggcccgcttcaacgatggcgacacccttaagtgtcgttcccctccttggaggcgtcattaatgtgtttctctcctcttccatacacttttgcttattaccaaagaaaagaagcttgttgaaagtgcctgctttgtaaaaacaatgcagaaggaagcggggaatgtcctgtccaattttaaggtgaaaacctcgctccagctttcggatgagaggtggtggcgaatcatgttgtatctcccatgggggcgttgctttagagaaccttcctcgtgtagcggagaccgttggtggaattttgtgttggcctgggacttagcagctggtttgcaattcagttactcttcggtgataccattcgcttcagttcttggtgctggcagtgatgtgtatgggttccgataggcagaacagtcggacgctattttagggagtctattttcagttttgaggaggatgaggattacatacaacctgcaatccatttctcaaaacaatggttatgcaaacttttatcatttgtagatagtgttatatctgcgtaggctgatgatgttctaattagttttcttgttacctatcaagctatgatacataaattgtggtcgttcgagctacaatatctataataattggttgtagcttatttggatcaatagttggaatgagttccattatctaaaaatgcaaccattaatattgtcatatctttttaacaacaagtggcatattatgacatgttttcacactttacttgatttgggccaaattaactagaattacacggacaaaaagggtaagacgagactggatatattattggcttgtatttctggtcaagtttagcataatctacaatcaaaggattagtcggtttcataaaattagtaggttattttaattaaactatagcattaacaaaaccatttactttaccccctaggtggttttggcacagtgcccccaccccactctcaaactaggtattctacccctaacctttccaataccctcaacccctaaggtggtttctgaaaggaccttgatatcacctagagtgtgtgaataggcattcctaaaatttacttaaaaattccagcagttaaaaacatggtccgaaacttcatgacagcttttcttgccgagcagagaaagctatccggaacttctgtggttcttcctatgaagttccgggcaattgtaagttactctttcaagcacctcacaacgagtaaattgattcagaaggaagcctaaaccacaaagatatacaacatgtatcaaacaagagttcgtactagatgagagttcccaaccagcacataaggcatattttgtagttgtgacaaaatcagatgacagatgcgtactactatattcacaaaaaaatagaatgcatcttcagtaaaacgaaatattcaggagctgaagtgaaaacaaaatcatttattgaaaacacacctcaatttactgaattagtatcataacacggtactgttgcagaaaattcaatccattttgttgtttcaacttagaattatgttgaattaatgacagctgtggcttgagtatatttctcaaactctttaatatagctccgaaattgcatagaaagactgcagcaaggtacgtatccatgcatgcgtgcctgatggcccgccagatatgacaacggcgccagatcgagaagcttgtgacggcatgtcggcatgcttgtaaacttgtcctagatggagctgtgtagaagttctaatgtaatctacaagtacacaatacatccaaatggacatcaatccagactgtacatatcaaagatgtatccagtaaacgtatgaaagatacataaaaacattccgagtattgtgtatgaacaagtggattaacccggaccatagatctcgataaaagtacaattgaatttggtatacaagccttaaaaatatgtttgcaactctctatttttttacttaaaaaataagaggtgcttccatcgttcgtcaaaaaaaccggatgaaaaaaccaaatttatcagataaaaaaaccgggcgaagaaagtgcaaaaaaaaccaaatctgtccgatccagaaaaaagaggcgaaaaaaaaccaaaattgtcccatctaaaaaaccgggcgaaagaaaacgtcaagaaaaaagaggcggaaaaaaccagcgaaaataaaaaaaaataaaaaaacacgcaagaaaaattatttccaccgtcggtgatttttttaaaaaaacatgcgaggaaaaaactgtcagaaaaaaggcgccattttaaaaaatggttttaaaaaaccgtgcaagaaaaaaacacagtctattaaaaaaatcgctctgagtcggataggatccatcgattttttgccacctactacatggcttttatttcatcatatattctcctgtattgataaaagcaaaaaaaaagaacatttgaaaaaaaaacaagcaaaaaaacacgcgagaaaataattgtaaaaaaaggcaaaaaaaacacacgagaaaagaaaagcaaaaacgggagaaaattatggttttcgttgtaaataaaaaagaaaaaaaaacatgctagaaaaaaaactttagaaagaaatgcgctatttctgaatggtttgagaaaatcgcgcaagaaaaaaacattgtttataaaaaaacaagctgctcattaaaatacaaacattgtcattgaaatgattattcatgaaaaacatatattatcattagaattttttcacccgtggcaacacgcgggcatttttgctagtgatgtacaatagataaagttataaattggattccatatacaactcttatcatattgttcccatagataattgtatacactagtaggtactaaagttgaatggattccatatttcatatgtaaatcttagcttctattttatcagaaaaaaagcccgtgcgttgtaacgggtgaaggctattttaacttattattgttatacggtttagctagggtgaaatttactctggaaattcgcttgatttttttttagaaaatcatgagctgcaattaggagtctagactttcgtgtcaagttagcatgtaagttgactccttttgtattccaaaaacgaacaaatatgaaaaatgactcaaacataaatctatatttttaaaatcgaacaaaactaaaaaccaactcaaataaggatgacataccaaagtaccggcaaaagcatatataatttttataatagtagagttaaatctaattgtattttcagtacaaatatattaataaccgatctaatacgagaacttacctatcatgatcagacaatcaatatatgtatctgtatttttaaaataaaaatgagaatttcaagattctgaagtgatcgtggtgtcgctttttgatatatctttataagataatagatagatagacaagaataggtaacatatattttcttataaagttattttccactagctaggggggtggcctggcttgtgaaacaacactattcctagcatgtattatcaagttgagcaggttgccctagcgatttttctcttttaggaattgaacttcaaaccaaaagtctatagtgtttttctttccagaaaaacatttgaaatttcttcgaaaatccatcgacacagctgaaaagtctttgctgtgttggaagtgttgggacttattccatatactggtaaaatgccatattttgctaggaacatgagacaaaggtattataatatttcataacaaactattttttttatcaaatattttagtatcccttgtaaccaaatgttggagtaactcacaatattaaaatatagggaaattgtgctacaccatactgctta

SEQ ID NO: 59759 - DNA, 41715 bp, Oryza sativa
cgcatgatacctgataggtatcacctgatacgtcgcgagtatcacctgaaaacgtggtagaattgcctgataccttatatatatcactcgataccggacctgatacctaaccagtatcatcccgttcaaaaacgggattccgttatatagcagcccctagaaaatattatgttgtgccgtggtgaggttcgtttcagggaaaaaaaaaaaggaggcctatgtgttgtgcaattgatacacggtctgtgcttttcggaatgacttgctgatccagatatgtatattatacatcgttttgttgactatgtgcacctttttactttaaagtatcttgatacggagaatttgtttttgccaacaaaggtctcttgtgattgtgatcgagcttacggtctgctcttgccagaaagcagctagtagttgtgttttgccatgcatggtcggcatgcttcttgtgttttgccggtgatcgaaccaggttcccctgaagtcaagtgaccagtcaagagtttgaacgttgaaacgttgccttctagcgatgtgccatgtgccctaacgagtttagccaatcaaagctagtcacaggtcactacagttcgcaactgattttaccctggacaagcaggtagcttcagaaattagactgatcattttgccatcaccagtgtcacctcaactgttccacccgtgctctcgccagtaatacctctctatgtacagctctctgtccctgaataacaaatataattaagtttcttttggtatgcttaaggtttgtttccctgtcgttatgtacacagagcatgctgttctctgttttttcctgtttggtaagataagatttgtttgaaataacacagacggcatggtctcatgtctctgtaatcaactgttcgttaactgttgatggtgacgcataaaaatgcatctataggaccaagatggatccgtgtgatctgatgatctgatgtgcatactgcatagtatcatactatatagttttctgtggttggaagtgtcaagtgatcgaagtttcagttgaaagatccatccatcgatcggccgcatggcgtctgatccgctgaacacatgtatattcagtttacgatcatctctccggggcccgtcagattagcacgccgtctgacttgacctagtgcccatctctcgaggtttcagatcggattggagatccagcatgcaggattgatcgaaacttccaggcagacaagataatactagtgcgataataattaagaagaagatttaaaaagaaatctagatccatagttacatagcccatagcattatctcttgagtagaccttaataaatagtatgaagattttctgtagttcatgtaaataaaaacaaatctatccagggcatgtataaacctctgctcaaatgcttactgtcgttgatgcgagtctggtagaaccagaataaaacttatgctaattccggcgcatcaaccgtacgtgcatgtggctcacttttctacatatgcatttgcaaattgcagtttaggagctcctaaacttgtcgctgcttccaattccgtgtcaacattcagtggaaataatagaataaatgtttgcgtaactgaagattggagtgcgaatgttcagtggaatatatgctgcgtaattgcagatgggtgagttaggcgagagtgtatatattttcggccggccgcgacggttcgatcggttaagtacgtgtgcactatgccatggatgccatgagagacctgacgatgtatataattttcagaaaacaaatgctgcgtgtagctagtgcataatatggatgcatgcatatgccaggcttgatgatgaggaatatgagttggtaaaagccccaattcccggtcgtaattctagtgcccaaaatgatgctcccatcaaccaaacacgcccgcttaactttgatcaattaatgatgatgaaattgttccctagcttgtcctctccctaacctatactagctgtccaactgatttgcttttggacaagattaagcgttaaactactcaggcgcaaattgtggaatactctaccccaaaccaatccaaacctaccgttcagattaactatgactaatctagtggccattactgtactgcttttgcagctagcttcctctcctaacaactcaagcatgcatgcgcgattgcacgcacagctaaaacgaagtcgtctggttctgatgcgttgatgcctctttaattctgcatgcgaataataacaatattgtcttctccggcgccgtccatcctcgagattccctacgctcaggccatgagggggtatgtacgtatctatgctgttttttctcgttattctgcttttttaattagttttctacgcagagattccctgctctctttatgatttctcttgtagcagtgaaaaattaagaactcggcgcaagtacagtgttaggaacgcacgcacatgtcgtggatttcgccgagaaatgattgattcgcgcgctacatatgcatggatgtttaattactaaatcgatcacaaatctgcatgcactttgcggctagcacttcacagttttaattggttagtgctctatatttgtttgtgcctagctagccagcagcttagcccgaaaacactgaagaaataatgccattttgagtaataaggagctaattaatctatagctacctaacgcctatagtgctaacaaagatgtatcgacgcgtgctatctgcgtgttctttccctgcaaaagatcgataagaacagatcgactttcttgtagcttggaattaaggcaagatttccagggatactgtctgtaaagttttcatgctggttactccatttaatttttaaaaattcgagcacgtgatttgtacaaataatttgcgttttaatctgattattcttcggttcagttgaacaccacgcacctccaaaatatgcagatcagatcagcatttgttccaaaattaatcatcttcccttcgctgcttcgattaggagagcatgctgccggctggaggagtagttctgtttattatgcagcaagcataaaagacaactgaacgatcacatgaattgaacatatagaaaagactcgtttcaactgtcaatatatacagaagattcgtgtcagtttgcagttataaaaggagaagattacgcacagttcagatcgcgccgtccgccggccggagatgacagttagtgatcttgtagtcttgtgcacgcgacgccgttggctagcttacaacggccaggtcattgtactaggagcacacataccggtcacggtcagccgttgcaagttgcaaccgaccagatcattttgaccgtccagttatacgcgccccagaacgcatatatgatctagctctgcgatctaggccacgatgctagctgccatgcaacagctatgcagctcgatctgatatatccatcttactagattcttattagtagttaagcattagttactgtactatcaacaagttaatttcatcgatcatatcaaggctatatatatatatatatatatatatatatatatatatatatatatatatatatatatcttgatggattgatctctagctttgattcctttgcacagaatctggtgttgcttgcaaatactactacgagcagtagtacatcaactggtagctaatgaagtgatgatttatgccgcctgcatgccaattgccagccacgcgccagcgccgccggcggccggctcgacgccctgcgcgcgcggcctatcgtaacatggcggccttgaattggaggccgcagtgtccgacgagtataaattttcacaggtcgtacgactgtcacgtgctcccgcgacgctgcgtgcgcttccggtaaaagcaaggggcaaccgcccgctgcccacatggatgacgcgagacgggcctagaggcggccccggctgctggtgggcgtcgcgatcgagcaagagagagactcgagacggttgtgctcgcgcgtcgtcggagctaagaacgaggagcgcacacgtggatgcgcggcgactttgcttgtgtccaccggcgagtccacgcgtacgtgcgcacgcctgggtgttggagttggcgaatccgtgttggcagtcgcggatccccgcgcggagaaaagctgcagaggctgcgggtggtgcagcttgcagctacccgcgctcgctcacggcaacgaccgatctccacgccacgcaacgcaacgcagcacgactgcacgactgcagctgcacgggtgttacagtgtaacagtgtctgcgaggcttgctgcagtggattcggctgtacagtagcgaaagccgtaggagcgtgcgccggtccagagcacagtcgtacttaaaaatgtaccccattcataaaaatggaaagtgtgatcttaaacatacacatttgatatctctagaatcagttttttttaacagagtaggagtacgcctcaagcagtggtagatgcgttgcgtgcacacacgattgagctagcgagctgcaggaacaaacgttaccagctgcactagctagagagagtaaagtattatatacggagtactgaacacactatacgctacacgcgctgtgactgtatgtctgtgacctttgtactgtgctgtgccagtgtgccgtgcagtccggccaggtctccgcgcgccgcgcgccgcgcgccgcgcccccaccacgtcgcgcgacgccaatcagtgcgtgccgtatgaacgtggcgacctctgggtcgatcacctgtcacaccgagctagctgcacgcacgcacgacgtcgcgatctcgcactaccggggccctggcccttttccatgcacgcgcgtacagcgtcgtatagcgcacgtatgcaggccgcgggcgacccccaagtccagtccagtcgctacgagctgaaagaaacacgctgcccccgccgcccaagcgcgcgcgcgtactactgttgctcgcttgcccggccagccggccggcgcgcggcctggccgcgccgcgccgtgtcgcgcagggtgcggacaccgaggctcgctggcacgcgggcctgtcgcgcgcgcgccgcggggctatccgatccgtgcccccaccacgcaccgtgtacacggttctggctctgccatactacatgaacactgtgtgcgtcatgcatgtgtgcaggcagcgtgcgtgacagtgtgagagcgccaacgcggtttacgtgtgcgtcgcttgtgcgcctagcctagctgtgtgctgcaacactcgtacagaatccaagtatgcagagaccggccggcgatcgatatcatttcgatatatgtaatttgttgcgtgcgggcggctgcatgctcatgctgagcctgctgcttgcaatgcatgcaggctactggtaatgtgccaagtggatgtgcatgcatgcatgagagtatgaaactacacataaaaaaaatagtcctagccctagcccagtgccccagtaggccagtagactcaaaaaaaaaaaatttgaccaaaaacaacgtatcaaatatttagacatatgcatagagcattaaatgtggatgaaaaaaaccaattacatagtttgcatgtaaattgcagagacgaatcttttgagcctaattacaccatgatttgataatgtgatgttatagtaaacatttactaatgacggattaattaggcttaataaatttgtctcgcagtttatcggccgaatctgtaatttgtttcgttattagtctatatttaatactttaaatgtatgtccgtatacttcaaaaactttacacccaaaaaattaaacacaccctaagccggcaatcgcgggctcaatgcgaaagtttctaatctctgtccagctacgagagattttacgagcatatatagaatgtcatatcgatcgatcatcatcattgctaatgatgccagtcaagcaacattcacacacatcctgctataaggacatcatagcctcacgtggcaacgtgttggcaagtcatgtactactacattgtacatgccttgccataacgggagctactccagctacgtgcagcttgggcaacgcatgcatatgcatccaatgcctggttcgcaaagctctgctttccatcagcgcgcaacaaaagcagccagttggaaaagggttttggttcaagaaggtgctagctagctagctagccatgtccatgcatgtctctctctctctctagctttggcaaactcccatgcaagaagctagcgaaagcgaaggcccgcccatcattcgccttctgatccagcaagcccacgccaactccttgtctctttctttcttgcactgcatggcatattggcatggcagctccaacgaatcaatcattgtctaggttccgtgaaccaccgccatctgctggccccctgccgccggcgccaagtctttcttatgcccatacctgtatatgacctcttcttctctagcttcgatcgatcttgccatttcttggagaatactagtaccagagagctgtcaattaacacaccataggtgctttacttttgttaattaggatcatcagatcactggaacttcttttagtagcttgatcatgaaaatgtatttcttcattttcatttctgaataagaaatagattgaaacacttgtctaataataaagtgatcgtgctaattcgttcattgcttagagatgattttttttcgagaaatgtgcataaggactgctcatttgtttgaagatatgaataaagagggagttcagctgatttgttaggctgataattcaatagctggggaacatacccacattgtctcacatgctctccccatcatattttatttcaccagcccccacagagagagacacataaagaaatgccagctccaatcatcacatgaacaactactactcgctgaggatcaggtgatgctacatagccagaaggccacttgtacagcttaatttgtagccagccacttgtttgatttaattttctgctctccccccatattcatttcttgacatgccagccagcttagctctcggctcttggggagaaacgcattatttctgaatttctgatgggtccatcagatcgtagctagtactagctagatagacgcctcgctcctgctgggagttggagttaatcagctaattatcatactgcaactcgatcgatcgcctcgtcgtcgtcgggtccccttcgtttcagagaagatcatttgttcagaaaagaaaactaaactaaagggttcagagacgatcgatcaatgcatcatggaccacagaacgtgtccctgtcgggagaaacatgcagatcgagcgatggctggccctgcgacgcccattgaccgcgatttgtttaagcaaggcgcgcgaggcgaaatttgtttagcgatgtgatcaggctaactgtggagactgatggagttcgtcagtcagatgggggcggttgccaattggatggcagagggccctgccttgttggtggtttgcctgcagagagttagagagagagagaggactgacaggagatgcccctaactaactgcattcataaccgtagtacctacctactcccggtaggtaagttgttttcagatctgcagagtttattatggctagagcactgctacatttactaatttttttactaaacttttactaacaatcatcttaatcatttaatttagagatgaaagttatgaaaaatctatatgtactcatgatatgacatatcgtttctttaaaaatttagtaaaaaaaagttagtatgtactagccttttccacatggctaaatgggttagtacaggcagcaaacctatctgctatggcagtaatctttttcgtttttacaagtgtgcgaggccgcatccacgttaaacgactaaatgcaaaggacataactacacagctaaccagctaccactctatctataagaggtatcatccacctatacttcaaataagattttctcttaaactactcatctgatctatgatccgattacaccgttgtgttcataataattaaatctttacaacaatatctcacatgattatatttcgatgaaaaattacaaattacttttatgatatgtctaaattacttttagactttactgaatttacttcttagacatagaagtaacttagtgaaatctaaaagtaatttagatatattataggagtaacttataacaaaagaaagtaacttcaattacatgcacggggttgacgagagacgacgccaggtcccctccactctccatgtcatcggctgacacatagggtcagatccagccgctccgaccattgagaagcgacggttgcgggcgacgaccactgcatcagggagatggaatttgtccaatgaaaaaaggcataaattaaatttactttcttttgttataagttacttctataatatatgtaaattacttttagactttactgaatttacttttatatatcttagaagtaacttagtgaaatctaaaagtaatttagacatatcataaaagtaatttgtgatttttcatcaaaatataatcatgtgagatcttgttgtaaatatttaattattacgaacacaacggtataatcggattgtaaatcggatgagtaatttaagagaaaatcttattttaagcatagatgataggaatatttcccctacttgctaaatggaataatagcaaccaaaacttctaaagtacaagcacatgggtgtctctaattaagactaattggagaggcctctccaaatagatttaccgaaatgcaaacctttgtttgtacacgtgattagcaagaaccaaaccatgtttcaacctgtcacggttaacaaggccatctgaactgaaggcccaatacgtcagcgagggacggccttcttcttggctttacttcggcggcggtacagcccatgtgtatttctggggtttaggcccacagcccacttgaggccgtggatttttgctggacttcggcccattttgccgcctctcctttctcctccagcaagccacctgcacgcgcggcgttccggcggccacgctcgcgatcctcctcggttcctccgcctccgtcagcgacctcggaaggcggcggcgcgcgtcgtcgtgctgctctccgccgcgcgccacccggccttcccgcagctccggatcgcgtccccccagctgagcatggaagtgtgagtgctctctacttggcttcgattgggcttggaagtgtgggcggagagggctccgatctgatcgtgttcgatcgctgtggcagggtggcgtcggcgccggggaaggtgctcgtcgcgggaggctacctcgtgctggagcggcccaacgccggcctcgtcctcagcaccagcgcgcgcttctacgccatcgtccgcccgctccgcgacgagctcagccacgactcctgggcatgggtgagccccgagccccagatttctcgaacaaactttactagtagcatcgcggagaattgctccttactctgccgagcacctgtaccatactaggcgtggacggatgtgaaagtgacctctcctcagctctcccgggaggccacctacaagctctccctgaagaaatcaacgctccagttgacgtcttcaaggcaagtcattgatcatttgctgggattgtggcagcagcgctctggtctgtagttgttttcggaattcacttttggtgatagtgttaacaacttaatgttgcagggaatctgcaaacccttttgtggagcaggcagtgcaattctcggtagcagctgctaaagtgactgtcactgacaaagaggggaaggaggcactggacaagttgcttttgcaaggttttgcgattttagtctgaagttttgctcctgtgcaaatcatgtttttgtatactatgctatattttgatttcgtttagttgttaaattttcatctctatttttttttgtaggtttgcacattacaattttgggctgcaatgatttctattcttatagaaaacaggtaaagcttatttccttaattagcttgcacgtatgcttgcctttagccttttgatgagcttcacagcaccaaccccaggctagaagtcaaaaaagaagtgagatttaacctgaacgtggccctagttggttatttcagctttgcgaaccacctaatcttaaacatatattttcttcatattccactaaagcagtaacaaactcatttgccacttgccagtgcctaatttatggattaacatgataatttactgaaaagaggtagctcaggtagaaccataagggagaagttgtactgtgctttgtaatcggtattttctctttgtatatccgtggaaaatgtttacaattcacctatctgaaactgcaataaattgcacaattatttagaggcattgctttgaggtctgttctttctcttatacagttaataaatttgatatttgttcgtgtgtgctctatgtggtcatgatatcgtttatcatgtaaacaaataaagattcgatgggcatgcaaaggatgaaccatttgtaaataaataaaaaaaaaatcagtgcagataggttgcacggttctataaactgaaatatactctcttcccatgtttaacttatgtgtgaattacaatgcagatcacccttaaagagttgtgccactgttaaataattagcttgctattttctatcgtttctccagattgaagcacgtggccttcctctaactccagaggtattgctttcgttgcctccattctgttcaattacatttaattcagaagttgctaatggaacaatgactggagaaaattgcaaacctgaagttgccaaaactggacttgggtcatcagctgccatgaccacatcagtagttgcagctcttcttcactatcttggaactgttaacctttcatgtttgggccaatcttccggtggcaacgcagctggacgagatcttgacttgctgcatgctattgctcaaagtgcacattgtatagcacaaggaaaaattggcagtgggtttgatgttagtgctgctgtctatgggagtcaacgttacacaaggttttctccagaaatattatcctcggctcaggtataaaaaaaaaaactgtcattaccagatagttgtctatctaaaaggttttctattataaagcttgccatatctgattggctgataatatatctgcacaatatttacaggttacaggtgggcactgcatggcagatgtggtggcagatattgttacacagagttgggatcatgagaaggttaagttttccttgcctcctctaatgtcccttgtaagttaaaaagaacttatgattgatgactaggtttcctaaatggtcaataaactatttaacgggctgtcaccagtcattagaaaaattatgggtatgatgattgccttataagatttacagcttgattagaggttagttgcacttctattgtgcctttttaaccatcagttcatggctgttttttattatcacagtttgtgagaaaatactgttataagcacgaatgctacaaatcatgcttgtttttttctcagtaagaaatgaacatgctagtttttgtgatcactatgcattcctcaaccagaacgtagtttgtaggtttgcattctcttaaaaatatctatccttttgatttaggtgacttgaaatgcagaacttttagatgaagctttaagggcactacccagaaacgcctttctgtttacaaggcacagcagagatcagacattttttgtgagaacgcaatatgaacaatctatccaatattctttgcagtgttatttgattgcttgttgccttattgattagggagattgtgttctgttcgttgattgtaaggataagtactacttctgactatagggaattttttgttagcttctaggggaacctggaactggaggatcatccactccatcaatggttggatctgtgaaacagtggcagaagtcagaccctcagaaatccaaggagacatggagtaaattggggattgctaattcagtgcttgagaaccaactgaggaacctaaacaaacttgctgaagatcactgggaagcctatgaatctgttttacgatcctgtagtcgtctcacgtgcagtaaggtaaataactagattacatattcttatatcaaacattcaatattgtaaacatataatatatttgtttcaatgggcaagaagaaatcatgttgttatggttaataatatgattgttaactgtttagactccatcaaggatcacggttatatagtgcataaataatgcaactgttatcctggaaaagtgttttttgatggaccagagcttgaaccatccaattttttaacagcatcttctacacaattctgatttctgaaatacttatctttgttgtttgcatgcttcttgttcttagttatcaccaggtgcatctgtgaatttggaaagagaactcgtctttcagtactatatgctaaaaccttttctctttgttcttgcaagtggacagaggtggctaccaatcaacatcaagaactaattgttagatcattactggccgcaagagatgctttccttgaaataaggcttcatatgcgagagatgggcatagcagctggtgttccagtaagacttagttccttttaatgaaattatggatgttgaagataacatgatcgattcttctacatggtggctggcatagttacatctagacaaattgtttagctattaatttgtagataatggggacattatagtaatatacacctgtctcgttgtcctcattttgcagattgagccagaatcacaaactcaacttctggatgccactatgaatatggagggtgttctactagctggagttcctggggccggtggctttgatgcagttttctcagtgattttgggtgaagcaagtgatgctgtagccaaagcttggagctcagctggtgttctccctcttcttgttcgagaagatccccgaggtgtttcattggaagctggtgacccaagaacaagggaggtgtcaaccgctgtatcatcgatacaaataaactgataatgttgtttgaattccgttagatttattcatgatgtgtacgtttggtgtctctttcatgtagcactagccaaacatgatatgttgaagaggctacacgcggacatggttaaataagtgctgtgcacggagcaagatatcatgttgtgacagattgatatgatttagccatgtgaaaatgcttgtaactattgaaatgtacgcatagaatgcctatttaagcattccaataagctcaaagttataggagttcgggcctttgatttcagaactcctgtaacagtttccatggtttttgttagaaataaaagctgttgtaaaagtttccatggtttatcacagaactggacctgtttttggcgtttgaaaggggttgtgacaatgtgacttgtgagctgggtcgtcatctcatctccttggataaggactgcttttagtgaggaaatgctgagagcataattctgcaagaaatgcgtccaaaggcttttcaaagttgagccttggaggaggcattggggctttcggctttagcttttcggaaatgcccagggtcaaggaatgtccctaggtgcgcactcttccttgggctacaaatgcttcaccaatcaaggtgcccagggtcaaagtattttcaccaatcaaggtgaacttctctgaatacaaggtacctgtcactgtagctcatcctgaaaactttggcgactacttttttattctgtaagcaataaatttataaatacttaaaaaacatcttatattatcaatttatgttgcatcctaaatgtaaccatgcgaattttgtgcatcatatctaactattgttatttgctagctgcatcataatcttatactaggctcccaagaatctaacaaataatgttggcaatagaagtcgtcgcttttcaaaattatgatggatttaacaggagacggcagcaaaagctggaggtcactaaaacggcggctggttggagagtagggtgcctaccatgtctaagataatgaggcatgttggtacaggggaatggtacgttacgtaccctgtgggagcatcggaatgaagccgaggcagtggtcgtcgttttcgctccaggtaacaccggatctttagcacacattccctgggtgcaaagctgtttctcttcgatggctcacctcgcgtggccatccatatgcaagatctgcttacgtagaggaggaatatatggtgaatttttgtctatacaagacttgaaaaggctcaaaagctcccgtggggatgtagagaccaatcaatctcgcgcctcccttcatagttgacatatgtctataggccaatcaatctctacgtagaccactttgattcaaaggaaaaacatagaaatttcatagaattttaattctataggtttaattttttcaaattattatttttgtctaaatgacccttacctcaacccataaaagttttggagaaaatttagcattaggtttaacctcatagaaactttctttcgaatctctctttttctcaaaatccttttttttctacggtctaacccaataactatttttgtttttttctatgttttacagtccacaattttacactttcatttctatcataatcatgtgttttttcaattgttgtgttttttcaatcatatgttttaaagtgggcagaaatcttattggttcgcacaaggttttagactcagtttgtggttttgtgctatgctgtgtggtgcttattttttaaaaagttttggcacatctgacttttactgtttatatgtatgtgaaaaaatattaaagtatcttgctatgaaaatgttttccctagaaaatacgcggatcattactaacaacatatctacaaagttgacttttcggaaacatcatgcattccacggagagagtaaagagaatttgtacaaataaacttaacaatatttgtacttgtgcctacagtaaatcagtaatcactgtagaaatattttgttagaggactgcacaaacattagtagttgtcaaatacagttgtaaatgctgatgtagtacgcaataatatatcagaaattgaagcataaaatctttcggcgtgcgcccacaaaattcgaaggaaaagtacactagcattatggatcagtattggactaattgataataatgcataacagtaaatataagggtaaattggatccgtgccattgtaaacatgtctatttagataaatgccaatacaattcgtctattcgtagccatgccactgaaattttataaaacgttttccatccattttgcgttgaccaggccggctggcaatctcctcctcgacggaaaaatggcgatggagcttgccgccgtctgacaatctcgccaccgccatcggaagaaacaggaggagaaaaattggcaatggagcacacctccatctccgagacaagacgagcttgccgttggaaaaaagatcacaattcacagggaggaaaacaaattgatgatggagctcgccgttgtctgagacctcatcgccaccacgacaagctagccattgccgccgtctgagaccttatcgccgccacgacaagctcaccatcgctgccgtcagaaacctcatcgtcgccacgacgagcccatcgctgccgccacctggggccacggaggaggcggcacacaccgggggcgatgccgcggcggaccggctcgcgccgtccgggagtgcgatgggcggctggacttgccagggatagataaaggagaaagaggatgaggacgagcatctcgcggccgctttgtggcccatggcgcgctgaggaaataggagagtagggttggcaacggggcgggttgggccagaacgcccccggcaccgctcccagacttctcccccggcccgggccccgcagagatggtcgggtgaataccatcacccgtccccgcccccgcaggggacccgcgggtgagtgggcccccgcaccacccggctgacgactgatgattgacgagcgaggagccgaggcgacgctgacgagggacaacgatagacaggtggctggggactgggcatcgctgccgctgtcgccgcggatgcgcctccctggccgccaccgcggatgtgcccttcatggccgctgctgccgtggatgcgatgctagcccttgccgtcgctgtcacggatgcgccgctgacaccgacgccgatggccgtgcccttggtcgtcgacgttgcggctcgtaagaggccgccaccgccgccggccgcaagaggccgccgcgcgtggccgccgctgccgccgctgttgccgtccatgcgtgatggctgggtggggtgggaagggagctcaatgaggataaggttagggtagggaatagatgaggaattagggttagactagatgggtcttttgggctcgtaatatgctattattaatagtctaatatacatttcttcggggacccgcaggtcacctgcccccgcccccgtaggggcgggtccccgaccctacgggtgaaattgccatccctagaggagaggatagggaagaagggagaaagaaagaagaaaaccgaaaaaaaaggatggatgaaaaatgtgtcagtattggtatggtcctaattttataaagtttcagtggcacgatgatgaatagatgaattgtaatactccctctatatcatattataagttatttgacttttttttaagtcaaacttctttaagtttgaccaaatctatagaaaaatatattagtatttttaacacaaaacaatcatgttattaaagtatatgcaatgttatatttaatgaaactaatttaatattttagatgttgctaaatttatctataaacttggtcaaacttgactagaaaaaaaaatcaaacgacttaaaatatgaaacggagggagtagcatttttctggataggcaaatttgcaatggcatggatccaattacccaaatatcaatttttgcatctgaaaattctctacccaggagcttccaacgcatcccttttacctttctttcggcactagaatatcttttcacattaattaattaacaaattgcaatgcatttttatggttgagcttctttctttgattcttccgaaccagaagaagatacgcaacaattcccaccgatcaagtatatacatgtcgttttctaggtggaaaaagatggagtaacaaattttgtatcatttgcagctttcaacgagtatttgtgctctgtcgaggaggggttctctgaaatcacagtacacagaaaatgcatcaccatccaaacagagctactcctacatgaattcttttctgaaaaggcagagctacacctgaatataaatatatgaatctgaatgtcccagactagctagtcaagcacagaacctctagccgacaacgactagtcgtcagaactctgaagaccactcgccgatgcatgctacagagaggctgacgaatgacaatgtccaagttgaatcaaatccactgccaccatcaccacagaaacaatatatagagattagagcctattcccttgatgccaatatgctacctggtgcgtgattatctcaggtgtgcaaccccaaagcagcttagcattcatccacttgggctagctgtgttttgtgcagtttttagtgtacataatgctggaggaggaatcatctatggcccccctcttttgtgcacttgtgctagacgttccatattaacaaatgaaattattccttatcatttgctttttgttcatgatctccaaacaagtgattttctaattcctctgagggacctaaagcctggtgcagtatgcatgtatattggtgttgggcataaagtctggctgtcaacttgactatttttcttatctgatggaacctaaatgtgctagactgatagtcatgggccatgccaaatatgtgagatcatatatgattggctcatctcttttcaatataaggtaaaagagatccagagtgcaaatctagcttgttggagcttttgctttaattactctgcgcctaagaaaagtgaaaaattcttttcagagaaaggggggaaaattccagactatccagttcctgaacaatgtacctgcatatatgttctagtggaagcatttttcaggccgactgctcacagctatctctttgtgttaatgttgatccacataacagcgtcaaataacaacacatacagttaaataaatattgctgtatttacgagtaaatagtatcttcagcactcaaaatgacactcgtgtttcagcaagtaaaaaaacatatgtcaaagtacatgtgcatgcattatctacctttcagaatcacccaagtataactggattttatacctcactaaccccggcacataaactaattaatctgtcgactgatgcaaaatggaatcgatccggcttatgtggcgaccaattaactccctggaacttaaaaaaatccaagaggccagcggggggtaaaataatggattgatttgatcgatcatttccatccagctaaattaaagcgtcgatactttcttacgtctgtcgaataaaacgccctccaatcgctcgtcgcggccgctgttgagctattctccgatcctctcgtggcaatggccgccgatcaggctgcatccttgcagcaatttgcagtttaattctcctttccattaagctttcatctttagcaagtcgcctcttaaattagtgcatatatataatctgcactaccatttgcagcagctcgcgacaaactagctaagaggctaattagatagcttacactcccctataaatatggctcagtcgagtgctcgcttggaagcagcagcagccagcaagctagagcactgagcagtgagcgtacaaacgatcggtcggccggcgagaagaggagtagaaagaagaagggtttgcgtgtgtgtgtacatggattggagcagggcggagaacgcgaggttcgagcaggcgctggccatgtacgaccgcgacacgccgggccggtgggagcgcgtggcggcggtggtcggcggggggaagacggcggacgacgtgaggcgccacttcgacctcctcgtcgacgactgcggcagcatcgagtccggaaactacggctaccccggcaccggcgccggcgccggccgcggcagcggcaacggcaacggcaatggcagggacaagaacaacgacggcaacacgaacaggcgccagagcaggtaaaaattactgacgcaagatcgatcagcgatcgatcatatcgccttcgatttcgatcgatcgaaaaaaatgacatattttcgctggcggctgcattagataggtcgctagtgaaaattcattttgctgatggtcggtgcccctcaccctctcgttacgagtttgctggtggtttttaaatttttccaccaataaaaataataagccaatattatgaaacatcatttttctagtagtgatcgaggtgtctctcatgattttatataatgcatttgtgcatgcagagccaacgggccgcagacatgacgtacggagaaatgaatgtgtgtcaacaaacaacaagcacgtaaagataacaagagtacgagatatgcatattatgtgtgctatatatgtgtatttacgtatacatatctgaatgtggtctacggctttggatattggaagcatctaccttgatagctgtagcttaatttgttatgtagtgagagtctgagagagagggaagagcatgcatggctagctgctggagtactggctaaagcttctgccatcgagcagtagtcagcagtggtatgcaactacgtatgcatgcagttgtcagggatgtaaaatgtatctggctctactttgtaacgtgtggtttgttggtcttgattaactaattaatgtaatggaatgcaaggtttggtttctgactatgaaagaagtatatgtgtttttgatttactaactgtcaaaataccttatcaaatttgtagaggtagtgtttctcttggtctctttcttggtttgaagctttaccactgcaactattgctagcatgaggcccttcacagggcgcttgcgtggcgagtaacctcgtcggtctagctacgccaaaccttgacgtggaggagaaaaggaggtgagtcccgtgtctttgcaagttttgtgcatcctattaaagtcccggtttcctcacacccgaaaaaagaaccacgcttgctactcctcaccaatcctccccatttcgaagatactctgcattggatggcctgtacttttatgtgtgtcttcatcacctttttcttaggtggaagctggaactatgggctatgggcacggtgcattactcttgccatgaagctcttctccttatggaatatagtcctaggtcctaacgacaaccttgtgttttcgtcaaccctggttttcattttaggatcaaacacaagtagccaagcttggggttgggggggggggtgaattggatgagggacatcaatgtgtgaaggtctgatggaccgtgggtgtctgcgggacatgtatatccgagggactgtcgatgtacggtgaaggcggtgaataggccgagagacaccaatgtgtgaagggtatgtggtaacttttcctcggtcaacccatcctccttattctttcttatattgtgtagctggcaccacaaataccttgaaacattattgttttcatccctagtggtggagctaataccctatttgagaagttttcagcagctataactacttctagaatatccagctcaaccaaatagcctatattctcattcaggttttgagaagcgatagctatagaatctaaagaataaactactagttaaaagccaaaaaacctagtttctatatattttcaccaactggatgcttataagctagttcttcaactctcgaatcggacctgaatttgtaaactcaactttgagtacggatataattcttaaaaagataaaagcatgccaatgatgctttaaaacccttatgagatcaattattagacgactcatagcttccattcaactctaattaacattgaccattcttggatctgtatctcctatacttagaatagattttaactctatttttattctgttcttataattttttctctcaccaataatagttctagaagtctacaaagcatgatactgttgaggatgctgtatagtttatgtgccgatgttagcatgaaacctaggtaggtatgctagtaccgggttggatctatatcccctatacttacaacatatttcaactctattttgattttgttcttacattttttctatctcactaataatagttcaagaagtctacaaaaagtgatacaattgaggatacgtccagatcggttgcatccatgggccatgtacagatcagtagcttccatgagggcgaaattgaaagcattacaatctttctactgattgattcgccttcgctgccgatcaaccctaataagctatcgactgcaaggctttccactgttccccaagcgccatcaggatatggatttttgttaattgggataagggttttctgatgttgaatattgccggtctgaatgtgtatgaacttatggattcacatgttcttatcaagcataggcaaaatgctgcttttttctagcagatcgtgagccctacatcgagttcagttactgtgtggttttctttaattttccatgcaaaattcatcagcgtacattttttttctactgaaaaggtagaaacttgtcaacattattacaactaggaaggaagcccgcacaactgcgccggcaagaatgttaaaagaagtcatatatcaccatattcgctataaagaccatagattactttaattataatcataaaagtaatatgtataccgtcaaatagacaaatgatattcaaacaaaagttactttatcccggttatacatatacttatctatcaccactacatattaccattgtcttaaaggtatgtgctcttttaatagatagaaccatatttatacttaaaaataaacctaatatatcaataatataataaagaatccatcttcacttcacagtgtccatgtcttacttattactccccccgtcccaaaatataacaacttatagcctatggaatttgtcccaaaatataacaacttctccaccaacattctcttctcaactaatcacaaccctccaccattcaattttcctacctaccttcacttctcctccaatcacaacaccctccccccccatttaatcctatcaactttcttaataaccgtgtccaactctaaaaatgcttatattctgggatggagggagtagatatgtaatcctgatctcctgtacacgtatgctgcaaaatctcctatatgtatagaaacctctctcctaatctctcctaaaaatatctcttgtatttatagaaacctctctgtcctaatatccatatatgtacgccataaaatacatactgttcaccaaaaaacctccatacatgcgaacaacatacttactgagcccgtcctgctccatgacactaatgtcatctactaaactatgtatgaatattaaaaaatatcgcttttatcaattaatatgataaaatcactaaaattatatataaatgttcctctaacgcatcaagcataacatagcccgtcatggttttcttctcttatgccttaaaccatgggtttcgcatcgacgttgccataccccttaagatcagtgtggggcacaatttcaacattcattgtcattacaataataaatgattgcatcagtaactaagccaactgagctctattaacaacagtgacctctcactggaccatcaccttagcaatattgtcatagtatttacaatatcgtagcatgccctgtcctccatactttgtgccctttagggaataacatagagaaaatagaggtaatgaaaatagttcttttaagttttgaatcgatttgtggtatagagtaggcacggtgtttttatggtattaatcagtactactaaattttagtggtacaaatataattttctcttttaaaacttagcagagttgatcattcgacactaattcagaaaatctaatagctttagtggtgagaaccacgtggaaaaatatttgcgcaagtaataattctttgcaaatatatgattttacatgggccttgatattattttccttgtattattatagatcttcctcacctatacatgttcatgggataatatatgatagaataatctgtgttgttaaatttatttatgctaattgttaagactatttaaatgagaatgacatgaaaagggatagaatatgttccatgtgaacttttttaataaaaatgtagttcacatatttatatatttctttaaaaagattagcgatcaaagtcagtaactgaatatagtaccgctgccagttaaaaagattatttggatgcgaaagacataataaaaggattataatattgttccatgtgatagtattttattcaaatatagttaaatgggatgtagtattttttttaattcataaatcctgtttaactatcatataaacatgagcgaaaggagctacggaggaggggctggtctaactgtatgtattacatacaaacataaaaatattttaattattaatttgagaattaggagtgaaggattggtaggatttttatcgtacttatgtttttttttctcgtgaatactcccttagtaaaataaaatccaatcttaaggataaatcttaggattaggttattttgggcacagggtttatgtattatttttttctcttataggaatacgtttaaagaggtgagttaaaatatatatgcgtgaggtgaggtaacatatgagtatgccgtgcttcaaaaggaaactaatccacgattgtgttttatatagtgaataaaagtacttgagaaaaagaaaggtaaaaatctgttataggtgggcttatacgtacgtacatgccgtatgattgttttttatgtgcgtgcatactcagagagagatattaggagggaggggttaattactcgatagatctaatctaatggttgataataacgggtccatcaatttaaataaaaattgatggttggatgttttgcttttttcttagaatttatatgattttctctatttattagagcgccacgtggtggcgtagaagcatttgtagaatatcacgtggcgctttgaaagtatttctaggaagtttaatgaacttttagtatataatagtttgcttttcaataacatcaagttcttctttaatctgcaagtggacattacaatagcttgatcgaacctaactgcaagctgtcactttcatgatcatgagctgtgcatagttgtatagtactctgcgcgaagaactattctacgtgcaatgcatagcatgtacaacagttcttcctcccagcttgaacctttgatatgttgtatgaagtctgatcgggtttttcatatgtacatgagtcgatctgcagttttcttaataaaaaattctcatgaaccctatctgtacgtacatgaactgtctagatttttctcttcttttgcataattgctacatcaatcactcaatctgcttggtgttttcatccacgaggtgcttatgtacttctccattgtctcggcactcctcatcagtcccagaagcagtacctctcaaccctccttggcctagtggcgaagtcagaaattatcgaagaatagggataaccctaaggcttaactaataagttgttcatattctgtaaaatttatatggtaatctatctatctatctatctattatattatattattaaaatagccttgaaaggagacaccacgttcgctgtaggggctagaaattcccacattaatcgaagaaaaagaaaaaaaaaagaaaaggagagtccaagtagaagtacaatctaaaaatagctgaaattcggaattaaaaataagcaatattaaaagaagtttccatataagaacccaatacgagattaatcaaaatttaaaataaaaataaaataaaatccaaaattagaaaaggaatggagagtccaagtagaaatacaatttaaaaatagctaaaattcgaaattaaaaattagcaatattgaaataagtttccatataagaacccaatacgagattaatcaaaattcgaaataaaaataaaataaaagccaaaattagaaaaggaaacgagagtccaagtaggaatataatttaaaaatacctgaatttcggaattaaaaataaggaatattaaaagaatagtccatataagaacccaatacgagattaattaaaattcggaataaaaataaaaataaatcctaaattagcaaaagaaaataaagaagagttcaagtaggaatacaatttaaaattagctgaaattcggaattaaaataagcaatgttaaaagaagaatccatataagaacccaatacgagattaattaaaatttcgaataaaaaaatataataatatccaaaattagaaaaaactaaaagagagctcaagtagaaatacaattttgaaacaaatgaaattgaaaataaaaaataaaaacattaaaagaacacaatacaatattaactatctttttgaaaaaataaattctgaaatagaaaaaaaagatttcaattaggaataaaatttataaataactaaattttgtgacaaaaataaagactattgaaaaaaaaagaccatctaaaacacatgacgagataaattaagtaacaggcctataaaagagtagagttggtggtggttgatacgacttataaaaattgttaataaaacaccaaatagaatcctaatgacgattaaaaggagggacgtcaggcaggccgtgaagcaaacaagtaaagcggttgccgggacttctagaaagtaaaaaagaaaaaacatattgataatcattttcgatttttaaaatctcaatgacaataataaaaaggagaagcagcgggcggggtgtataagagtatagttgcagagcctccaacggttgacgggacttctagaaaataaaaaatgaattgcaacgatagttatgttcgaattttagaatcacaatgacaataaagagtgggcggcggatgggctgcagagggatatagtgacatcgtttgatgggacttctaaaaataataaaaaatgaaactacaagtccaatgttagaacttctaaaaagtaaaaaaaaacaataataatcatgttcgattttaaaatctcaatgacaataaagaaggaagacagcgggcgagccgtagaggagtacaatggcaaaaccgctgacggtttggcgggacttctagaaattaaaaatgaacctaaactataattacgttcgatttttaaaatctcaatgacaataaagagaagagatagtggacgagacatagaggagtataatggcaacatttgacgagacatctagaaattataaaaacgaaacccaacgtgacaataaactcgaaaaactgtaaaaatccaatttttaaaggttccaagaagaatgaatagaaatagtgatagatcgagcaagcaaataaagaaggagatgacataaggggtagcaattggtgtaatttttaaaaactatataattaaaaacatgaggatgataagatttggtcttttaaagtcttaacaatgagacatctatttaataaattttaagtaaaatcatacttaaaaaatatatgattgttatgtgctagctacgcaattgcgtgggccacccagctagtttaagaaatttcaacatgattttggagtcaagccataactaccctaggcctacctccgcccctgcccctgtcatggcctcctccatcgtcgatgccggtgaaccgccgtcggtcccattgctggatcagttcaacacaatgaacacaattcagtttagctggctttctattattgagaaaatattcctctctgatttcaatcggtttattgcccattaacctaggtttgcaattatgaaaccggttcgtgactctttgaatgttccaaacccatccatgtcagtttcttttaaacccaagcttccggtgatgcaacttgaattccacaagcaagggtgtcaacttagggtttggcacttgttgcaactctgaaaattcctaatgttcttcctacactgtgcacaaggttagcaaaaggtcttcaatcgtatcattgttcttttataaaccgtagtaacgcacaaacaatttgctagttatatataaattacaagttgacttattataactcatcggcaattttaaatcgtctaaacaaacatataaatgtagacggtaaaaagtacttaaacaatatttataatgtgttataaccatcagattgataataattatcacactttaatttttataaaaacatatatatttttaaataatgtaagctttatttaaacttagttaataacattacatcaagagaataaaatctaactgagtgatccccgacctctgcatataatgcacaaggccaaaaaaatatatgaaagaaacgactagaaatatctcccaagtataaaagtttgatagaaatatatatcttagtggctagattagaccgccacctatgctctggataaaaaaaaactcatgcaccacctggtccaattgtcgtgacagatatttgtagaactatttatatcattttataatatctacatacatcactgaaaaccaaataagtaacataggttcttcgcagtcttcttatatattcacttaaaaagcgtctcggattaaattaaattgacaaatgatttattaattgcgctattttaggctatatatcgtctttcataagtgaccaccaaataacatatataaattgtgctacttcggtttatttcggtcactcccagacttaatagataaaaatatgatttggaaagccatagacttacccgtttaatagaacaccaacttttaaatttaactttaaaaattaggtctgaaatagactaaacataaacatagtttcacatctctaatttatattgtgagagcattttagccagtttcattttttaaggtggaactaaaatcgtttaatcgtttggtttggttttaacttgagtagagatgaagctagagtctaaggtcgtgccaaacggccctttagcagatcgaaaacgtgatttggaaagccaaacaacaaagcaacgtgcaagcataacggattgggtctcttctctcttgacttgtcacatccggcttgcgctggccgtcgcaaggccgccgcatactcttctcccctctttgactcgttttgcgcccaagtcgatccccaacgtctcctcctcgctggttcgcccgccgcgccgcgccgatctccatccgttccacgagcagcggtgaccgggtgctgtcgtcctgctccccgcttcccttccggctccggtgagcacccgtgccgacctcacatcctctctctttccccatccatcccgttctacccacgccttctctcgaattttgcagtaaccttatcttctcttctagatctggaagctaggttttcaccttgtcttcttagtagccttagttttactagtagagtagtagtatcaaccgccgtggcgcacgtatcgttcgcccctggacctgaggattacattccgtgtctatagttcaatccttgaccttaaggagtataaatttcattttggaccactttttattaccggtgttttgctttcgaccaccctttaatcaacgtattcactttggatcagataatcttacctttgttgcattttggactaccctaactctcttctcaagcatatgaacgatttcgagtacgccggctccgattcatcagtgaattcccaccgctttatacctggcaatttatttgacagatgacaagtttgatgtagatagataaaagatttgagtgtgctccaaagtgacacaaaggtaagattttccggttcaaagtgaaaatattagttaaagggtggtccaaagcaaaacaccagtagtaaaaggtggcccaaagtaaaatttactcttatatgaatttcaacattgattctgctctgcagccgatctggttgattgatgagcagcccattgccttttttggcagatttgaggcgctaaagtttccattccgtgttacgaaaagctgcattaggacatggacatggcattgccaatagtgaatgccaccgcagcggtgcttgctcgtgtctcagctgcattcaatgccccttttgcccgcgcagttgtctttggggttcatatcgatggtaagcctcttacgtccacatcaatgaggaacttgtgatgtgataagggcgatcgacattcggtaacattccatttttcagggcacctggttgttgaagggctccttatagcggtcatagtgtttcagctttctaggaagagctacaaaccgcccaagaagccactcagtgaaaaggtaaagttatcttctgcctgttcctcgctgttactttgtgttagagtattggttttggtcattgctttccagaacttgttggtgaaagttagcattttgatctttgcaggagattgacgagctatgtgatgaatgggagccagaacctctgtgtcctccgatcaaggatggggcccgaattgacacaccaatgttggaaaggtttgtatgatggttacattctaattaaagtttaaacggtagttgatgcaccatatgggagttcttttttcttactttaaggaagtttttatgtttgatagtgtctgttctgaaggtagtttcttaaagctccttgcaggaaataattcgttttcagtattcctctatattatttcataagtagtgagttactagataaactatgagagaaagcatgacaggattggggcagttgtaagctcaagcattggttaacttaactaggcagtgcagcatgtgggaaggcaatattgacttgaacctttattcttgacaaatactgcatgcaaaaagatgatttgcatgccacaaatctggtcaaattttagacgaatacagggcatcatgaatcacttgaagtatcatgtatcccttgctttccaaatgcttacaatcttctattctttaggcagactaacttttcttgaagttattatagttgattcgcaatcgccatctgctttctgtaacttgcagtatcttctcaaacatttttcctcttctttttacgacgttaataagaacatcaaatgacttaatacatgctgccaaatgcatcttgctagtattttgttataaaagttgtcctccatctgttataatcttgtatctttatccagttatcaacaatactccatttatgtgcttgcgttgcactaataatggacagcagctttctgaataatacaaatttaggagtaacttccagcatccctaacatagcgtggccaatctcaaataactctcactcgtagaatattcattttgttgcccttccctcagatattgcaatgcatgatatatcatctgtttgatgagtccttgtttatggatgtgtaatgctggaattgagaatgtttatgtttgcagaatacctgcaattcttgggcattgcatgttttttctcctgagttttgggggtcttaacactattacgtttcttgctacagtgctgctgctccacatacaaccattgatgggaaagaagttataaactttgcatcagcaaattatcttggtttgattggcaatgagaagattattgtaagccaaaactctattatttaggagttattttgacacttcttccaggatatttgacatgggtgaattgcaggattcttgtgttggttcactggagaaatatggtgttggttcttgtggtccacgtggcttttatggaacaattggtttgtatactctctttttgccaccactgatctgtgttgcaaatatggaagagaaacttatcttttcattgtggaacacttgcagatgtccaccttgactgtgaggcaaaaatagcgaagtttcttggaactccagactcaattctgtattcatatgggatttctacaatatttagtgtgatacctgccttttgtaagaaaggagacatcatagttgcgtaagttaaccttttgcccacatagtaatatgaacaataccggcacatatagagtttgtcctctctttttttttcagtacaacagcttatataaatgttttagttattcacattttttatatacctgccttttgtaagaaagaaatcaaatgaaaactgcttccttgccccccccctccccccccaaccaaaaaaaaagaatgaaaatcctgcacaaaccctttagaaagtagtgtatatgtctgccttgtgatcttcaaagttgtcacctcttacatgtatctattctttagttgttattcttcctcatgcaattagctccatacctggatagttcttttactaggtagcacttttcttttcttgatttttcatgtttgaacctaagcaagttttctatatgcattgcagtgatgaaggtgtgcactgggcagtgcaaaatggtcttcatctgtcaagaagcactgttgtttattttaaacacaatgatatggcttcacttgcaaacactttggaaaaacttacacgtggaaataaacgagcagaaaagatcagacgatacattgttgtagaatctatctaccaggtgtggtgccttttatgataactctgattggacatgagtatggttttttctcatttttctcatgaatttttacgacctagaaaatcatgaaatcgtttaaacatatgactttggatatatcctctcttactgtgacgattgcagaattctggtcaaattgctcccttggatgagattgtcagattgaaggagaaatatcgattccgtgttattctggaggaaagccattcttttggtgtgcttggccagtctggacgaggccttgctgaacattatggagttccagtgagtacccctgacatttttgttctctcatcgcaccaaagtagaagattaaaaagaataggtataatccatggagtcctggtagacacctgttaatttatgaaaattgtgttactgaccattttaattggatatattggcacatcttatttcttacattttcttgcatgtgcagattgacaaaattgatattatcactgctggaatggggaatgcattagctactgatggtggcttttgtacaggaagtgttagagttgttgatcatcaggtaatgcaactctagattgacggaaaatcaattgcaatagaatgttgttaaatatcttgacctattaagttattgtgcttttgcagcgtctaagcagttctggctatgttttctcggcttctctgccaccttatcttgccagcgctgcggtttctgctgtcagctacctggaggggaacccgtcagttcttgcagacctgaggagcaacatttctttcctgcataaaggttaagaagattatcttgttatttatatacttatttgaccaacatttacttactttttaatgtgattaatgtagatgtaaagtttttaatgctttaatacctagcatgtaatgttgtggcatcacttttatcatgtatttttcccattagtggtagtttcaaaacagctgcattgaaattgtgaaacacattatgggattcaatagttgaatttgttcaggcataatatgtcgttactggtgcctgctgatcaccttgatgccttcgatgttttttatctgcagaactgtcaggtactccaggacttgaaatttccagccatgttctgtcacctatcgttttcctcaaactgaagaaatcgacgggttcatcaaacaccgatatagatcttcttgaaactattgctgagagggtaagtccatgtcgacacaacagaacctttccagctgcaaatgaactttcacttgcatatatttacagcatcctatttccaacaggtattgaaggaagattcagtttttatcgtggcgtcaaagcggtcacctttggataggtgcaaacttcccgtcggaatacgcctcttcatgtcagccggccacaccgattcagacatctccaaagtgtcctcatccttgaagcgggtctcagcatcagttctgtcagattacatctgatcccctttctctacgagctgtgcactaatctctgtgtgcatgtttggttaatgtacataacctgtacatttgtaggttccgatgattcccgttgccgctcatacttgcaaacacttcgaaaaatagacgtagaacagtgaaattaggtgtgttatgtatcgttcggtcttctggtagtggtttcccggtagaattcattctatatctttaattttgtcctctattcatcacttttatcattttggcttcaattcatcactttctggtggatttatattcttttttttagtgtagattggttgcgcaaatggcgaaaagaccccaaattctcaaatcggcacaaatcgtttccaggtttcatcttacccaatcgctccttccttgcaaatccaacctgagcagccatattaaccaaactgaaagcgctgcctatcgaacaccacaggcggagacgatggatttgtgccggacaaccggagcacgtgcaacgcgtccatgttcagcacaaaaaaatataactacttcaagctattaggacaatgttatatccaaatacatagaaaaaatattgctatattttggaatggagatagtacttccattcaaatcatgatatatataaatattaaatttgaaaatgtacaaggattgttctgtcttaaaaaagaccaatactacatgcaatttcaaaacccgcagcattgaactattaacaaaaacaagcgccataacacgtctgatcaacagcggtaacaggttaccatatgcacactcgtttttgagttcaaaatacaccagacatcttaataagttagataaacatctgattaatttttgctagagtagcaacattctcatctcgctttgctcttcttaagaagctttggatgcagcacactctgcgcgataagctttgaatgcagcacgctctgcgtagtaggccggtacaactagatagaatggaataagcagtgagtaataaaacataagtgatccgatgtgcaaggcataagcagaacatacaatataagcatttctaggaagtactccctccattcccaattatcattatattacatgagtgcaacaagaccaagaaaaactacgtttactgaggtaacaaactcatatgagccatcctcactatgttctacccaataacaaacaagacatcacatgtccattacttccatgcacaaataatgaatagacttaaaaaatgaatactagtatgatgatcatttcagaataacctaaaacaattgtacgatgatcaattggaaaaggaggggtatcctaagtttgatcaaatttgtagaaagaatacatcgaccatgtcaaataagtaaactacaaatgatgctcatttgatatcacaaatattatcgtttcttctataaacttggtcaaacaacaaaaaaaatattatactttggatagtagtgtttactagcgcaaaatgtatgctcccacacaaatcacaaaaaaggacatgccctcattgttcggttactcgtaaaaaataaatcacaaaaaaggacatgccctgccccttgtgctcatcaaccaattggagcagcatttctttcctttccaaaatccagaataccccctaccctttcgacaacacggaacccccacacctttttttttaaagaaaacacagacacaagaaagaagaataattgattgataggtagtataaaaggactcacctgcatctatctttgggtattcccgacgatgacggctgggtatgaacatgcatttgcaaatatggtcagaagtgcctactgatagttgatcacagcaaagcaatccaaaagtagagctgtgaaacttacaaggtgaaaagcttcaaggttagagactgaagttcaccagctagaaagttgttgtcgtcatggacaacgtggtagcggaccacgcgggaggttgactacagtcaaccaatactagctcaatatatttttttcaaggatagacaactccttatgagtatatttgcagattcaccaaactaaaatgtaccttatgagtagtatggcggcaaaagaacttatacttagcggtgtcagcctcagttcctatgaaacaatacccagtcaccaaagccaagtagcatgtatgtgtattcacctcactcggtaaaaaggaaatactacaagcagaatcagcaaacacactaaccaattgatgcagtaggcaccacgaccacatatgtcagtgatggttgatcttctttgtaggaataggcacaagcctttcaagggaagaagcacaaaaccatcaaaatgagcaagtcaaaccaagatacaggaaggcaaatcatattgtattcctacctgtttaatagcatctatttcttgcaggcaaatgcgctccatctcaccttccattaatccacctctgtgcaagatgttgcactgttagcatatatctaatagtatcacactaatcaaggaatacaagtattactacctgtagaagattatcctcttgggtctttcttttatcattttgtagaaggaccgaaagaacttgctggaaaaaaaatgaaaaatgttagtacaccaaatggatcaaagtgacggtgagctacagattatgtagaacacagaattacgtcatcatgccaccacgtctagaatggagatttatgatgccattatgaggttgatgtgaaattaatgtatgatactttctgaattttggccagtccaatgaagccgccacctacatgactccaacaaaaaatatgatgccaattggattgtgtaacaacaaaacgcaaatccaggagatggtagttacagaagagacatacagatgcaatgccctctgaatccactcctgcctctgaatcctctccaagatcatagtgtatcgtgtgagcaccaaaaaatcgttgggacttctgacacaaggggtaagtgcagtcgctgacgacgtacataactctttacaacctgattaataaaccaaaaacatgataacactataacaaacaaaatgagaccaaagagaaatgaccttcaattgtatttggcgtgcaactctcttcagattccgtttgcttaggcagggtaaacagaaaacataaacaattctaaggctctcacacatctcttcaatttcccctgcaatatatcatatgcaactgtcaaaaaagaaaatcaacagtgaacctgacacaactaacttccataccatcataacttctatcatctgccataatcacaattagaatgtctatctttttgggcacatccagcaaagtacgtcgtatatgaagggaagtaaggggtacatcgacatccatttttggtaatgtaccaaattcctatcatacaaagatattaagtcagatgtgtggtacatgattagtagaatgccttgttcaaggaaagtatgcagggctttaccattcccatgtctatacactttcctataatgtcactgacaacccgcgctgcatgtttacgcttaggtgaaaaatttacacatgcccaacgtctcacaattccacgttcgacctaaaagggaacaaatgcctgtttgagaatgattctataaagatattatgaatcatgacgagagataaagagagttgcatagcagtgaaaataccaaaaaccccaaacgttaaaactataccaagaatccatcagccaagtatgttcttaggttgccccaatcatgtttgtcaactgttcaaggtaaatattatattcagactatcagatccctggttttgaacacaactttccgattatgtggttctcatattgttttgtgttggaagacttgcaaactcgcatcaagcacgcaacattaactatcatacaagagttgtaacacacaagctggtatagtgcacatctcatccgaggactatatgatgcataatttgatttgagtatgcatgacattttgtttgatgatacttagaacatcatcagcaaaatatttgtcctcgcggcattatttgaacattgaagaaagaaggtgaatcgacaaaccaaatatatacaattccgaaacagaagaacacactgattcaaccacaatatcatggcatcaatcaagtaaagtagcaaatttacaacagttgctaggctgaggtggtgatcaaaaaagattttccaaacttcagttgtcaatgtccttttcaatattcagattgatagcatgaaaatggtatgcacatatctctatagtaaaaattgttatcgaaaggtccattaggtctaatagatctacaagaacagaaatcttttgacagtgttaatttctaaaacaaccttatgagtgaaggaagtactaaataactagcaatacctgcagctcatcatagtcatgactgatgtgattttcccatcgcctcacttcaggagtgttacattctgcagcaaccaagtccttatcctccacaggcatgttgctgagtttgtagtagccattggtgtcaaacaccttagagtactcatcccaagacacgccgctaggcttcttgtatggatgttgtgtttcccatcctgtcttgagaatgtgctcgcgttcccctggagacagaggaagaagcaagaaagcataaacaagaaaggacaatcaacgcaaaataaaaagggcacaacgaatgccacacgaaattattaagaaaggtgaatggactagactgggagatacaaaagagttaagaacaagctgctggcctagggtagattgattaactttggactagaccagaaactgagttttaccagggcacaggaaggcttcaaatgaaggcggttcacttaactcagaataagtacttcctgctaacgctgtatgagtctctatttccttgtaggttttgaggcagccttctgcgctattggcggcctgttcatgtccattctcttccagccgctggagctgtttacataattcatcattctctctcatctgctgcacggaaccatcatcatccatctcttcatcaggagatactggtacatattcatcatcatcaccataatcatcatcatcatccatctcttcatctgatgtagggaatgcttccaagtaaatgatgtctgagtcagcatctcccatatcttccaaatcacttagatctgactcactatcttctctcatctcatcagaaccatagactttctcagagtcgccatttaccctcttctcctcacaagaacaaaaaagtgttttgccctcagcaacatgattaagaaactctagcatgagagttgtgcaaaaggaaaaaagaacaataacacatcaaacagaatgagagagaaaccttggaacgaatattgtgagcaacattgttcaggtatagcttgctgggtgtcctagcatgctcaggcaaacaacattgatataagaatccaaggttcttacagatatctttgactttcgctgcaaaacatcgcatgcaactgtcaacaaaaaaaaaagaatataaaggtgcggttgatgcaaatcataacttccataccatcagaacgtctgaattctggaagaattacaattagaaggtttatctggtttacttccactccttgtccgccaaacagttcttgcacatcatgcaaagtactttctagtttattgggagagttcaagtctacgaacactgcatgaacagacttcaaatcctattatgtaaagtcaatgtcagatgtgtcacatgttgccaaagtaatggtgcccaggaaagagtggacggatttaccatcccaatggccacacacgcttttttgagctcagatgcaaatttctgtgtttctgtagtacccattaaagaaaaatttacacatgcccagttttccacgtttgctcctttgacctaacatggaaaaaaaatataaatgtgagaatgctctctaatatatatgtagtacagaaggtaaggagagtcgcataacagtacgagtcgtcacaaagaagatgacatgctaagtgttcaagcagaagtgacaagagaacatcttatgtggtcaaggtcttatttgaaatcattcataagctaatggagcttgcatgatggtatactagattataactttgaagttccaacggcaaatctattttcatagcaagtccgacacccgcatgcactgcaagtaccaagttcatgtacaagaattaagcgtcactaaatggaatcagaccactattttgtatacaggacacatcctgaaacagtagtagtagcattcaaaagtagtgttttattttggtcggccagcaagatgacttgcctcggatttgttcttcttggctacatgagcaccatacgctgcagaacactcatcatacaggagggcagcagcatcaggaggaggatcttgatctacaactctggaacactcattatccagtagggcagcatcagtaggatccggatcctgatcttgatctacaagcgaggcagcgaaggctttgtcctccccaggatcttccgtactgaaattgcatcggccattgttgccgtctttctcatccatggcctgtgctcctaatcctgcctccagatagcctgatcatgagagagtaggagacgtttatccatctataatctatcttgctcaaacgaacgcaaaacgaaaaacagcatgaatatatcacgaggatgcaacgaaatccgaattagttagagctaatgataatgataaatcgattaataagaaatacgagatcagaggcatggaggaattaaacctagttaatttaccagggaccaggaggagtgctccgggaggcgacagcaggctgtagggctgcgtgcggcgcgtatccaaccgatgctcctgaagggttttcgacttgtgttgatgtatggaatggaatcgactgcaacggaatatggtaaggagtattagcccacatactctaaaaaaggtaatagcccaaacggcgacaagtttttgggccaaaaagttcatgtttggcccaaactttgattacctcatgggctcaaattcagcttaaaccaagtcaggccgatccacttggaattttgagctggtgttaattaaaccattaattcctctttgcagaacaactgcgcctcacctaagcccaagaaaataagaacggcatctgctgctcggatgactgttggctgcttcgatacaggagtactttttttatctgcacaagttagaagtagaactgtcagatattgcaagacttgaaatttgaagccatgttctgtcacttatcgttttctttccttaagctgaacaaatcgacgggttcaccgagcagcgacctagatttttcttgaaactattgctgagacaacagaaattttccagctgcaaatgaattttcattcgcacatttccttttaccaacagttcttgaaggaagattttcttgggaatacagtttttttttcacctgtaaaatattttcacttttattcttgggaacaccgaggattcatacagtcaaaaattttcaggccgtttgggtatttggtaagggtaagacatctatctggctagtcattgcaacaaaaacgaactctgaaacagaacgaacatggcgaaggggaaaaagatgaatagacccaaatctgaatcacaaagccatatcgatacggagcctaggcaagccgaatctctcgcagggtgttgaagcaatgagccaatgatgtgggctgaatgtacagagaaaggagaagctgggacgagagataaagggtcggaggcagagtatggaccggtgagtatgaggcgacggcgcagatcgttctcgccctagattccctctccgcttgtatcagctcttccttcccttatggatagcgaaggtgggtagacaacggacccggcgtgaaccgacgctggtgcagcagatggtggtgaggatcgaggccggtttgcataagtggcgcagagtagtagagatggttgcggaacggatcgcggcggcgccggcgatggggcggcgcaaacgtggcgactcagcggcaacaacgaaacgaagcggagagtggtgtgcggtggcggcggggcagagcacggagcgtcacggagtagcgggctcgacggcagtcgaggctgcgaggttcgatatcggacggataaaaatttgtgccccatctgcggttaatttacatgctaaaacggctgtaaagttttggaataagttcaccggccatccctcaactttacgtcaagtctgtataaggtcccctaactgcaataccagaaatgtatacttctaaactatgtaaaatcgtaaaaaaaaaaggtcccgggacagtatagatgcctggtttcgttgacgtgacatcctagtcaggaaaataataaaattgatatgtggggcccacatgtaagtgagagaaaatggtgtgggccccacatttcacttttctttttttttctcttctcttctgtcgttgattctctcaagtagtcgagcgggcgtgatggcagatgggggaga

SEQ ID NO: 59760 - DNA, 642 bp, Oryza sativa
acacgcacctccactactcctggatattgcatggtatatccaataatacgacgacttaaccttcgtagacagtgttattcatgcttccatcaccatttatccatggcaatattgggtgatatatatgcctttcgcaagcatgacaacaatcactgcccctgttgtcttgtgctggagtaaacgaccttttctgacctacaggactttgatagcgtatctgaggagagcttgacttgctttggacattaagaaccgtcacagtgtgcccgtcaccaagcatttttacactcccttgcacatcactagacattgcatgcttctctctcagtagattttctgtatctccagtctcggccatctcaaaagcagaagctcgcaaacaactgcaatgacttgaatctgcaagtgtagttatatgatattttgacttatgtatagagtcaacaatctgcacaccatcatatgcattgacctgtgaagcaagaaaatagagtgacacctatatatgagtagggaaataaaaaaatgtggacaagaaagcagcagtaagtgtagcatcttatatgcaagtattccactcttaatcagtttgacataaatatttaactatcccaatgatgttttaaatgtttatataaaatt

SEQ ID NO: 59761 - DNA, 596 bp, Oryza sativa
ttaaatcctatccaattctttgaaattcctatggaatgcacaatcttatagagattttagagaaaatttagcatgagctttaacctcttggtaatttttctttgagtttatctctctcatccaattcctgcggttcaatcaaacggtaattcatgtgtttttcttacgttttgtaatcctctgttttacacttatatacctttttaaaatcctgcgtttttcctattcttatgttttcttaatcctacgattcaaagggccgttaacatactatacggatcgcaaaacgtagaaagaaatcactggaacgggagcctcacctatgatgaatggcatgcacttccaaccttgcggcgtcttccccctcttgcctgccacaacttcaccaccgacgacacccccgttctcaacggcgccgatctccatctccgtctccaaagcgtaccctcgctaccacagcaaccaccaccaccaccaccgcgcggaacggcggaggccaaccaaaacaccggcgaaaaacctcgctctccgcccgccggtgcgcgcgccagccagccagcaccagcggcgccgcgcgtatgtgaaagtaggcaagg

SEQ ID NO: 59762 - DNA, 5034 bp, Oryza sativa
tgttttcttctctagcttggctagtctgataaacggacataatttcttctctctcttcagaagaaaaacggaagcgtttcagtatgattcggatctgaatcacacactctttgtcatgtgacagactgacaggttcgttgattaatactccaggggtaagcactaagcacgggtgcccagcctttgccttgcgttaccaccagcaattgacatttgacagcgatccacttagccacggccatggagtccaacgccgccgacgagctactgctcgagttggactccctacgcatctaccggagcggcaagatggaccgcctccaccatcccgtgcttgcgcctgccggcgtcgacgcggccaccggcgtcacgtccaaggacgtggtcgtcgacgctgacaccggcctgtccgtgcgcgtcttcctccccgcccgcccagatccgtccaagaagctacccgtcctcgtcttcttccacggcggtgccttcgtgatcgagtcggccttctccacgacgtaccatggctacgccgcgtccctcgccgccgcggccggcgtcgtcgccgtctccgtggagtaccgcctcgcgccggagcaccccgtccccgccgcctacgacgacgcctgggccgcgctccagtgggccgcgtcggggaaagacgagtggctcgccgagcacgcggacaacggccgcctcttcctcgccggagacagcgcaggcggcaacatggttcacaacgtcatgatcagggcggcgtcctcccatccagcgccgaggatcgagggcgccatactccttcacccttggttcggcgggaacgcggtcatcgaaggcgagtccgaggcgacggccagggacatggccaagatctgggagttcgcgtgcccgggcgcggtgggcggcgccgacgacccgaggatgaaccccacggcggggggcgcggcggggctggagaacctccggtgcgagagggtgctcgtctgcaccggcgagaaggactgggccggggcgcggggatgcgcgtaccacgcggcggtggccgcgagcgcgtggcgagggagcgccgcgtggctggagtcggaaggggaggggcacgtgttcttcctggagaagccggagtgcgccaaggccaaggagctcatggaccgcgtcgtggcgttcatctccgcctcctgagtccacctgggccgccgattaggtgggggtggattccggcgagggagggggaagtcgaagcggtcgatctgagcagtgtgtatgcaaattcttcgaataaagtggctacatgtcaaattgatatctcaatctgcgccgcctaggcgaacggtgcggtgaagcgggacagtgcagggcactgtggttctgttagggctttcacagcgcagtgacgtggcattcagccttgagcttacacatagaagattttcagccacatctgcatttctcgtgagcaaaccaaaaacgtgtgaccatattgagacacacgttcttcatcaaccttttgtcagcgttgtcaggcactcaggctagcccacactcgaggctgatgctagccatggccgtggatgaggtagatgagtcggcgtctgtgccgcttcggaggagaagcgccgctgacctcaccgtccgccgtccctcgctctcacgccgctgacatcgtcgttgattcaggggacgagaagaggggtggatctggccgctcttcaaccgctcatgtgccgccgacctcacagtccgctgctcttgcaccaccgaccttgttgtccaccgtggtgaatcaggggacgagaggaagggtgaatatggccgctcttcaaccgctctcactccatcgacctcgccgtcccccgcggctactccacccagcaccaatgccaacaccacttgggccaccccaccgctgctccgctacgagttcgtcgccgccggtgagttgaggtggggttggtggggtaagggagagggggagggagctgccgccgccggttggggcaggggcgcagctacggggggtgccggagggggccaacacccccctatctgccccctccctgctatactatttagcgcattagcatgttaattagtccattatcaataaacatgatatagaaaattaattaataagaaagagacggagagacaacacaaatcaactcctcgtctaaattgcttcggcttcacacatctctccgtcctcccattgcatctcgctgtcgagcatggtgactcaagtctcaaactgtcaaacatccaatgatacaactaaagagctaaattcaagctttttttaggcagaacacatgatgccctgttttgtcgttggcatagcttactctgacttatgacttgttcgccctgcccacacccccctaactatagatcctggcttcgcccctgggttggggaggagatgggtctggagaggaagagaagggggcgagggagtcgccgccggagatgagctcgcaaatctgcggcgtcagtgtggtggggagggggagaggagggggcacgtgggagccgagtgagaggaagagagaggcggaaggggaagaaaaggtggtggggccgacctgaaaagaaaaagtggtggacccacttaaagctacgagtgcacggtggagaggggagcttcgactgtttttcttcttatgtggacatttgggctcctcaataagataggacgcattgctattgcccttaaaggggtatttggataaataaggttagtaggcaatctataagaatatgaagaatccaagaagcagttggttgatatccgtttctaagaaactcagtttttatcttctcggttattttctatatcttataagtacaatttcacaaaatctagataaaaagctaaattatttggggagcttttaattcgagaaatttcaaaatataccatccaacttgtagcacgttcaggatcaaccatccaatccgtgtgtcttttagaatctgccatcacaagagctaatttcttcatttcgcgtcattccgtccatccgaagcaacgttgtccatccatccgttgccatgtcctccgtctctcgccattgctcgtcgccacttccagcaccgaggtcagggatggcggccgagcatgcggataggcggacgacacgaatggtgacagcggcggacgagctcgggtacggatctagcggcgacggtggccgagcttgcggatggcatgaatggggatggcggtggacgagctcgggtacggcgctagcggcaacgagatgcaaggtcggggacgacggccgagttagtggacggtgcaaatgccaaatagcgacggcggtggactagctcggtgctagatgcgacggcggcagtggtggccgagctcggagacggcttcgcgcggacgggcgtcggacggatggatggacagcgctagcggcaaccggacggagtggcgtgaaacgaaggaattcgctccccccaatggcacgttctaaagtacacatggattggatggcaaatcctgatagggctgcgaattgggtggcatgtactgaatgtagctgcataagctccccaaacagacatttataagtgtatagtgcagcttctaaatagtctacactatactgagccacatactgtatgtttgccacccgtcagaaaccgttccttgcgaatgcgcgtatgcacgaattagcatttctgatctcctattgcctttgggagaggaaatgctttggtatcgcatcattgccttccacaagtggtggttcagcttcatccttccaggagcagcagcagcagagccatggctggagctagggagccaatttcctcagccagatttattttgtttatacatgattggtcgatacagatttgattttttttcagtttttggcaatgctacggtatacttttacccagggttggaaattttggactgaaatttcggaaatttctgtcatttcagtcacctccgatacgatattatttcggctgaaatttttcaattttttaaatttttcatgaattggggtaatatttattcaaattcaactaaattttgcttaaaatttcggaaatttcggaccgaaatttctgaaatttcgggatgtcggtaacccccgatacaaaggcatgttccgatagagtgaaccctgcttttacctctctaaaactcaaattgtgcattggtttcatcaattttgtggtgctgatttggcttggcaagggtgtatagttgttgtttcagagttcagacactgatccaataagaaaaacaacccaagtttgtaaagctgattgctgaataacgatattgtgcattagcagaagattcagtatagtgcaggaccacaatctggtgtagtgcaaactacaaaaagcccgacccggcaaaaaaactacaacaagcctgtctcagttgaagggtcttggttagataattcagtgtaggtatactataattgattgaattataaaaacactgttcagaaacaagaagagtactcctacgcaacttccacggttacttaatggtattgaaatcatgaagtatcagtagaatgtagcttaactaaccagaggcatactgcgatttggccatgactaatatgcatgcgtaacatccttgattgctgccgctcttgtttatctttcttgcaccagtaatgaggaagtatttcagaagcaatctgcgctcaaagcacttcaagctcaccttgtgattaccttcggtgtgttctgacttggggctctgctctttcctactagtagctgcaaattgcgatgagaatcgatagctctcttgcaggcagcgtataatcaaaggttggaaccttctctcataaaggtggcttagaccgtagcagactagcagtgtgtgttttgtgtttgtagtgccaactgcattcccttcatatcatactacattactgccaagatcaagaacaaaaggttgtgctcgtttctctcattctctcactctcaccatcgccatgcctggatttgcccaagaatttcaggccaacatatgagtatattaggcct

SEQ ID NO: 59763 - DNA, 1522 bp, Oryza sativa
cattgtgaaacggaggaagtaactagcaccacggtggtgtgctagtcgacgggattcgaactcaggccgtgtttactttcatgcccaaaattattttcacgtatatggatacacatttgaagtattaaacgtagtctaataacaaaacaaattacataatcagcctgtaaactgcaagaagaaattattaagcctaattaatccatcattagcaaatgtttattatagcaccacattgtcaaatcatggcgtaattaggctcaaaatattcgtctcgcaatttacatgcaaactgtgcaattagtttttttttgtccacatttaatgatctatatatgtgttcaaacatttaatgggatgaaatttttggaagtttgaagggaactacaggcaacctcactcttcttaaaaaattctaatatgagagtcccttcttatgtatttattgttattgttttcttattacagcgagggaacgagggatctggcatccaatcaagggaacacaatggaaaggataggttccctctgttggtgtgggatggatgctccggacctctagccgatgggcaggaactaggggtgaaaacgagccgagccgaggctcgtgaaagcttggtgcaagggaagctcggcttggcttggctcgctacaaacacgaagggatggatcgatctaagtgcaacactgaggaaaggaaagtgtcacatttacatatgatgtctaatatttatgggattgtctatctaacattagtgtaaatataatataattagcatgtaattacaatataactctaatgtaagtggtatgtaagtcggtgcgagagaggggcaaccgcaatccacaagtcacgtgtcactagtggagaaatcgtttttagtcactagtggagaaatcatttttagtcccggtttgtaacccccaatagtcccggttttcaaaccgggactacgaatccgggactaaagatcgatctttagtcccggttggtgttaccaaccgggactaaagatgggagtgggcaatagttttttttcattcacgcgctatttaatctctaatttattttctcccaaattaggtgggatgcgtaccatcccaaatacataaatcaatcatatacactacagattatacatcccaaatcaaaccccaaatcaaagaaacatcccaaatatacaaatcatacacaaatcatgtacatctcatatccatacaatgagattccaaaaaaaaaattatacatctcaatccatacaatgaaccacagattcttcatctcaatctacacatggatcacaaattctttaaaaaaaagaaaaaaaatgaagcaaagccgccggccggctgagccggctgccgcctcccctcctccccagccgccgccgcactgccctccgccggccgggccacccaccccctcctgctgcgcacactggatcgagttgggaaggggagttgggaagggataagaagaaaaagagataatgaggaagggaagagataagattagagatgg

SEQ ID NO: 59764 - DNA, 8753 bp, Oryza sativa
attttgttagttgaaagaacataaactcgataagcccgagaatgagtagcatagccaaggaaaatgccatccaatgatcgagattcaaacttgtccaaatttccagatttaagaacaaagcatttgcaaccgaagaccctgagatgtgaaacttttggtcgacgaccaaatctgagctcatatggcgtcttgtgcaagatagttctcaaaaacacacgattggagataaaacaagcagcagaaatagcttcagtccagaactttcttggagtcgtaaactcatcaagcatagttcgtgccatctccacaagggtgcggttcttcctctcaaccaccccattctgttgtggaacatatggcgaagaaaactgttgttcgactccagaagaatcacagaaaaattcaaatgcagaatttttgaattcagagccattatcactgcgaatggctcgaagagcaccaggaaactccaaagccaaactacgagcaagagactggaagaagccaaatgtttcctcctttgattcaagaaaatagacccaagagtagcgagagaaatcatccacaacaaccaagacataccacttccccccaactgactggacccgagcaggaccaaccgtatccatgtgaagcagttgtcccggtccatctgtcataaccattgtaacaggcttgtgggaggaagatgtcattttcccatgacgacatggtgcacacacaagatctttcggagctttcaacttaggcaaaccccgaatcaaatccataccactaatgcgagacaagtggtcaaagccaatatgaccaagacgtcgatgccagaaaaacaaatccctattctctgaggcaatgagacaacgagaaggaccgggagcagaagagtcgaagttagcaaagaaaactcgaccaactcgagaaatgtcaaaaacaggagattcagaagcatcaagaactcgagacctgtcctttttgaaacgaacttccagattttcatcacagagttgtgaaacagagagcaaattgtacttaagcttacttactagtgccacatctttcagcatgaatttgtcattgaccttgattgttcctttagccatcacgcgtccactgctcgcatccccaaaagtgatggtctcatcaccggatgcacgagtgagagaagtaaaccacttggcttcaccggtcatgtggcgtgagcaaccggagtccacaagccaagaattacttctccccactccaaaatcctacaagaaagacacagcagatctcgatgattcagtactggggttagtgagaaatgacttaggaatccagtactgaaccatgcgaggagtacaagcatctttagtgttatgagcagaattatatgcaagatgaccatgtctgttttgccccaaccttgctaggtcacgtcgagggtgcacatctcggcgaggaaagcgagatacaccacttgaacgacaatgacacgcacactcgaacctctcagggactctagtagctcttctagtcctaagacgttcttgtcgctcttttctagcctttctaaagcagaaacctaccaaatgaccagctttcccacaataggtgcactcatacttggttttctctacaggcatggtttgtttctggttttgcttgtgctcaacttgttttggatttttgggtctaggtaactctacaggcttagacttgctagtcataggtaccatctttggttctgaggttttgggtgtactagaactaatgtttccaatgaaacctgcagacttgaaggttataggtttttgagctagttctatcatcccatctgtgacacctaaaatctcatgggtacctatcctcaaagactcagcaaaatcatagcctataccttgattgtttatggacactttggattggtctaggatcatgttcaactttttctttccttgagcaaacctctctaaagattgttgtaggtatgagttctctttcttagcagactcaagatcaactttcagagaaatgcatgatgaacaagaatcaatagatttgatagaatcaatgacagttttagcatcttttagttcagtttccaggatagcacaattagcacatgaagaatgaataggttccttagtagcaaaagattctaacaaatcattcttggtcctaagcatggcaacttgttgtcttaattcattattgtcactagtgagaatgggacaattttcacacctaccaatcctatcatgaacaaatttttcttttagttctttcaattccatctcaagcaaacccatatcaactttcatttcatagcaagtagagcaagcagcactagcactagaagaattcccagctcctaaagcacatgatttcaacttatccttgaggagattaattttagaaagatatgaagcacaagtagaacaggtatcctcctcaggaatcatggatctaagcctagcaatttctagcgccattccatcattttcagattttagtttctcaattttatacttagaagacctatacttgtcactaatttcaatcatcaagtgtgccattctttctttgcttagttcatcatcaacagagtcattatctgagcaaaaatcatcacaaagagaaccatccaaggaagggatatcatcaagacatacctcaggatgctccgatgagtcatccttatcctcaagtgccatgagacacaggttgatgaagtcctcgttgttggcgagacagcacatcccggagaagtccttgtcccccttttcttgatcatcgtcgtcggagtcgatgtcgctaagctgcacctcctcaagagccgccaagaccttgtgaatcgccttcttcatcaaatccttcttcccctttcgcccttgtccctcgggcttcttggtcgtcttgtcactcttcttctttaacttgggacaattcactcttatgtggttaggctctccacactcaaaacacacaaatggttcattggtttttcctctctttttatctctcacatttttgtaagctcttgagaattttctagcaaaaagagcaagatcatcttcagggatcttctctaattgctcctcagtgactgagtgtaaagcggcaagagagaagccaccacacacaaaagctgagtcattagaagaagtactaccagagggatcagctaccaaagccatggagtgtttgaggcctttccgatggaaaacatccatctcatgggtttttagctttgagtaaagcttgtccatggtaaggtcactcagaggagcactctctgtgatggaagtaactttcatttcccaaacaccataatcaagacaattcaaaagatgacgagcattatcattatcagaaaactcttttccaacagatcttaactttgaaacaatttctccaaaacgcttgaaataagaatcaatggactctcctgggtgcatctcaaatctttgatattctttatgaaattgattctgacgaaccaattgaatatcattgtttccctcatggaaattgcacaaagcagtccacatgtcatgagcagacttgtggtgttgaacacgattaaattcaccagaagaaattccaccaatgattgcatttcttgcacgataattaaaatcaacctgagccatatttgcaggcgtgatgtcagcatcatcgggcacagtgtaaggtgatttaaccttattccacacattatgcccttgcgactggaggtaggcctccattcgtgccttccaaatgacaaaattgtgtccatcgaaaacaaatggtttcgcagagtatttttcttccatagctgcgttcgttgccacggttaggttacaacgaacttaaccgggctctgataccaattgaaagaccaagaacagctatagaggggggtgaatatagcaattcaaatcttgcccccgaaaatactcatcaagccggatttctcaaaatccttactagaaccgcagctattagagaagccggatctagaaaagaagagagaaaaagaagagagaaggaattcccgaaactagaggaggaagagaaaatgaattcccgaaactagaagagaggtgaggaagagagagcaaaactcatcatcgcaaagttcaaattgcaagcggaatttaaattgcggaatttaaatggacaaggcaaaaatgaaatccttcaaatcatttcatttataggtgatgcaaaataaccgctcaactaggagcaaacatacaccttcagaggaacattaacacaaacttaaaatctctcggacaaacacactcaaactaatcctaatacaaaagcctctcgggcaaacacactccaaactcaaactgaaactctctcaccgagcatctcaaaaggattgccaaagaagcaacctccacccttgcatccatctctctatttataggctaagacccctaagacattgtctcaaatacccctagggcgaaaccctaactcagaatggatctggtccacccattcttccttagaaccgaaggaagcctcctggatgcttgccacgtcgttgatccaaactctccacgccgcactgatccgcgtgctccctctccaaaccagtgacgagccgccacgtcacgcctcagcacgcgagagcgcgcgctccaccgcgtggatcccacgctcacctgcgcgcatccagtccaaagcctccacgcgtcccgccgagctgctcccgcgcatgctcgcgaaatcgcgcgtgggtcccagtacaactcccgcctccgagccacttgaaacagcgtggaccccacgcccgcacgcgccgaattccttgccgccgcgtgtccactgcgcgcgcgtgcctcgcgcgatctcccgcgcttgcccgcgcatggtgccaatgccgtgggccgtcgtcttgtcttgggcctgctcggcctggcctccctgcctgctgatccatccatcatcttgagccacgaggaagggctggattggcttggcctccctgccaaccaatcacagctcacatgcaccaatgggctagcaagctcctcatgcacacatgcatgtcttgcccccgtgcatggcattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctccttacacggtgttcgtccaccgtgtgcaaccttatgtccaatcttgtcatccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccagtacttgtcaatttcccatcacaaaagaactataaccacacatggtttcacaatctcccccttgatgggaacattgacaatcccaagcaaaaattttgaaaatttgatttttgattcacaaagcaaaccattttgcaaacgtcgaactttggtcattttgaaatcgtgaaaaatcaagaccaagtgaagtgacaagaagaaaagggatgcgaatgcaaatgcaagaatgctccccctatgtgccaaactcccccttttaccaagatctaaagcaagttttaataagtgcaaatttctctccccctttgtcaatgatgccatcaagatcaaaagagacaaaaatgcaagataaaaatgagatgaaacttacaaattttagtgttttgagagctttgagagttatctaaaggcatcaaaaggtagacatggatcacacagatacaagcatgtgctcaagcctagctaagcatgtgcataagaagtatgaaacatgtcatggatatcaagttagtatcgccagcaagcaaaaagttttcaagtgaattagtgatttagtgtgcaaagctatttctagaagaagcttaaaaggaagcaaaccagctcataatcatgcaagatttacataatcaaagcaatgaacccatgctaatgtgctaatgcccagttcataaagagtatcaacatgataacaaagcatagaacatgagcttttaatcttttctcatgacttttatatttaagatttttttttaatttctttaaagacaatagcacaatcacgacggtccacctgatcttatcagtcagcaagtgatggttgtgccaaacactgccgtctgacctcaatcaagttttccagctagagttcccattacaggctgtctcagtgctatcttcggcactactcatgcgtaaacgcactcagtagcccggacaaaaacagagataaagcttgtaaagcatgattgatacaaagtatggacgcataagcatgagcattcataagcatgtactgacagttattgcaaaaagaatgtaaacatggcatgagtatgagagggatacttcaatttaaacaaacttctagagcaagcattgcacattgattaagttcaaatgaatagtcaatttaagcaggtttcaacaagcttgaacagcataacatgatcacacaagctacttaagcaaatgaaagctagacaagagatcaaactagcataagagtgatacatgcatagcatagtgatgaccaagagataacaagcaaagctcaattgaagagtgtataaaacaatgcataaagtaaacatgatgcaatatgttacaaatgcatgcaaaagaaaaacaactccccctcaaatcaagccataggggtggatcacccctaactcactccgcaagaactcaaaacgagagcgatcaagtggttttgtaaaaatgtctgccaattgtttttcagattcaacaaattctagcacaatggcacccttctcaacattgtctcggagaaagtggtaccgtatctcaatgtgcttggtcctggagtgttgaactggattttttgcaatattgattgcacttgtattatcacaaagcagaggaacaccagagaaaaacagaccataatctttcagagttgaaatcatccaaagaacttgactacatgcactagcagcagctacgtactcagcctcagctgttgattaagcaacagaagactgcttacgagaggaccaagagaccaaagaagtgccaagaaaatgacaagtgccagaagtacttttgcgatcaatcttacacccagcaaaatcagcatctgaaaaagctcgaactgaaagggcagaagagcaggagtaccaaataccgtactcaagtgtagacttgatgtagcgaaagatgcgcttgactgcttggcgatgtgatgttcttggagaagcctggaacctcgcgcacaggcacacggagaagtggatgtccggccttgacgcagtcaagtagaggagggagccaatcatacttctgtactcgcgctggtcaacttcttcaccgtcctcatcaggaccaagcgatgaagtagttgccatgggagtggcgattggcttgcagtcggccatgtcgaacttcttcaggagctctttggagtacttggtctgatgtacaaagattccttccttggtttgcttaatttgaagtccaaggaagaaagtcagctctcccatcatgctcatttcgaattccctgctcatcacatcagaaaactgggcaacaagtgcatgagaggagccaccaaatatgatgtcatcaacatatatctggacaagaagaaaatcaatgccactatgaagagtaaagagagttttatcaactgcccccatttcaaaaccattttgaagcaaaaaggttttcaatctttcataccaggctctgggagcttgttttaaaccataaagagctttatcaagtttgaacacatgatttggaaattttggattttcaaaaccaggaggttgtttgacatagacctcttcctcaataactccattcagaaaagcacttttcacatccatttgaaaaagcttgaaaccttttgaagcagcaaaagccaaaagaattcgaatagcttctaatctagcaactggtgcaaaggtttcttcaaaatccaagccctcaacttgggtgaaaccctgtgcaaccagtctggctttgtttcgaacaattgaaccatcttcacctagtttgtttttgaaaacccattttgttccaatcacattaaaacccaagggtggttctaccaaagaccaaactttgtttctttcaaaattttctaactcttcatgcatggcattaacccaattctcatcagataaagcatgacaaacatttttgggctcaaaagaggcaacaaacgctgaattgacaagatcataagaccgatttctagttaccctttcacccaggcctctgatcatcgagtcaggcggatgtcggttctggatgtgtcggggagctgtcggtcctgatgtgccaccatcaatctcctcagctgctgaagatgatgtagttggtgcatctcctgaaggtgatgtagtcgaaggagaaccggtttcttgcactggtggtgtactgtctagaggtggaggaatggaatcatcgtcatcatcatctgaatcctcatccacaaagatgctttcatctagaacacctgaaatttctggtctagctcctgggctagcctcatcaaaagtgacttcacaagtctccacaattttgttagttgaaagaacataaactcgataagcccgagaatgagtagcatagcca

SEQ ID NO: 59765 - DNA, 53714 bp, Oryza sativa
gccacccaatttatcatttaattttagttttaattactaatttagcagcaatttcgttttagtcccttgtgttttatataatttagtcgaaatagttcattagttgtacaagtaattatgtaatggtcctacagaccgctgatgttatgtgttaattaacataggtgtttattcaaataccctgtttcactaaatttattgtcttaataacatgtcttttgcattttatttcaagacatgctctactttctcgctttattaatttacaaaattctataaattttgtactttgatttagtaaattctcttaattatgtacaacatgattaatggaggatttaatgcatgttccacttcacattttgactcggaaattaatcacatgtcgatggagccctatactttggtcatatcgaccataacttaggcagcgagtatctcgcccatcatcaagtggtctacattttgagatgattacccgatggagtcctacaaattggccgcactggtcataacctaggcaacgagcaccttgcccatctcacagaggtctacatctcatgatgattacccacatgtgttattttccaagaataagttttgaaaaatgagattatttgaattttggttgagcacaaggtagtggagtcctaaacattggttgtggtatattcaacagaatatatttgcctggagaccgtgttttaggcagcaagtataacttgcccactattaagagatctactccactgtttaattacttggagattatccacattgtgccacctaatttcgaattctaactcaaattgtcaggtccattacctgcattttttttcgaaacattacaaaatatgaagtcttacatttcgcattgagattacaaccttaatatcatgtttttattaatttacctctgtaaattgataatgttaaccatgattgtagggacatggcaacaaaagagttcgacgaactcgccctcgatgggactaactatcccatatggtcttctgatatcaaaatcaattttgcctctcgggggattttaaatacaattgaggaacccaatgatggggacccggaaattgagcctaggaagctcaatacatccctttttcttttgagactctacattcacaaggatcttaaacattaatacatgttagagacgagccctctcaacctttggaaagctctaaaagagcgctatgatcagcaaaaggaactcatttggcttgaggctaattatgagtgggttcatttacgcctacaggactttaaaactgtggcataatacaaccatgttgttcataacatttgttccaggttgaagttttgcgaacaagagccaactgaggcagagaagatagagaaaactctatcaactatgcttccggaggacaggataccgactcaacagtatcacgctaacaatttccagaaacgttctctgcttatacatacattgactcaggcagaaagacaccatgagctttctttaaagaatgcccaacagcgcccaccgggctctgctccactacctgaggtgcacttcaatgtacagaataatgctgagaataagaaaggattcaagggaaattcttcaaataatcctaagaatctgactggaaagcgcaaacgcaacaacaacaggcgcaaattcaagggttgaaagaaaggaaaagggaagggtaaggcaccacaacctcgtagcaatggcaacaagcattgcaacaggtgtggatctgacactcatgtcgctaaagactgccgcatcccgaaatatcttgtttctcttgtaccaaaaatccctcaaggacaaaaaatcttctgagaacccaagatttgaagcccacttcaatcttacacataaagagcgccctgaggttgcaagttctcaccaggctcctgttcaaccagagagcaacctcaatgttgtcccagaagatgtcgctccactctctgcgatggacgatatgttcatcgaatactgctcaacggacccacttggagatttgcaatgatctcggtgcgtcccacttggagatgaagctgctcttatctcaatgtgcttgaaatagtatattgatatcctataagtttgccaaacaatattggttgtaataagtagataagtatgaactcccttatattgtaaggttgtatggcttgctagtcattagagtatgtactattaacatatgtaaacatcatactatgtatctgatgttttaattattgtatgtatgtatatatattggataaagaattcttaatcaagtaattcttctttcattatagatgtctaaggatatcgctccgattggagaggaattatgtcttttggacagtgataccacaaactctatacttagggagatcaaatactttcaaactctcaaaaagagagaaggcaacgttttgactatcgctgggcgcgatactgtgatagttggctcaggacgagcaattattacacttccaatgggtacacaaattacaatcgaggatgctttattgtatcccgattcaactcgtaccctactaagttatagatatatccgtcaaaatgggtttcacattgaaacccatatggataatcgagaagaatttcttctcttaaccaaacaacacggatatggcaaacgcatttgcgagaaaattccatctctcacatcgggattgtactatacatacattaagcccattgcacatgttgcgtataaagtaatttttcaaaatgttgatgcattccacacttggcatgatcgacttgggcatcctcggtatcgggatgatgagaaaaattattggcaactctgttggtcatcatttgatcactgacaaatttcccaaatcctctgatttcgtatgcactgcatgtgctactgggaaactaattttgagaccatcttatctcaaaattagagccgaaccacttaaattccttgaacgcattcaaggagatatctgtggccctattgtgccaagatctggaccgttcaggtactttatggttttgattgacgcatctacaagatggtctcatgtgtgtcttctatcgacacgataccatgcctttgccaaattaatgtctcaaattataaggctgaaggcaaattaccctgaacataggattcaatcaatccgtatgaacaatgctgccgaatttacatcccatgctttcgatgattattgtatggcattgggaattcaggttcagcactctgttccatatgtccacacacaaaatggtttggctgaatcattgatcaaaagaattaagcttattgctcaaccattattgatgaattgcaaattaccttcgtcgtgttggggtcatgcagttctgcacgctgctgaccttgtccaactacgaccaactgcatatcatgaaactttcccaatgcagttagtacgtgaaaatcctccaagtatttcccatttgcgtaagttcggttgtgctgtatacataccgatctcaccaccacagcgtaccgctatgggcccacacaggaaagtagggatctatgtgggattcaaatctctgtcgatcataaagtatttagaacccttaacaggtgatctatttactgcccggttcgctgactctatcattgatgaggaacatttcccggcattagggggagacttcaagtaccagaaagaatgccaggaaattgattgggatgcccagggtgttccagcctcagacccacgtactactgaaattgaacttcaagttcagaaaattatacatttgcaaagacttgcaaataacctgccagatgcatttaccaattataaatgtgtgactaaatctttcattcctgctcagaatgcaccagaaagagtagaggtaccaaataaaaccactcaacttccactcactaaaaagagaggaagaagtatggccacccagcgagaaacaattgctaataagcaaagaaagacggtaaatgcaaaccaacctttagttgttacacaccaaattgatactatatatcaagcagatcgtgatagtctgcaacctagcttggtggtgcacaatgctgagactaggaatttggaagaccatatacacattgtttcgggagatcacgatgagtctataagggttgatgaaattgccatcaactactctgaaactggagaatcttttgatagaagagctacaattgtcgacattaatttttctgaacaaattgctgattgtctccaagttgatccagaacctaggtctataaaagagtgccaaaagcgctctgactggaacaaatggaaggacgcaattgacgcagaattagcctcgctttacaaaagagatgtattctcggctgtaatgcctactcctcgtggtatctttcctgtgggatacaaatgggttttcgtccggaaacggaatgaaaacaacgaggtggtgagatataaagcaaggcttgtagcacaaggttttacgcaaaaacctggcgttgatttcaacgaaagttactctccagttatgagtggtataactttccgatatttaatatcattggcagtacaaaatcgtctatttatgcagttgatggacgtagtgacagcatatctttatgggtcacttgattatgatatttacatgaaggttcctaatggaatcgacatcccgaatcagaaggtaaatcataacatgtattgtgttaagttgcagaattcactttatggcttaaaacaatcaagcaggatgtggtacaactgattaagtgaattcctttcgctaaagggatacactaaaaatgatgattgcccgtgcgtctttatcaaaaagtcccccacaggattttgtattatctcggtatatgtcgatgatctcaacatcataggcaatacacaagatattaatgaagcacgtcatcatttaaagacggaatttgagatgaaggatttaggtcaaaccaaattttgcttaggtctacaacttgagcatttaccttctggaatccttatgcaccaaagtgcatatacccagaaaattttggagaaatttaatatggacaagtcatatccttctaaaacccctatggtggttcgatctctagacgtggagaaagatccatttagaccaaaggaagatggagaggatgtacttggtcctgattttccatatcttagtgctattggcgcactgatgtaccttgcaaatagtacgaggccagatattgctttccaggtaaatctattagcaagatacagcgctgctcataccaaacgccattggactggagttaagaatgtctttcgatatcttaatggcataagagatcttggacttttctttaaaaagaaccaggattcaactttaattgggtatactaatgctggctatctatctgatccccacaatgctggatcacaaacataattcgtatttttacaaggtggaactgctatttcatggaagtcttctaaacagactctggtagccacttccacaaatcattctgaaataattgcattatatgaggcatcacgtgaatgtatatagcttcgcagaatggttaaccacatattaacatcttgtggtattggttcattggaatcacctaccattatctatgaagataatgccgcttgtgttgttcagatggaaactagttatattaagagcaacatcactaagcatattgctcctaaattattttatcctcatgagcttcagcaacatggagagataaacatcttgcaaactaagtcatgtgataatcttgttgatttattcacaaaatctctaccatactccacattctttaaatgtgtcgaaggaattggtatgatacgacataaaaatttgcaggattcagggggagtatcttcctctggaaaataacctattttcgttatattatactctttttcctttgtatgagttttaccctttaggttttctcatccaaagtttttaacgaggtaatatcaacataagttatatttcttatcatttggcttttccccactagggtttttactaaatgataaccgtagacattatactattttggatcatactatgagctttactcatagatctaaaatagtcaataatatatatcacggttctctccttatttttcccactgggttttcgatgagttttacgtgatgtatttaactataattatttctaagattatctttacagatatctggaacagtgaaagagcaatgattaaagctggattcgatcaagggggagtgttatgaaacaacaggtgatctcatccatataaaaggatggatcgcaaccgaaggcaaccgcgccttccctaggcgctccttgggaacggacgtgatggttcccaaccatcgtgtctccggttgccaccccttccccatctatatattgtaccgcattgatcaataaagaattccgttcattcattctctacattcttgtgtgcaattctctctcgctcaatccctcccgctcaatcaatcttattcaccattttttacaggatccatgccattataatttgtgtagtatacgttttttttcactacctatcccttcaaccattttctaaaattttaggataaaattgcccacgtcttcttcctggtcttctccccatctcacatattcatcttccctctccttcttcgaagcagtaggtggaagttggaactgacggcgatgggctcccaggggaggagcggcggtggcggggcaggggccgccaaatccgcgagaacgtggcgagcccaagacccaccaccaccgtcaccgtagctgcactgtgcgcgctgctgcactccagcatctagcttggcctcggtggggggatggcatcaatgggagtaatgccgacgagtctgggttgggataaatccttgggtcgccggcgggggatggattgatgatacatcctgacaagcttgttcttcttgtagtcgagcagaataatggcagcaagttgatagagcatcgaaaggattggcctttgggtagaacacgtgtatctaatgttagctggtatgaacgtggttgccgtctgtatgaatgaggaaggggggaggagagaaagagcccgcgcctccccaactacggatctggaagcgccgccgcgctggagctgcaccattgtccacctgtcgcactcgagctccatcatcttgatctgctcgagagagcttcgccgccggtccacctgtcccgctcgaccaccagagggtgaggacatttttatcaaatacaggtaaaatacatatcttaatggtacaactgaaattataaacaagtgatcgtggcattgttacaaatacgtaaattataatggtatattttaaaacctcaatatttacagtggcataaatctaattaatcattttcattttggagttgatacgtctgctgtagttacacgccatgacttatgttgttatgttagtcaaatctcttaattgtactgtgactagggatgtaagcgggccaacccgagaacccgtttatagacaaaattagtgagtgacccgcgggttaactcgtggattacctactaatttgacttataaatgggtttatatattaacccacttgcttttctataaacgcagcaagctgagccatgacgtgaaaacccgcggattaccctttatttaacatataaataggttcataggtcgtcccgcttacatccctaggcatgtccattcctcagaaaaactagtttttgctgaggtgatgagtaagagatctgcttccattgcgtgtttccaaaatcactttatttaaaatttccatttcccagcttatatcacccactcctggttattttttgattgagacactgtggagctttcattttcttttctgtagatctaaaatatgactgcatggttatatgtttacgtatttgaaaaagaaccgagtaacttgagagtacttttttggcgcatgacggcatgtcggcatgcaccatctcaaaagcatggtaaaaataatacagtaatgaaaacatgaaatatatagtttggctagatggatatgtatgtgtttggtcaatagagttaagtatttgaaaaggaaccgggtaacttgagagtatattatttttggcgcatgacggcatgcaccatctcaaaagcatgattcagatagtaatgaaaacatgagatgatttgaaaaccattgacacgacacggatgtacatgtccaaatactatcaactttacatccgtttcgcacgcggataaacaaaggaaaattaagctgctagtgtcattgtcccttttccaaaattctttccattataatttgttcttctgtaaaggcgatatgtttttctaataatggattctaaattcattaatccggcatctataaacacgagggatatacacagtcaaaatgatagaagagcacttagactcacacctcattaaaaaggagaacacacaacaaaaaggaaaaacctacgatctcgccacatccttgcttcttgacatcctctacttaaacggccaaaattgacgagtggaggacgtctagtcgccaccgtccctagtgcgttgtcgctgcaaatctcagttcatatcatcttcatccgattcaagtgagttgatgccacgctccgccgataaggccacagccgaccaaacgcgagctgaaaggatccgcttccgcttcgccgaattcctaggcctccgccactatcgtcggaatcctcctctgcctctcagactcccaggcctccactgccgatgagatcttcctccgcttgatccgcctcctccttgccgagatccttgcactggcaattaggccgctgccgccacagccgaggaggtattctgcttggactcgcaggccaccgccattcctagggtcgttgctacctacggaaccacctccgtcggatctgccttctccctgccgagggttggccgttgacgcttaggtcgccgccgtcctccgccgcatccgccgccaccatcctccgtcgcacctgccgccaacgtcctccgcagcgcccaccgcctcccaaagaaacaccgccatggcgtcgtcgacagctcgctgctacctgccgcggcgctgttctcctgaccacctctgctaccatgcgcaaccaggtattggcctgccaccgccgcccatggccctgccgtctctcgcactagcgcgccgccagatctgggggcaaaccccagacccaatcccactgtccgtcgcaggtcccgccgaagccctgccgccgccttcctcgcagccgcacggcactccggcggcctgctagggtggcggcatggcagcagcgaggagacaagaggtcgaggcgatgagacgaagagacgaggagtcctgtgaaggagatatataaggctttgaaagaagtccagtctagagcatctccatcaatatttcatattttaaagttgttaaaatgtatatatgggttaccccatttgtgagaaccctaagatcaccttttaagtccggtaacagctctcatttctcagtcttcattttattttttcttctatttcgacatatgccggtttactcaaaacaagaaagtatacatcgatgaatatttcagagcagactgatctcatagcaaacctagctatctgattctgcatctcctgtccctctaaaccctgacgatgcgctgatcgttgtgccggagttcgtgatgatgccagtgctagctacagaaattgcaaagactaggttgatttgagctccttgatcaagtacatggttgattgtgtgtgttcgtcacacctatacttgcaatttcacttgagaaaatacatgacctgacaaaaatgaaaaccaaaagaagatagagtccatatagagaacgcctatgcttcatcgatgatcaggccaatgctccaagcacgatgctgatcgactagggatcaggcttctctaccttcagagctaggtgcctttgtcactaacatgtgagttcaatgaatcatggatacacctgtcctgtcagtgacaaaggaatggtgtctttgaaggtagaggatctcaatccatcaactaggctccatcctcgctggagcaggtcggagaggcgcggcggctagagtggggcaaaggatccggagttgcgcaagatccatccacagtcgccagccccttaagactgaggggcttggcatgaaataatttcgagatgatttaggggcttcagtagggatggatctagtttttaaaccttaaccctcaatttttgttttgtttgagacctgtgtttaggggtcctgctaaagacgctcaatgagagcgtatttgtaactgaaattcagaataggaaaaaaatagaatcgagactataatcaatattttgcggttaggtatgtgaacgttctctccaaaaagacatcctacaactgattataagacacttaacgtttattggaggaaaaataataattatagataaaaattttatatgtgtcgttatggacttaaaagtcaatgctagaataaattataacaaataacatcaaaattaagtatgaaattaagcttgaaaaaaattaaatttagttttttaacacttatataactaacatactccctccgtcccaaaataagtgtagttttgcactattcatgtccaacgtttgaccgttcgtcttatttgaaaattttttgtgattaatatttttattgttattagatgataaaacatgaataatactttatgggtgactatttatttttagtttttttcataagtttttcaaataagacaaacggtcaaacgttagacacggatctccacgactgcacttattttgggacggaggtagtaaataatagtagatgcataagtccaaaattaagcttgtgtgaatgataagctgaaatgcaaacgataaccaattaaaccatacatttgccacctgtcctaaactttgacacggataattgtatttacagctaactaattattctttcagtgataggtgatatacacgtcaaagcgagcgcttgtgtttgtaccgtgcaccatatattcttccatgcatggtttcaaaacattttccgaacaaatacgacagataggtgagaatcgatccgtgccttttcaccaatagcaatcacagagtcctctggtcatttcgagttcttagaccatctacacgcaacaaaacctgctcaagtctttaaatagttctatacttcctatgtaaaaaaaaaaaaccttatacagatgaatctaaatgaatatatttcagatacactcttagaaattgttttttttaacggagagtacttaatttcgggctgcatgcctgcatccaccgtgcatgcccatatggcattacggcaaaatcctccaatttttttaaggcaagggcgacctcatctctcccaatcactccacgccaagtccacccacaaatccagacatgtaaccgcaggcaataaacacacagagcagtacaggtactggagtgagagtgagagcatgcccggcctgcactgcacgtcgcccctcaatttcctcggactgtttgtttgggtgcacgccaatcactcatcaccagcaaggattataccccccccccccccccctgcacgctgatcggatctgcagcttcatgaatgcaaagcgcctaccccagcgtcccagccagctgcgcatgtcgttgcctgcaagtttgagcatgcatatgctttgcaattttattgtgttctcgggtgactgcgtgcagtgcatccatggctaacctgcaacagcaagactaggctaatggtgatccccaaacagcgagccgacgcgtacctgacctgcaattttttttaaaaaaaaaagcatgtctgaatttgagaggattgggaacttgtaacagcagtttgttgcttgcagctaccgtggacgaaacgatgaacccttggtgaaaatcaggtttgatcagacgacaactccgatctacctggctcaggattttattttattagtctttgacggggacctgacctgagacatatggcaatctctgggtctcacattaatctctgggtactttcctatggcaatgcaatgcgtttatactgtgagctgtggctgtgcgactgctagtgctaagctatagtggtataccctgtggagtactcctctgtatggagaaattcttcatgctgcactgtacagacatgtcacattggtgattggccggcccgtcagtatctcgcaggacagatgcaaccaaaggatgaccgcacgtagctctgtgttgactatttttttttttttggcaaaaggaaggccacgccatggccttatcggcttgctccattgcgttattgcgtaccaatgtactatacctccgtttcttggatttaaattctccccatcatgaccattgacaaagtactaagtacatgtctacatgagcatacgatcgtgatcgagcctgccgctgcccactgaattcgaattctcggttttcccttcgaagtctagtgctatttgtttcttctctcgcattttgtaactgctactgatccttgtccttttgcacatcgtcactcgagcagagcagatgctcgatctccgaaaatctcaataagggaaaaaaaagtactcaatccgtctaaaatataagcatttttagcatagtgataagtcaaatatttttaactttgatcattaataaaaaaataaaaaagatcaatcatataaaattgatgttattagatttatcattaaacaaactatcataatataccactcttttaatttaaaacatcttacttttatatatattgttagtgaaaatagcatctcagaaactatatcagagttaaaaaatacttatattttaggacagagggagtagccatccgccatgtactctgcttagctctaaacctgtacggccggctgcatcatcatcatcatcaccatctcatcatcagaggaaggcaagctgccatgctgccgcgcgccattggtggtgaagccacctccaaccaactggctgatctgccgcccagtcaatggtgcagctcatcagaaaaaaaaaacaagaaaaagaaattggccaaacattttcttgcctcgcgcagctgcgccgttgccccgcgcgcgcgtcgcacaagcaagtaagcaacagccacagggcgccgcaccaacccggagcagtcaccggtgatcgatccgaccctgcagagtccgggctccagtgctctctccacggtactccctccgtaaaaaaaaaaaaaaatggctacgtgattttacctacgataaaaaatctagacatagttatccagattagcctttttaagaaaaaaaaagtatacgtggaacacagtctagacatagttatccagattagtctttttaagacaaagaaagtatacgtgaaaaaaatgttttttaaatactttttatattgaacttttttaaaaaaataaatagatcctgtttttctataagatataacaattaatattcaaataattatatgttaattaatgatttgtctcattttagatgcaagtgagaaaggtaataactaccccactgaaactgtggtcagatcatgggttggttttcagaatatgggtagtaaactactcctggagtagtgattggctgcaggttgacgatgacatgatcaaaacgaaagggccaattttcctggagatgactacagtacaaatacggacgacaataagaaagggaaatctccccaggaaattttaaaaaaggaacatggaggaggagaaagtagaaacctgagtaatgccttgtttatgtaatataatgtatggggatgagtaacaggtacaactaataaattcatggtccacacaagcttaattttggacttatgcatctactattatttatgttagttatataagtgttaaaaaacagtccacataataatatctacgagttgctctgttgacttttagaggacgttttttttttttgaaattgttcttcaagaatgaagtttgataattaatttcccataaaatgtatttttaatggatatagactacattgtgcgaaagcactttgaagtataaatctatcggtgcaggtctatgcactaaacacatttgtaattgagctatttgtcgatcaaaatccacagagtttgacttttcaaaattaaaatgtcttaacaaaattcaatacagggagaatatatattagaaaaatattgagagcattatatatcgtattgaagcacagtggcagtcgttttacttttatagagaaaaaccgacacatggatatataccacggccattggtaagtgtaggctaatctcacacgttatttttgttctatgatagtgtatatccattcccgggtacttgtcaccacatactatttatactcaaattttgaccacaactattctagcagctaaattgtaaatatttgaaattataccatagtattgaagcatgttgcatgctaaatatataatcatctaacttccacgcataaaatttgacatttgagaaatatttgagaacgaagcgaacattagagtgcggtgaaaacgacttgtaagaaaaagtatggtaaaaagacctggttcaatcctatgtcctaagtaccatgttaatgagagaagaatatacggtttgacacatgtggaaattttaaaagtatggcgggggattaaattataatggtgtaaattaaaacaaaagacacatgtggaaatacaatttagaaaaaaaaggtgatactgtttaaaaaataatcttgactatacacctagacaatataattaataaatataccatagaggagttcatgtcaaaacaacgcatcaacaatggaatttttgtttggattattggaagataaagatagaactagtagtttgctcactggataaattccaaagtaaataaaatacttttgattcttgaaatacaaatatactttaaatcaaaaccagctgcccaaaagttggccactaaaagctgaagcaaatagcatacccttccatttggcaaacgtccagatcatgatctgattattagcctataggcaaccaattgaaccaaagatgccccgtaatatcaccccctaattctcagatcgagcaccgggacgacacttaactgacgtaatcggtagaaaaataaactattacaactatagcaacccaactaactacaaacacaggtgaggtgatcaccggcatgagaaatttgaaatggaaaataaaaatagtgccatgcgttgatccgtcccagtacaccaatttcagaagcttgggtgttatgcccccaaatcgtcacttccccctgattcacaagcaagccccaaatcatcagtgtgtgacagaaaaaccccccttaaaaacgtccgtgcggtgggcgtaggttaagagagaccgtgcgcgcgcgaaatctctcacacgcccacagctcaaacgcgcgcgcgagaggaggggaggggtttggtttgcttggacactttggtttggtcgggtagctcacctcactctcatccgaccagcgactctctccctcctcctcgcttgcacacttcgtactctctctagtcccccgcatacatgtcgtccgcggccgtggcgtctccgagggagacggtgtcgccgcccatgtcgctggggaaggttggtgtcgccgtcgtcggcggcgggaggaggaggtcgaggtaccgcctcgagacgagggggttgtcgtacgtgctcccggcgaggggggcggcggcgaggttgtttcttggaggcggtggggaggagaggttgctcctgaggggcgtgacgtgcgaggcgccgcccggggaggtggtggcgatcgtcgggccgagcggggccgggaagacgacgctgctgtccgtgctggccgggtcggccgacccggcgagggtggtcgccggcgaggtgctggtgaacgggcgcgccatggacgctgcgaggttccggcgggtgtccgggcacgtcccgcaggacgacgcgctgttcccgatgctcaccgtggaggagtcgctggtgtacagcgcgcggctgaggctgcgcggggcgggcggcgggaatggcggggcggcggtggcgagggcgagggagctgatggcggagctcgggctgcggcacgtggccgggtcgagggtggggagggtgtccggcggcgagcggcggcgggtgtcgatcggcgtcgacctcgtgcacgacccggccgtgctgctgctcgacgagcccacctcgggcctcgactccggctccgcgctccacattgtcaagatgctcagggacatggccgccgcgcacggcaagaccgtcgtgctcaccatccaccagcccgggttccgcatcctcgagctgctcgaccgcgtcgtcctcctcgccgacggcgccgtccgccaccacggctccctcggcttcctcgaggctcgcctcgccgcctccggccacggcatccctccccacgtcaacgtcctcgagtacgccatggagtgcatcgactccctcaagcccgaggtcaccacggcggacgcgagccacgcggacgccgcgtcggggtcgtcacggcggcgcgcgagctccgcgccgtacgcgaactcggcggcggcggaggtgtgcatcctgtcggcgcggttcgcgaagacggtgctgcggacgccgcagctgttcgcggcgcggatggcgcagtcgctcctcgccggcgcgttcctcggcaccgtcttcctgggcgccggcgacctccagtcgaggctgggcttcttcgccttcaccctcacctacgtcctctcctccaccaccgagggcctcccggtgttcctccaggagcggcgcatcctggagcgcgagacgtcccgcggcgcgcaccgcgtcgcctcctacgtcgcctccaacgccgccgtgttcctcccgctcctcctcgcgtcggcgctgctgtacgccgcgccggtgtactggctcgccggcctcgccagggagcccggccggttcgcctacttctccctcgtcgtctggctcgtcatgctcaccgccaactcgttcgtcgcgtgcttcagcgcgctggcgcccagctacatcgtcgccaactccctcatcgcgggcctcatcggctgcttcttcctcttctccggctacttcgtggcgagcaagaacatccccaggtactgggtgttcatgcactacgccagcctgttcaagtacccgttcgaggcgttcctcgtcaacgagtacggcggcgcgcgcggcggcgccgagtgcctcgccgaggtcggcggggggctctgcgtgctcgacggcgccacgctgctgcggcagcaggggatgcgggcgagcatgcggtggagcaacgtcgccgtcatgctcggcttcgtcgtcggctacaggctgctctgcttcgtcttcctctggttcagatgccaccgcatgaggaggtgaagcgcgccaaaaaaaatgcaaatagtaattgctcaatctgaattcgacattttttttcttctctttttttgctgtgcttttttttctctgagacattttcatcttgggttcgagtaggataatacgaatatatatatatatatatatatatatatatatatatatatatatatatatatatatatatgtaattaaattgtatgtatgggagatattgatcaaattctggtggaattggatgttcttatgtatgaaaaattgggagaaataatttgatggtcaggtggttttttgtttgcttgttactttgtgattgtgtttttcaagtattattaatttatttatcattgccctttttgtttgtgtccttttccaagtatagggaagaaactgtcgcattcgtgttagatttgccattttgatggtctcttctagaggtagatgggaaaagcaagattaagatgctaatcatatgaggtgagacagtgatgacaaaggtcaaagtacatgcagcaggttggaggcatgcctaatttgcacctgttttattgaaacaaaaagggtagctctgctagaaaatcaagtgctaatcaattgtcaggacgcagccattttcctgtttcttacccaaaaatcttccatttctgcattcaaaacaaaataagctaatcatattgtattcgttaagtggaggaaatgaataatgtactcctatcaaggtttgagattcttgatgtcttgagatgttcttttttttttcagctgacgaattcttttcaactgggtttagttttgtgaagttgaattttgctcggtacaatgaagaacaaggtggtggaagctaaaagcgatgtatgcataatacgcaactccacattttatgatagagcaaccttttaacatagtacagctttacaagttttaccaaacctttgttaacttgcacactcgaatttaattaccttttgtccctaccgttccaccaactacttttctcccccacaatctaaaacctcatagctggcaatctagcattttttttaacattatggatgtaagccaacaatttgacttaaattagatccatctactcctcccgatcatggtaatatgtcatttaaatatgaaacattggtacaatcttcgaaattaattgtaaccatcaatttcctataaaatgtatttcaaaaatccataaaattacaatattgtaagagtgtatattttgagaaatatatgaccgtatgagcttcatgtatcaaatcaaaatattttaagagaaatataagaaatgtcattgataaacgtccaattctaaaaaatgctatccataagtacgagtttcatgaaatgccatcattcaagcaactatgatatagaaatatcatcgttaagtgctatagaatgaacagtgtatttaacaatgtggaatagatggaactctaacgatgatgatatcttcgggacaaaatcgattgtactataacattttatgaaactcacactcgttgatacaactcttggatttgggtgtttgtcaatggcaatttttagatttttctcatgttttaaacgataattgctgtcaaattttaaagtttaactaaaaacatacaaacgacacgttctcaaggctagtgaaagtagctcttgtgaatctcaaagaattttcattccgagatacatacgagggccaacagcccaatattaaccaaataaaaaggaggtgtcactgacgtggtgataaagttgtatgtaggtgattatagcttcgcttattattgtttaaatctggatgctcataaatattacgcacataccggtgaagttttattagaattttagtaatactaggtagttgccataggtctccatctctataagcgtgtattactatattatgaatgtattcgtgggtgcatgagtatggtgttacgtctagtggcgtgtacgtgcatatgtttcttttgcgcgatctatgtattctatatcgttgaaataaaaaactaaatatgcattaagccacaccacctaaaaaaatcttgacctttggatcatcaattagagagctaggaggaataagatgatgtgaaactaaagagttataaagacatttagttctcttcggttaacattcattttattgttgtaattacggtacgttcgtgtagcttcaactttcaattgaaaaactattgggcatataagtgaagagctttaagccatttatggtgctattcattggtagtagaaagaaatattaactattgatcttatttgatcgaagagtttagatctatatatatcaccttagttagaagtaatagaaacataaagaaacatcattgttaaaaaaagtgtggagaggcataatcatcatttagcagtgactaaacatttttccacatttttttgggctttttcgatggaatatgagcgatgctagggtaatggattaccacatatcgatctagctgaaaaaataaacataaataacaaacttatccttaatcattgaactaataaattactgatttataaagtatattaccagtagagagcaccgtagcatcgctcatatttctgttcttttgtatattttctatggctcgtgtatcttcaaaaatcatttatctttacatagtagcaaagcacaacataccatctatcgaaaaggaaaaaataaaacatcaaccagctgggaggcttttgattgacgctggccaaaagcacaatctttttttttcctctctgaagcagcagaaagtgaaaggattcagaaaacacaccttattgtgtcgtgggcatggtggggtgtaccgcacatgtcacaccgtcaccgcaaatggcatgaccatgttgagcttaaaattttgctacaccaaacatgtctgcatatagctttccaaaacaaattttattccaaacagtaattcatggagctaaattcatacattttgacttttgagtatcccgttccagtatttacaaactatactgcatgggtggcatgcactgacatcgatctcactctcgtattcccatccatcccgagaaaatggaagcataaacttcacgtgtaacgtaaaactagaaactactgttgaataaagagtactacctccgccccaaaataagtgcagccgtggatatccgtgcccaacgtttgaccgaacgtgaatagtataaaactgtatttattttgggacgaagggaatagatgtttaagatttatctacatcatgttatatcacgagtaaaaattttatttattatgatgtggataatttttagatgtcttttttttaattcaatggtcctttacatgtttgcgctagctacttaagctatacatatttctccatgcatctcgaccatccggtgcaccgtgcacagcgtacgtcccaaacataagcagcagcatctcttttttttttttttgaagcagatcaaattttcaagcagcatctcatcagtgcgcggcagcagagagaacgcggggtgctgctaactcgccggctaaaatgtgaccccgggtctcctaatatactttatttgttttaaaatggttgacgccgttaattttttaagtacgtgtttgatcattcgtcttattaaaaaaaaattaagtaattatttattctttttatattatttgattcattgttaaatatactttcatgtgcacatatagttttacatatttcacaaatttttttaataagatgaacggttaaacatgtgctaaaaagttaacggtgtcaaaccattttaaaacggaggccgtcgcccgtcgccatcgtcgtcgcgatgaagaatgcggcgccgttggctttgcggcggttgcccgccactacggcgtgcaagcatgcatgcaggctggtcgatcgatcgcccggcacgcgcggcggcggtgcgcaacagaagtaatgctccatgccatgcatgatgcatcgatcctctgtacatcatcatccagcagctaggattgcattcagcgcgtggatgagtggatcgaatctccgaaatggaacgggcaggaggggtccgatgaggtcggcgacgatgcatgttgctgtcgatcgagctaattctagccgataattccattggccaaactctttgtctgcacaaccaatgagcgatcagtcatcagttggctgtgttcgttttggtgtatggctctatatcgttgcgatcagatcgatcaaatgatggatgatgtgaggaggagggaaaaaaaaggaaaagggacccgagtcgctgtcgatatacaccattatcgatctatatctatatccatagatcggcgatggtatcgatccaccattggctagctagctcctttaaacttgcattgcgttgtacgcttaaattacccgtttggtttccaacccaattatgatgggagccgaatagccgatctgcctccctctgctggtgcgttgcacacacgaaggtcaaaagttttgagccagataaattgacggagattacgctgcgtgcgcactggcgcgaaaaaaagaacagattggccagagtgccagccccagataaataatggcgcgctttttgcgctttttgttgtgaatgtgatctatcgagagcgagaagaaaaggcgcttcgccattgtagtcggctgagtggtgtctcacacacaatgctttcatgtttcatcaacaactcggaggacatccgtgtgtgatgagcaagatatattgatattcctttttttctaattaaagtatgttgatcaactgtagacttaacctgctattattgcaccgttccacctttactgtacatccacctcagcattagtcacgctccatatgataaattaaatatttataaatatgaaattaacaaatattagctccgaatggttcaagcaacacaatacgaaaataatttttttaaaaaaataatttaagagacttgaagcaaataatccgtgatgataattttgtgtggtagctaaaaagaatgaggtcgacgagtgaaatgagcaactataatgttgtactcggtgggtgtcaatgggtgtaaaatgaggatgtgccatcggggaaaattaattatttgtcactattggatttaacaaatcttcaaatattcctctcttaattttgtcataacaaaactgccaataggtagagttgattttttttaactatttgcgaattttgcatgtgcggcttaccaacgtgaaaaatcaatgtgggatccacaagttagctctctcctccccttcatcacccccaccagccagacaaggtagagagggcagcagtggtggaggctcgacccaaaaacagttgctagctcagtaggcgtaggtagtggtgcggcaagggagataagggtggtggttgttggggggggggggggggggtatttactcgggccatcttagagatgggagcaatgaagcgagggagcccatgatgctggcgacctccacatcccagccagggacccgttgtagcagtctctagatgacggggcaatagggagcaggttagggggtcagcttcgtgcaaaggaggcccgacgtggaggtaggggcctcccattccgcgatctggcagatgacaatgcaaggccacccttgagcagcgagcttgggaggccttttcatgtcccaacagagatgattagggctttgagtgaagatctatgtggcacgtcgtgaatagcagaggaagccagaggcagagcatgagaggctacaacggtggtcagggaatgtgggatggagcgggtgacgttgacccagatccaaggacggtaagacattatctttctattggtaatttcataagtttaaaattgagggtcacttagaaagttgctaaattttgatagtgacatatagttaaatttcccttgtcagcaaagctaagttgcccatcgtcaacatcagaaaatttgtaaatggattaattataaataactacagaaagataaagttttgaaaaaaaaaagaaagaggaaggtatacttttttttttagaaaattataaatttaccactggtttgaatcggtattataaaactgatataaaaaattaaaaaatattactaaaactgtcattcgagtggcaatgccctttttttaagagaaaaggaggaataagggatcgagacaaattacatttcttggcctcttgggccttttcggctttcccctcccatggtcttgagacttgagaggagagggcaagcgaggttgggccggaagtattcacaccagttttggcccgttccagctaggaaaaaaacgaaaaagtacaccgaaggtccctcaacttgtcatcgggataaaaaacgtccttgaaccgcaaaaccagatatacggggtcccttaaatatataaaaccggtcacccgaggtccttcggtggttttgactccggttttggtctacatggcggctgagtcagcgtgggacccacgtgggtcccacatgtcaggtgtccacatcatctctctttactctcttatctttcccttcctcccctctatctctctctctcgggcagggccgatggtgagcaggttgagcagcggcactgcgacggtggtcggcggcgacagcgactgccgccgcgcacaccacgcctacctcgccgctgccgccacgaggcccgaggcccccattgcgtcgtcccccaatgccaggctctgccgcctcatcgcccgcgacgacctcgccgaggccacgcgcctcgtcgaccgctcacgcggggagacacccgacgccgccgtcgtgaagaccaacgccggcgaagtccatgagccgaagcaccaggcacacacagccatggacggcgttgaagtggtgagtgcacttatcggctagtactatgactggctggtgctggtgctgcggagaggcggcgttggcgggcgagagcggtgtaccacgagctctagcaccagcccgttgtagtactggccgataagtacgctcaccacttcaacgtcgtccatggctgtgtgcgcggccaccgccgccgttgcagtgccgctgctcaacccgttcaccatcggccctgcctgcgagagagagagagcagagaggggaggaagggaaagagaagagaggaaagagagatgacgtggacacctgacatgtgggacccacgtgggtcccacgctgactcagccgccccgtagaccaaaactggagtcaaaaccaccgaaggatctcgggtgatcggttttgtatagttaagggaccccatatatctggttttgcggttcgaggacgcttttttatcccgatgacaagttgagggaccttcggtgtactttttccggaaaaaaattctgctagatgggccacattttcccaacaaatatcgggttcggcctctaggcttccatccacgaacgggggctctcaccggcccagccgccgccgacgcgctctgctccgctcactctctccccaccgcccaccgcatccgaagcacgcccctccctctcggtctcgtcgccgccggtgcgaccgcggtttcctcctccccgctccacctccgcaacacaaccgtcttcgagcctcgggcttcacgtcgacctcatcggcaattcggcaccgcaccctcccctccccatcgccgggttcgccttctccgcgcgcaactcgtcgcgtcctcgagctcggctaattaacgatacttttactgattactgaagcggttaacgacaagtccaactaacaaagtcgtcgggttggtgtcagtggcccagtgtgccacctactcctcctactcaaagcctcaccgcctcagcatcgcacgacgcctaattaatcaattcctctcccgcgacacgcgcgcgagctcaactgcctcgcttcctccctcctcccgatcgaccgcgccatggctgccgccgccgtcaccaagtcgccgccggcgctggtgcccccggcggggcccaccccgggcggctccctcccgctctcctccatcgacaagaccgccgccgtccgcgtctccgtcgacttcatccaggtcttcccctcctccgccgaagccgccaaggaccaggccgcatcggtcgccgccatgcgggagggtttcgccagggcgctcgtccactactaccccgtcgccggccgcatcgcggagccggtccccggggagcccgagatcgactgcaccggggaaggggtgtggttcatcgaggccgaggcgagctgctcgctcgaggaggcgcgcaacctcgagcgccccctgtgcatccccaaggaggagctgctccctcgcccgccgcccgaggtccgcgtcgaggacaccgtgctcctcgcgcaggtacggattccatcacccattgttacttgagctaaattttccactgcaaatttggtctggatctgactcctgagaggttgggggttgtggatctgtgggggtgaggagggttggtcaccattgctatcgttgactcggtaatgtggggatgtcaatggcggcaatggtgtgaaaggaaaaggtctagctgaatttctagattgaacttgctgcaactgctcaattgtgtgactgactccactctgcagacagtgtgactgaccaatctgaacttgctgatgacttctgacttgctttaagacgtagtactactagcataaacttctgacttggtgtatgtatacagtatcacgcactactgatcccaagtgaaagtgatctatagctccggtggcgcggtgaggtgaactggaccgcgcggtgtgtgtccttccctcaatcctcatcctggtggcacttctctcctcgccttctaaccgttggatggatggaccaaccgactggatcatccgacactctcgtagtcttatgccctgcttgagttgcattacccgactttgaaccgcacacgctcctgagtcctgaagtgtttctgggagatatattaaggccctcaacgaaatttaacaaaacctttgacacaaactgctcaattcctgagtcctgaagtgtttctgggagatatattaaggccctcaacgaaatttaacaaggccaatcacactgtctgctcaatttctagattgaacatacacatatttgacacaaactctaacagctagacaataagccttggaaaattttgtacaagatatcgaaagcaacagatgctgcaactgctcaatgtctggacaccggaattttcatttttgcttgctgctgttagtgaattccatagttccaagcttgcatgtgacgaagagatggtctcatgatgacatggcatgcctgggctgatccaatctgttaggtagttcatgagaattgatatccaaccttgcaaatcattgccatgctttctcttccaagcttgtgaggatgagggttcacatagtactgtcctttctacctacatagcttaattacattcaaggctgcaaggatgaggatgagggttcacatacccctaatgctttttggatactatgatatgatactccctccgtcccaaaatatattttgggacagagggagtacttagttacaaatagattttggtttgattcacatgatgacattatgcgtgcttctcaataggttgaatgttttaactttctgttctaagttcagtgaaattttttcatgttggatgctaaagaggtactaagtcgatgacaattttcatgtaaatgttgttcatgccacacatccttggtaccactacctgttaaaatagtctgacactaagttgacattgtaacatggcctgtattagactagttactgaatttgcatgttctgtgatttgaatgattagtttttcaatttcctttccttcagattacgaagttcacatgcggtggatttgctgtgggcatttgcttcagtcacttggtgtttgacgggcaaggtgcagcccagttcctgaaagcagttggtgagatggcaagagggctccctgagccatcactcaaaccaatttgggccagggatgccattcccaaccctcccaagccacctctaggaccacctccatcgtttactgcattcaactttgagaaatccgtcattgagatctcgttggatagcatcaagcgtgtcaaggaccaggtcgcaagtgagaccaaccagaaatgctccaccttcgatgtggtcactgccatgatgttcaaatcccgtactttggctattgactttgcacctgatgccgatgttcgtctgggttttgctgctagcacacgtcacctgctgaacaatgtgctgccttcagtcgacggctactacggtaactgtgtctaccctggtggcctcgccaaaaccagccaggaggtcaaggatgcgtcgctcgtagagattgtgacagcgatcagggaagccaaggatgtgctctcgacacggttcctcgattggatgagcggtggtgccaaggagaaccattacaatgtgtcgctggattacggcacactagtcgtcacagattggagccatgtcgggttcaacgaggtggactacgggtttggcgagccgagctatgtgttcaccctgaatgatgatgtgaacattgtgccgtccgtcgtctacctgaagccgcccaagccgaagcagggaatcaggttggtgctgcagtgcgtggaggctcagcactccaaggttttcggtgaggagttgcagaagcttgcatagaggtaacttcgtgtttatacgcctacacttcgcagcgttgagagctgttgtattctggtgtgttgaatagccgcttcttgaacttggttacaaataaaacaaggtggatcgtgtttgtattctgtattgttgttaccatactacattatacattgattgacattgttgaggcagtactgttacagttgagaacaaatgattccattgatttcaagaatttgtacaatatagtcctacatgaacattatctttcattttccacctatatggtcaagcctgagacggcctatttgtcattctgtggatatacgcaggaagatatttcacatgtcgtagtaacatcatatgcctatttaccaccaatctgtgaaacctattcataactctgtgtgatgaaacattctcagtacagtgcagtcagactagcatcatggctttgtcttttggcttattagccacaacaaaaatattaaaattttaaaacttaattttaaagtctacctttaggcttttcgattgttgtttattttccagcattagtttttaaatcactaaggacagtttaaagatacacaagtttttttttttgggtaacgatgaaatcattagagtttagaagactagcccttgatcatccagcttcagtagtgttccaagttcgtcagggcccgatggagctcagcacctgagcagattcagaaatgaatcttaggggggagaacagtaagaacacatgtatggtcatgtgaagtccactaatcttccaaccacgaggagctaccaacccactgaaacactgtcctcagtttgtcacagatcagatctaatcatctatacctaacaaaaatgcctgaaaattccacacgagaaaaagaaaggcaaaaaagaagtcaaccactctcactgagcattgagagctcgtgctcgccacttagcaacaaccacttccattcattggggagggaaagcggcaaagcaccagcccagccagcgcggcgccaaactccacctaccgacgagagagagagagagagagagggggagggcatggccgccgccgccgccgtcgccgccgtcgccgccgcggccgcggccgcggagcccaccgtctccaagtcggcgccggagctggtcccgcccgcggggcccaccccgcgcggcgcgctgccgctgtcgtccatcgacaagaccgccgcggtgcgcgtctcggtggacttcatccaggtgttcccgccggcgaccggcgggcccgcggcggacggccaggaggacgccgtggccaggatgcgcgacgggttcgcgagggcgctcgtgccgtactacccggtggccggccggatcgcggagccggcccccggggacgtggtggtggactgcaccggcgagggggtgtggttcgtggaggccacggcgagctgcacgctcgccgacgtgaacaacctcgagcgcccgctcctcatcgccaaggagcacctcctccctcgccctccgcccgaggagaagctcgaggacctcatcctcatggctcaggttcgcaccatctcctccccaattcccaattcccacgatgcagctgctcgatcgattgatggttgaatccagcgagagaaattttaggcgctgattaattcgagatcttgttgctttgcacaggtgaccaagttcacctgcggcggattcgcggtggggatctgcttcagccacctggtgttcgacgggcagggcgcggcgcagtttctcaaggcggcgggcgagatggcgcgggggctcccggcgccgtcggtgcccccggtgtgggaccgcgacgcgatccccgacccgccgaagcccccgccgcgcgggccgccgccgtcgttcacggcgttcaacttcgtgacccaggtggtggacgtctcgccggagtccatcgcgcggatcaaggaggacttcagcgcctccccgacgggcggcggccaggcctgctccaccttcgacgccgtgaccgccgtggtgttcaggtgccgcgcgctcgccgcgtcgtcgctccccgacgacgccgaggtccgcctcgggttcgccgccagcacgcggcacctgctcgccggcgttctcccggcggtggacgggtactacggcaactgcgtgtacccggtggggatcgcccgtcaccgcggcgcggtgcggggcgcggcgctggcggaggtggtgggcgtggtgcgggaggcgaaggaggcgctcgcggcgcggttcacggactggctcggcggcggcggcggcggcgaccactacgacgtgccgctggactacgggacggtgacggtgtcggactggagccgcgtggggttcaacgaggtggactacgggttcggcgagcccgggtacgtgttcacgctcaacgacgacgtcaacatcgtcgcgtcggtgatctacctccggccgccggcgcccaagcgcggcatccgcctcatgctccgctgcgtcgaggagccgcacgccgccgccttcgccgacgagctcgccaagttcgcctagatatacgtgccatattgccatgacgatgtgtgtaaggatctcatctcatatcatttgggtcacaagttcacaaccctgctgctgctggtttgtgcatgtaaaattcgatcaacgttggaattcgtgacgtttattcgtgtcttaacgagacgttatgtcgtaactttggcgcgagagggaataaaatccagtgaagtctctggtttacatctagtcggactatcaccgtttggtataaccgatttgagatattttggtgtgtgattatgatcgttcggacagcctattctgcgaaaatgctcaaaatgggacgctccccccccccctcccgcccccgcgcgcgcccctcccactcgcctccaccattcgcgtctcgttgcaacaaatctcccacatattacagaaacaccctattaagagaaatccggttttttttcaccaacaatgttttagctaacgtactcatgatattttattgtgtatggatgaaatgatgttttattgtgtatggatgaaatgttacagtggattttgttatagtttcatattttcatcttaatgtacacgtggtttgttgatgtacacggggtttaagtattgcagtggcttttaattgtttgttgcatacgttgaaccaaattcttttatccagtgatcttactgtgtttcactacttttttttaagaattaaaatatttttttcgctatttactgaaacattatttttatatagggtgaaacaacggtcgattttttagaaacggttgtttcatacgttgttggtaatgtttcagctttttacaaaattgaaacattttcgacctacttagtaaaacatgttcgatctacttggtgaaacagcgaccaattttttttttaaaaaaatcgggcgcctaatttgtaggcgcctcgcctattctgcaatcgcttgcaattttgggtggttgtcagtcgattctgtgcgccgtgaattatgcatccaacggcatgctgaaacacaaaaaggaaaaaagagcttgcgcaaaaaaaaaaacgaatgaaggttttgggcccatagtctttttgttttggactactttgggctttgggctttgtgtagtgttttgggctaatatctgggccatgtgagagagatgcactgtgatcttctctttgactggtttgcatgcatgtgcctttgggattttgtcaaaatattttgggcttataatcgtcggcaggctgccgtgacttccgctctgagtgaacaatataaatctttggctgaaaagaacttttaatccataaaatcgaattagttttgtttcatgcatctgggctttgggctttatgacattatgtgttgcctctcaagacaaagcaagacacgtgaagggtgaagagaggcaggaccaaaactcataccaagagacacacccatatattccagatcaaatgcactatattggattagaggaagcaagaggatcaggtcgatcgaaaccacagggacaaaatcagtagaaaatacaaatcatcagatgtaatttctattttttggttgatatgtagctgcttgatctgtctgccaccgctcttttttctgttgtagttgaaaaaagttccagtcctctgaaaccaaaaaaaaaaaaagggacaaaaaatagtctcagtagtgttgttttggattggatgtctgattccatcaatatatgaaatgacaatgctttaggatctcatttgcacttagtgggtcataactttatagattgaagggattatggctgaaatgacaatgctaaatgcaaatgatcgtgagagattcatgaaaatatatcttacaaattacaatctcacatgtgcgcatgttggccatgaaactgtcatacgtacatgcacatactatcttctttatttataccttctttatttatcacattacaacatgcatcagatatatataaaaagcaaggacctttcattattgtatcattacacttatagctagacacagcttaaaactaattagccaatcttgggaatctcggccacagtgtcgacccagaggatgacacggttcgggacgaccactcccaggatgatggttcctactgggagcacctcaacttggaggtctggacggtcagccttgattttcgccttggcctgctcgatggtgaggccaactagctccggccactccgtcttaagaccaccacatggcttgctgtctgatgaactcattctggtcacagcaaattaatgaagcaaaattcctgcaaatatagctaggattaatttgttgttgtgtacacgcaaggcacttaattcgaaacactctttcatcaaattaagatcagaacaggtacttacaaccaattgaaactgcttgctatcgagactgaaacgggtgttattgtccagcagaatgatagatgctctattgatcgattcttaagttgtgtgtgcgtttggtgtatgagggatggagttgtgtggtgtatttataagatgagaaaagaagcaaaacgtgcaatttttcggtgccgttaatggataggcttcccagtttgctgagatgagatatacttgtagacttattaatccttctggactcagaaaattcacggatgtaaagggtggcacgtgtgtgtggtggagactctactagtcagagaaagaaagtgtcaatttgttaaggtagtactcttctgcatataccacttggtgcccagatttgcagaaaacgatatgattaataaacattttacaggtcaaatttacaatgtgcaacgtggatataaatatgattcattggatcatgccattgtaacttcttcaatactaaaatataccactacaatttatggaattttagacatgcttaatttaataggtatttcaaatatgccactacatgtgtatttcttcgatgaaccaacttgtccatgtcttcttttttttttttcatcccctcctcctgttcatcttctgcaccattaccatcagagatggactcggccagttatcagcatggagctatagcttagagcagcactgcagcaggcagccaaatccatccaagcttgttgccgctgcctgttaaatgcatcgaatagctaagcactgacatatcactaatgcttatttttggttctaccatgattatggtttcatttcctctctgcgccacatagctactactattatttagctcgaaattaattaaatcttcctagctccaaatgcgtttagaagaattaattatactcagctctatatgtgcaaggttcatcgtcaaaattcaaatctgcaacccacaagtagccacgcaccatatggccaaatgtccccatgtccaaatcgttgaatatgcatccaacaacccctctacacgtgggtgcacatgcatgaagattgaagcctatccactaatgactagtccacgtaccggcccgctttgaaacttcgttatttacacacgttgctcgatgtattggtgtgctgtgtttttttttagaccaaattgctccgttcatatggtcctataaatgcacgcatatacgttacacaaatccaaatccatatccacacatcgcggtgcaaaaccaaaacccactgcagagaagaagcatcgatcaattcaagttaccaagtacgtactcctgtctctaccgtatgtgtctacctgtttaggttctttattatttgaatctacacatgaggagaggttccgttttttgattagtggcgtttggagtcatcgtttcgcttattcacggcatatttgtaaagaaaaataatttatgaataaaacttttatgtgtatgttcttagcgatttaaaagtaaaggctgaaaaataaacttcgataaaaaaaaccttgaaatcagctccaaatttaaggttaaaaatttaaattttaattaataagcataaacataagcgaaaagatgaggctctaattaaggtcccatttgcaacaattttaaagaacaaaatatgattcaacaagtaattaacatagaaaggtgtttctttgatgatctgaagatgcagtaatcatgaattaaccactcataatttgcaggcaacttggatcttctcgattgtttccttgcgaagatgagttcctcttagacccccaagacggagtggcccgagctagtttgccggacgatcaaggaggccaaggagaagatcaaagcagaccgtccagatctcaagattgaggtggttccggtaggcaccatcgtcactcaagagttcgacgagaatcgcgttcgcatctgggtcgacacagtggcaaagacccccacaatcggttaagctgaaaccccgatataggcatacatctagcaagtgtacgtccatgcaagtatttctggatatggtccagtatgataaataaataaataaataaataaataaataaataaagctgtgtatgagcgtgtgtgtgctcatgcatgtgtgtgttcacggttagcttttttttttttaaattcttgcatcaataaaaagtactacggagtacgtatgtactctttgaacaatgcgttatacgacaaatgagatgtgtgtcctcaatcgttttatctgaaaagatatcagcataagtacaaaattgctgctgtttacaacgtttcttcccatctttacctctttttaacttgtactgcctcctttcccacgcacacgtttctcaaatcgttaaaccgcgtgtgtttttctaagggtaacaataatgtatataacaaaaatagtccatataaatgggacctatgtatagagcttttaactattgtatagtgctactgagtcccatcgccgccgcgctcagtagcagccacggccgcctcccaccgccgccacgcgcagcagcagccgagtccttatatacataattaacaggttgtcaatacgtaaaaatcctcctaaatttgtatggattgagacattctttaggaatctcatatgattcaatagtttccaattctttatttcaaagggtcatatagtgaaagtgcatttatgcccctagtgggttttggtttattgatgacaaacgattaagggactaatgcacttattgagtgtataagcaagtgattagaacaatgaagaagctaggaaatagacttatagatggatgagaattaaagagaagatattgaagatgcgggtatgaagtgactacctatggcaagatggtgaagcgcaagcgacgcttagctacaatggaccatgcagtggtgaagggcaagcaaggggcttagcgccgacgaaccgaaaccggtggtgaagggcgagtgaagactgtgtcgtgatgaaccgtgcgaggccatttgaagccatggattatccgtattaatcatttgagaaatggaagatgaaatgtcaaagatcaagaagatgagatcttcccaatgatcaaatgaccttgacgttggtaaccctccaagtgaagaaacaatatggtgtgaaggtactcctattggtataactttgctttttaaatttgagtttaggatgccgtactattaagagggataccacatgcatataattggttgaatactagtgctcaaaatgcttcatgtttgtgtgagttgaaaaacctaagccaaaattttaatcccgagttgtttcacttgtcacaacacttacatcgggtttcattgcaagtttttcaacatctcttgaaggttttggaccatgttttatattgggtttgatagcccacgaaactagctttccatagagtccaagatcttcgaaatcggagttcggagtaaaaagttattgcatttttacttgagcagatgtatcggactatccgatttttcacagaacttcattctctgtctttgtttgaaaaatcctttcgagtgagtttttctaagtgtcggagtatcctatgttggatcagatagttcgatgatacagagactccgaaatttcatagaacttgagtctctgtttgaggacgaagtttttgcttctaaaatatcagatactctgatttaacatcagatagttcgatgtctcggaaagtccgaaatttcatggaacttcgttctctgtttctcgttgccttgaaggtttaaaatatcggattatccgatcttgtatcggactatccgacgtgggctgaaagattcccctccaacggtcacattttgggggatctatataaaccccccaccaacccttttctagggttgcccaaactgatttcattccaatcttgctttgggttgagctttgtgctaagtgctttggatctttgagctctctccctctctatctcaaatcccccttgttctttgtgacttggatctttgtgtgtggatttggtgtttgggagcctagtgtgtgtttctctttatcttgagcactaggatttgtccaagagtcgtgtggtgtttattactcttggaggttgaggattcctagacggctaggtgtcgttcttgggccaccgatctacgtgtggttggccaagagaagtttgtgaaggccggatctcgcctccgcaagaaaagagatacccttagtggaaggaggagtgcatttgtgcaacctcacgaggatagggttgaaaaagacccggctctttgcgagcccctcaacagagactagaatcccctcaaggatttgaactccgggaaatacattggcgcgtaaacctcggtgatatgctcactctctttaccttcttgtaccattgctttgtgctatgctaatattgttattggtcgagctcacctctttgcttgtggattgaatctagagctcttaggttgttctcttgtttgtattgttgttgtgcaggtcagatagtctgatctcagttcagactatctgatcacataggactatccgacctgatatcagacaatccgatcctgttttgttttagctttcgcatttatttaaaaaatcgcctattcacccccctctaggcgacatcaagatcatttcatataggaaaaataaatcctatataggattataatcctaaaaaaatacaaaatacctatacttttcttttaaatcaaagagcctaaatgtcttgtaaaatacacttgcagaattatgtttggcaaaattttgattttttttctttggtttatgcaaaattggtcctaaaattaaggggcaattacttatttttagtaattgaccctgtttcgatacctaactaccaaattaaccctaattaaccctacttttttgaagtttgcttatttgacccttcttttcaaaaacgaatgtactatctgaccctaatccgttaaggtgagttaacggtgttaagctatggacaaattatctcttttgtccttgcttatttgaccatgttatcaattttgaagaattgaggtgaacaattcaatttgataaatttgatatcaattttgacagattgttgacacaattatagaagatttttaaaaaatttcaacagcatattatcgtattttgtgatccaaaattgcatttaagtaagcatatacacagttaaagtcaaatacaacaacaaattcatgtccaacaaattcaaggaagaatatacatagttaaagtcaaaaccaacaaccaaattcatgtccaacaaattcaaggaagcatatacacagttgtagctgaatccgcgctcccaccaccaccgcgcacaccagcaaccgccgacatcccgctgccaccatgtgccacagcagaagccacctcccaccgccaccatgcacagcagcagcagtcgagtcccgtcgccgccgcgctcagtagcagccacggccgcctcccaccgccgccacgcgcagcagcagtagccgagttccgccgccacgcgcagcagcagccgagtcccgccgctgccgcatcagcagcagccgcggctgcctcccaccaccaccacactcagcagcagccgcggccaagtcctgccgccgccccgctcagcagtagcctcccaccgctaccccgcgaagcagccgcaactgactcccaccgccgccatacgcaaccaccgtctgcgcggatcccctacctccctccacggcctgccaccgtcgccggtgctccctccctccacagccggcaccgcagcagatccatgcccctccctccctccacggtccgccgctgccaccggtgctccctccctctaccaaccggtgccaccgcttactaccgtgcgttgccgccgccactcgccgggggaaagagagaagggatacgagagagagagaatgatatgggatgggatacacagagatgtggataaggttggagggtatttcggtcactacgaaaatttattatatttatttttttaaaaaaatgattcttaacggtgttgtagaagcagggtcagacggggtgtttgttttcaaaaatcagggttaaatagtagggtcaatttgatagatagatttcataatagggttaaataagcaattgcctctcaaattaaaatttaaaacccaacaaattgtaaacatactgcctcaccagtcacaaattgtaaacatactaccacctcagcttgctaggcgtattatattagctggaatcgaactcttccacgaaacgaaacctccaaagtttttatacacacgccaaagcaaccatccgattacagtttacagattttaatttcgaaggagagagaaaaaaaaaagaagggagagctcgcagtcgcagcgccggcggagggagaagacacggcggcgatggcggcgcgggcggaggcggcggcggcggcgccgcggccgctgcaggcggcggcgatcggcgtctgcgcggagacgggcttctgggacgcgctccgccgcctcaagctggacgtcctcggcaccgacgactcccccatccccatcaccggtgcgaacccctcctcctcctcccctacctttgcttttgttgttcttagttccgatgttttcttccccccgaaaacctgccgtctcgagcggggaacgggaagcgtgcgtatccccgcgtctcccaggcttcccccatggaattcggacgcggtggtggttcgtcggagcgattgttaagagccgtattgtttgcttatgggtggcgatgccgagtgtggatgcttgtagattaggggtttcgctcgcctgagttggtggtttgtgagcggaatattgtttagggagaggttgcggcgatacgaggttttcctgaatgccacattgagttggtctccgtgcgggagttcatgattttgtcgtcgtaatgggtgtatagtaatttggattttagaacttcttctgttgtttaatgatcaatttctagcccgaagccctactgtttgttgtcattactgattgctctttctgcaatattgctgttagcacccaaacagtgatgtatttcagattgtctgttgagaatcctaagagaagtactagcaattagcaaatataattcaaattttgctaggtcattttggttttttagtttggtcgtccatgtgttgccgtgtgaatggttttttcatggtttgatttctcaatcaactgaacaagtttgctgaactttattgctaggttattatactccacgccaatatgagaaaattgcaagcctctttaggatatgcccagaatcgatactgccaccttctgccaattcctttggcgataggaacaattgtccagtcccagggaccctactaaacactaataacatgagaggattccaaaacttggacagagcacttctactgaaagctgaagcaaagaaggtacatgcttgacatggaattttgctagcattaccactaacactactagtttcttaaaaaaaaattaaagcatgtaatatgtgttgcagatcttgcatgatattaaatctggcaaagtagaagagaatcctgctttgctactaaggttccttgtgatatcatttgctgatctgaagaattggaaagtatattacaatgtcgcattcccctcgttgatttttgactccaagataactttgctcagcttgaaacttgcctcacaagtgcttaagcaagaagaggtcatgttcctttgaaccttatagaattacagttgacaaaagatttttcttgttttaccatttccttgttggcactaaagattgttctatttctgcaggcaacatccttgtctaatgcatttactgagtggcgtaaatcaagtgaaacaacaggtttgagatgaatacctaattgggattgttttacttggttatgtcacttgatgcctaaactgtattatattgaaatttctgcagttgttccattctttctgatcaatatatccccagattcatctgctactataagacagctgaaggattggaaagcttgccagggcaatggccagaaggtctgttttgtgcaatacattttgtcatttcatgttttttaccagatgagttctgacaagtgatttagaagactccttatttacctatcattcttcatgcatacctttaatttcatgtgctaatggttgaatttgctgatgcagttgctattcggattttatgatcatggtaatcgaggttttcctggatgggctcttagaaattatattgcattcgtgagcctgcgttggaagattgagaaagttcattttttctgctaccgagaaaaacgaggacgtcctgacatacagcagtcccttgtcggcgaagcatcatttccggcacctcatggtaatttcgtacatctgagaaaaaaaaatagggggaggggggatcctatcaaaataactagtaattttggaagcttttaaagctgacactggttatgctttgtaatagcaggctgggatgaacctgattatgtgcctgaagcaattggatgggaaggagaaacggccgggaaggaatcgaaagagatgaaaccgaaagaaattgatctttcttcaattaatccagcaaggtagattaacatttttttctgggatttggaaataatcagtaattgattgaattacctttgattgctttaataagcacagtcaagatgaagaaaaacagctgatgcacttgaagcttatgggatggcgccacttccctgtgaatcttgacaagttagctggggtccgttgtcttttgttgggtgctggaactcttggatgtgaagtcgcacgcctacttatggttaatgcttttagctgacacaagatttatgttccatttttatggttaatcataacagggcatttaaatgtgcgtatcttttctgctgttaatttatgggtttttttttcagacctggggtgttcggaaactaacagtggttgatgatggttgcgtttccatgtctgatctagtcaaacaatccctctacacggataaggattgtggtgtcccaagagtgactgcaatagtcccacatctaaaagaaagatgttctgcggtggtgagtctttgcagccttatcttaaaatctatgttgtttacatatttctctcatcggtaacaattgctatcatgcaggaagttgaaggcatccaaatgggaataccaaagcttgagtataatatttctgccagcaaaatatcaagtattactgatgattgcaagcgtctccaaacattagttgattccaatgatgtggtcttcttgttgaatgaaacatgggagggaatgtggcttccaactcttttatgtgcagacaaaaacaaggtaaatcgtagacaaccactctgtaattaaggaccttttgagtagttctcataagagagaagtgaatatcatgcacttttaggagatcaggcttgagtggcaaatctgtcaatagattgaccatgcaactcagtttagtattcttcgccttccatttttcatcacatagagtgcccttgggagttggaactaataatgagttggctccgctgcagattgccattactgtgttgttaggatatgacaattaccttgtcatgcgacatggtgctggtccaggaacaaaaagtggaggtatggatgaagggattgctcagatagagaatttgtccacacaagacgctctcggtcggcaaagattgggctgctgtttctgcagtgatactacttcccttgttaatgtataactgtggaaaattactttatttgtgttttatcgcgtgattttgcatttatgacataattttggtatgcttaatcttattctttgcagtcagatcataatggagcactggatcagcagtcggcagtaatattacctgggctgacctcagttgcatctggcaaagcagtggagctctttgctaggatgttacatcatccagatgagtaagtatacctacatgaaagataggtgtaaagtgcaacatacatttgtatagcattgtctgtgatagttgaatagttggttgacctagtacatgagaacataaaaacaagatgatgccttatagaattttacttcttgtagaattcatgctccaggagatattgctggtacagacactgagcatcagcttggtctattgccacatcagatgcaaggatcgctctcaaagtgtgtcttgtcaactgtgctgtgcaattcctcaagcaactgtattgcatgttccaatgctgtacgtaaagtagaacatatgcaggactaaattctcataattctatttattctaatgtttctgcatgctattacaggttttatcagaatatagaagaagaggatttgattttgtaacgcaggccatcacctgtccaacatatttgaaagaccttacaggcatatctgatttgaaaaaaccatttgcttctaaaatttcagccagcattcctgtttctaaaacttcggccagcattcctgtaaacctagagaagctgtccagtgcccgatgtctacttttaggtgctggaacacttggatgtgatgttgctcgtattcttatggttagtctttgtccagttctacttttatgttgaactacgaacagacttaacaaaacatttctttgactatggtggaaacaaaacttttcaggactgtggtgtgcggaaactaacagtagttgacagtggtcgagttgttgtgtcgaatttggcaagacagtcactctacacatctgatgatcgtgacagcccaaaagcatcagcaatactagggcgtttgaaagagagatgtccttcagtggtaaatttcaattctgttccttcaaagcaatcttcattttctcacattcttgctccctttcatgtctgagcatatttcccttgtaggatgcaaaaggaattaaaatggaaataccaatgccaggccatcctgtatcacctaatgaagcagtcagtgtgcttgaagattgcaaacgcctccaggagttggtatcttctcatgatgctgtcttcttgctgaccgacacaagggaaagtaggtggcttccaacacttctctgcgcaaatgaaaacaaggtaattcttgtgtgtattcttcactaatgtagacttgtgaagtgttacatgataatatccctcgcaccgcagattgctattactgcagcattaggatatgacagttaccttgtcatgcgacatggggctggtccaggcacgaattgtggaagtccagatgtggttgctgctgctgatacactgtctgcagaagatgttcttggtcgtcagagactaggatgttatttctgcaatgacgtcgttgctcctgttgatgtaatgttgcctaaactttggaaattatactctttttacttaacatgctacattctgcaactgtcacatcattttccttaaccatcttgtgatgtagtccgtgtccaaccgaacactggatcaacaatgtacagtaacacggcctggattgtcctccattacatctggctgtgcggcagacctcttcacaagaatgttacatcatccagatgggtaagtgactggatacctgaacataatatgaacttgcgcgatatcatttccagggaaaatgttggcggcatttggtgattgaaaaaccaactgcatttaattgatctttactacattctgcaggatccatgctccaggagagattgctggcacaagcagtgagggtccacttggtctattgccgcatcagatacgaggatcactctcgcagtacaacttactaaccctattgggctattcctcgagcaattgtaccgcatgttccaatgcagtaagtaaacatttatgattgcatgatttggaacagtttctttagaacttctttcttgtattgtattgcttcttcctcatgtgatttggtgcaaaatattgcaggtgttgtctgaataccataggagagggatggattttgtgatgcaggtgatcaacgaaccaacctatctggaagacctcaccggccttactgacttgatgaaatcagcggcctattctcaggtcgagtggattgatgaagttgacgatgacgacgagatggatatatgacgtgttgcatgttttttttttcatgatgttaacacgtgtaaatacaattcatacgcatacttagtccatcagacgatgagaatggcgttcttgaatctcgaatagcctcttcttaaccaactagcaaatcacagtgtaaacattaccaatctctggtgcaacaaacaattgtaacctaggggaaaaaaatgtacactttgctaatattcaatgctaatgttgttcccattctcaattccaaaagagaacgttgtccccgtgttaaatcgcatcgttttctatgtttctacgcttgctggagctgcaccgtcgacggctgcatgcgcctcgttgtgccgcaagtactcggcgaggcagaacccgaataacgcagaaactcccgcgacgtcggcgcccatgaccagcaccccggcgacgggggcgacggcgacggcgagcagcgcggccaggaagccggcgccgaagacgagcgggaacgcgaacacgagcgcctccacgggcacggcggcgccggcgccggccgcgaggttctgcgtgacgtggtacgcccagaggtagagcaggaggcagagcacggcggccagctccgacgcgagccacagcggcgagccgccgtagctcagcagcatgagcgccatcgtcgccgccaggagcagcgacagcgagcacacgaaggcgtgcgcgttcgcgtgcgtcctctgcttcttcctctcttccgcctcctccttgctccggtcgccgtaggcgatgccatcgccgtcgccggccagctgctgcttctccttctcctccatctcctatacaggttggcttggctcgagttgtgcccgtgcacgagctccttttattgctccgagtccggagctgagctcgagtcggattgcatcccgacttactctacggattcggtggcaaaaataactttgaagctttcagcagaagaactggacagcaacagcaaaagaggaggtatattgtgtatccatctgttcttttatagattataacaagatagttactagctctctgtactgtacagcaactcatgtgccggcagaagtcacaactgatggaacatggaaaatcaaaggagcaatttgagtaacatgtggtatgtacaagatacatgattcacccagctgcctgaaagtctccgaagtcgtcgtccacgctctcttgaggggccttctctgctgcagttggttgctcctgaggagcagcttctgctttcggtggtggggaagaagcgacgttatccgcggctggttgttcatgagaagaaggaaattctgctttgaaaggagtggtatcagctccagtatcagcagctggttggtcttgggaaggaaactccgctttgaacggagaagccgcgatgccagaatctgtaggagagaccggtgatggcggaggtggagggagcttgagggaaactggggcctccttggagttggctttttcgttaaatgagagcttgttgaggccttgctcaaaaaatgcagattttatctttgcgccggactctttctgcacagaacaaaagcaaacccaaacattaaggagatgttgcacaagaagcatataactacaaaaatcagaagagacgtcaagaggttatttctcaaatgatgtgccaaatctggcgtaggggcagtgcaaatatccttcaattaagttcaataaggctaagatggatccctacgtaagagcagctcaaactgatatatctacaaatatgcagttttatttaacacattacatggaaaatagtctagagagcaaaataatctaatatgaatattactgagaaatagtaggatcctgtaaaccattatacggttagcttcatttcaacaagacaagaaacttattaaaacaagtttgtttgaatacaaaagtacttaagacacgttcatcacacatgccgtataagggttgatatcttcgagccatgaataggcattgtcatatgcatggtaaacctggttgtcatgatatattttttttacaactgataattctgagaattggcacagataatattttcatcttaataaatttcacggtttgacaatttatgcgtgtcaatgcttggagtggacacaaaaattaacttcataataattatgtttgtgaaaccaaatgttgaactacttcctactcaatatataaggcatcttatgagtgaatacacagattaagaatttaaaatggtaatacaatcaagataataagaacagacaactatcgttcttaaatacctagggaattggagaaagaataaggccaaacatcagaaaatcccagccagaaaaaactggacctggtacctgggccaggctgttctggccaatgggaccgttaaaatagctgacaagggaaaatcccggttcaaccgccggtttcttagcccaccagaccaacctaggcaggtaacgagccattcaaaatttgcaaaagtagttagtgacaactggaattcaaactcaaaagatgttgctaattgcttgcatgggcaaaccaactcggctaacaccacttgcttgtttctactagctgttaacacgcctacaatagcacaagaagtagtacgctcatgtggtctgagacccgttgaccaagcgattcaacctcttacttactgatccaagtcctcggacaagtcaatgtctggtctggatctaataacattgtgtgtaattactttagcaaccaagcagctctagtggctttaggtaggatgctaatactctagtactgagctaataaaacaacaattacatcatgaaggcctacagaaacaatttcacatcaccaatctctagtttgaccaccaaaatatgacacatgaaaacttacattttttagctgcaaaaccaaagtttccccttctttgaggctgtaatccactgatgatgatttctcatagtgttgtaccatctcttcagcagtctttttcttgtttagatatctttgatgatgtaagaaataacaaatcataccggaaaatggtccgttataaaaagaacttattggataaaaatattaccatacacaactacaactgcaaaaaggaaatacaaattgaattcattgtgaccaaaaacagaaacatttcatctgaccgaccaaaagaaacataattggcaagcaaaaaagtacatcctatgaattgattgtatgggtagaggatttttttgggttcatttagacctttttaataataaaatggttgaacattcaaaataataatctcacacgtacgcgtgttaacaggaaatcaatgtcatgttagaccattttaatgatactgcaattgaatcaaattcacatacagagtccccagccattgagtgattacatgggagaacattcgaatacatatcatgcttcaagtaatgaacacaaggatacttcatatggtcgtgcagagcagcttggaaatcatatgcttgaggtctttcacggaagcctaaaccaataaaggcatggcgctgacgtccatctgaaaatatgtggtaagatttttttaataacttaatatatttctacgtatggatcaatgcgataactgataagccacttcaaacactatgcttaccacctcaacactatgatcaccaactcaatggaaaaaacattaagacacaagaaagtcataaaaatcatgagaagatcagcttatcacctatattctcttcaacacggagtacaaaatatctgcaaaaacaatgttggagtagcaacaatcatttcaggttatctttatacagtctctacatagtaacttatgcagaatagaaacactaaggacaaaagtcaccacaggattaaaccaccatgtggcagggaaaaaatgcagacctgctgctatcaataacaggttccaccggatgtggttcgtcttctctgaggaatgccctagcgtacagctcccctaaaaatgtgtccgaggaatcaacattggtgatcacacaagcactgaccaacggcactaccgtgattttttttgtacctgtgttcttatcttccagtttgatgatgcactcttctcctttgctgacaaccttgagagtcccttcccaagcccacttgttgacgttccattcatcagccctggttgatacccacggtttaaaaaatgtgactcaggctctcggctcataaggtcataccaaaatcagaacagaacaagtacaacaatggagtgagctaatccaagattgccgcattcgatagggccaatggaacgagagttctcgaaacaggacgacctatagctaattcagattgttatctttgatctgtctagcccctcacacagtcaaaccttcaaactacatagccttgctcccgcggacaaattgaaatgtgaatcctactaagcccatttctatcgggatttttttgatgaaccaagactagtatatacctgtaggaggcggctgtcttcctgggaggtatctgcgtaaagagagagaggattaaaaaaaaaacattagcacgttcacgcacacatagtgctcgacgaattgcgcgcccccaagagaacacaagcacgggggcacgaagcgggtcactgactacacacaccctaaacagtcaaacaaaccggaggaagaacaaggcggcgaggggggggggcgcacggggcgtaccaggtagacgtagcactcagcgacctggaacagcacgagctccaccgcctcctcggcctccgccttcgcctgcgactgctcgccggtgctcgacatggaaccggcgccggatcttaccgaggaggggagcggccggggaaaggaggggaggggggaaggctggccggatccggcggcggtgggcgtccccgaatgcggcgacgcggaggcgcgtgagagaggaatggatttcttcttgggggggagagagactgagagagagagagagagagagagagagagagcggtgggagaggaggaaggtggggaagggaagtgccgaagaggggagaggtttgcgtcgggttcggggtcggccacgcctgtttggtcttgggtttaggtgcggtgttgcggtcgtgttcggctgacccgatcgatcggtgttgcttccggtttgggtttcattccacgtatccggtcggtgtggcgatcagggtcacggtatataccctttgcttagattcggctcaatttgaaagattagagatgtccggctccattggcttattccgagaataaaccatacaatatatctacaaataaaaaataatttgtgaataaaatttatatatatatatatatgctcttgacgatctaaaagcaacgactgaaaaataaactatgataaaaaaaacccttataatcaactctaaatttaaggttgaaaaaacaaattttgtcttataagcataagcgaaaatatgatcgcattgcccatgacttgtttagaatgtgagattttatagcggtacaactcttcagtttatagcgggttaataccgcacgataataagaaattactcttttataatactgtaaatgatcgttttccatttgtcgtaaagtttattgacacctaaaatgctatcaagttggttcgcaccgagctcgatcatcacataccatcaatctggtgctcaatcctgataactatagtgcaagctttgaccgcttcactcaagctccacactcacacacatgagttctgtcggtccgcactcaccactcgagctctatggtcatgtggccggtctttagatctgctaatcgatttcccctaagccctattattgtgctcaagcttcatggctttgtgcgcgagcatcactgcctagccctagacttgagttctgcaatccaacataagctttgaaactacgtctgtatgctttgttggtctcacatcttatgtccggtagccccatccccaagttttgccaaccttgaaaatgggctctactacacgctgagagattggtgagcaattggcgggagaacgaggaagaaagatatatccgtccttagttgtataagtgttacttgtgacaaaaagaagtggacatcttctctatttttttttacattttagagtcaataaacttttagataaacagagatgatcctcaactatattatggcataaaatcaattttctccttacagcttattaactgtaaagattataaaatttaaaacattattgttagttcattattagaaaagaaaaggactgaactaccccctaactatagggaccacacgatttaccccacaaaaccacaaaaccagacacccccaaattttcataccggacagatgacatcccccaacctgatttgatctagagcggttttggtcctactcctacgtgatgcgcatgtggcaatctcgtcagcataaaaagtttaaagaacgatgagccagttagagggtaattaggactttttcttattaaaaaaatgaaaagaacattattagtaacaaaaagagagtcgagatttatcagtgtcagcgacgatacgagtcctaaaatcaggtaaaacgtcagagcgcataaactttgcaaccttaaaatatagccaaatgttgtgtgcacagtgcaccgttgtactactttcttggtgcttgagatttaatctatatatagtagtcaaatctactacaaatatgcttttggaatgctttcctcgcaccttcaggagcaactactcttggtttcttcaaaaccgttgcagtcatggatctagcttgctatcttgttgggaagagaaagatttgattgccttttatagtttcatagttagtcctagacgaatttcaagagcttatgttaatttgaccatattcaagagggtcttttgcaaaagtgcttgcactcgcagttaactcccctctagggataaacttcatatgtgtctaattatctatcaatatgtatctaattatctatcaataaaaatgcatgggttttttgtaaaaagaaagtttactaacccaatcatggatgaagtttctggtaatgtccacccggctaccagtcctatatcaaaggtcacgcaaaagcaaccatggaaacatacacggggaacttgtaaagcgtacacaagaccatcaagaagtgtaaaactcaacctgtggattatccgaattaatatgtcaattgtccgaggtgacaaagggacaaaagcacaaagcattgttcttgaaccaagaacagtgcaaaagtaaaactcaaaatctcaaaaactaagattttgcaccagccgggaatcgaacccgggtctgtaccgtggcagggtactattctaccactagaccactggtgcctcttgttgtaaatttagaaaacaaagttatataatcaggatagtaaacgagattcagaaacgctgtggtcttgctgttgtagttccacacaggctacttgggtctattcagtcagcaaggtaaatcatggggagaatatcatcgacatgtttgatctgaaaactacttgagcatatgttccttattgttttaagaaattttgttaaggagtacgatggaacaggcaaatactaagtttcagtaactgtatccttggtttcattaatatagttgctgctcaccttggtcgtgatagtgtttaggtgcaagtagaaaattgaaccaccgttttcttgaaacgtcttctttttttttaatgtaagtcgacctgtaaatcccaacctaacatcctggttccctagttaacaattgccacaattctcacttttttaaagaatagtcacaattctcacttccaatgcttaatctttcaatcccaaacaaagtttctttactgcaaagtagaagagttgaaaattttcaattaatatctaccctattttcataacgtctcgtatcttatcgatattttgcctaggatttacaacaccccatagttggtggccatctttctaagttctatgcacgtgattaaatttatactttaaaacatactacgttctagagtcttcagaaaagacaagtaaaacaaccatagaaaaactccactacttccatgtatgacaaaccacaataaaatataatactatttattttactaacattaatatcaatgtactattagggacgaagctatgaatgcgagcatccaagtttgaactacggtgcatatacgagaaaatagataaactaaaacttaaaaaaaattataccgattttctggagttctcatcttctcgtatgttccacccagtcactaaaaaaaatttgagcctttttcaatatgaaattcagataaacaaactttataagtcaaataagggtaagagcaagtttaacagtatagccaactactagctccaattcatatatagccaatctaatagcttattcatacaatagttacatactacactattaatatctggtctcatctgtcatatactcactgcatcttggagtccatgctacagctggctataaatctgtagcccgctgcttttctctcttctcatttattttcttaaaatatatttatttacagctagcttatagtctgctattgtacttgctataactataattccttttttagacaagtcattgacgcgtccggcttggacaccacggatgcccgtgtccagaaatcctgcggctgccggcctgacccgataaaacccctcgaccgatcccaccccaacccaacccttgtcgaatccgaatccttcccccc

SEQ ID NO: 59766 - DNA, 688 bp, Oryza sativa
cgctcccgaatgcggttctgaactgtctggcccagcctttgcagcgaggacattgggactcctcatcctccctgcatacgagcacattagagcacatgatactcaatggctcgtttgcaaagaaccaccaatataaaaagaagtgcaaaagaaggttgagattgattgggacccttggaggaaattaaaaagaaaaacacctgaaccaaatctggtgcttggcactgcaggcagcatggggagattcccggtgatgctctcgctgccgccgcgcggaacgagagccgcaggccgagcaacggcgagagcagaggccatcgcggttagcttcccccgagaatacggtggaattgcggaggtcgcgagcggtggatattgggaagaactactgcttggccttcgtctgctgcagcggatgcgagtggaaggctcctcgtccacgaaagcaccatcggttggcagatttgcagattgccccttgccttctgcagatattctgattaatttccattctacgagtattactgtaccgcctgcctgtccgggagaccggggaagttcacgctgggatacagcttcagatttcgctaggtttatagtgcctgactagtgacacacagatgtaaaaatttgtatcttttttggagtatattaaaaaactaaaccgtcacaacttttttagtaaggg

SEQ ID NO: 59767 - DNA, 561 bp, Oryza sativa
ctatagcattcttgacttaactcagacttgaaatttccaatgggatattctgtcttgcactgaaatggatcagtttcattatggtaggtgaatataatcagtgtagctaaggaaggtgttctatcatttagaaatgttaatgctaataatttcattcacacgttcaagataggttagctttattatcttctacagatgagttggaagatctctcttttaatctgatagtgccaatgaatatatttcatacattaatggcattggcatcagacatgttcattgtgtgtggaaaaactaagtttgctcctttctcctatctattttcttcttgatgtgtatgcagaataaacgagtttaatgatgctattcttttcattgaaaagcctaaacctactgatgctttttcaataaaggaaaggtacatacagacaaaggtaaattattctgtccatcctttttatgctgaacctagcaatgctttcttgatattgatgtatatccttgttagtcatgtgctagttgaagattgaattccaatgtaacccttgccttttattttat

SEQ ID NO: 59768 - DNA, 47010 bp, Oryza sativa
  unsure (1)..(47010): unsure at all n locations
cccgtggtacggcacaggccagcaggcggcgtctcccctctctccctccctcgcagatctagccggaggaggaagggggaaggccgacggcggcgacgacggcgtgaagcagcggcggcggcggctcccctcccctcccctctcagatccggccgggggaggggggcggcggcggtgcggcgatttttttttcgttcgtttttttgcattttggcaggcgggctgttgcctcgactgcgaaaatcatcgattttcacagtcgttgtattgcaggcggacctctctctcacctgcgaaaataagttttggccgcttgggaaaattggttttctagtagtgccacacatacggtcccaaccccgtaacgacgaagagaatacatatgtatggctataatatactgctctccgtgatcggaaccacgcaacccacgaatatgaattatatgattgagagtggatgaatcttgggccaaatctttgaccagtttcagagatcacacgaaggaaagaatatattgaaaccaatccaatatggatgacgaatccgattggaacggcaggaaagattggagccacggctattgagtattgaagctcgatcagtacgtcccctggttgtgaccttccttagataagagtgatatggggtctgtttgggggagcttataagatttgagacgcaactagttggtagccaatttctgagaatctgtaaaagctgggttttccagatagacccatgatatggtagcactgaactagtaggcagacgcacctggtttctactactactacaactacccaacatatcaacttgctttgtgctgatatcgtcgtgggcatacgggcgtatctaatatcctgatgacccagtggctaggcaggggatcaacgccgtcacacgcacgctacctgctttgctcaacggatccatccagacatcctgtgctgttaattccgcatgagagtgatctacatcgcgtgatatggggtaatttcttcctcctaaaatacaaaagagattttaactgggtagtatattttgaagtgtaaccataggatatatggtattgttttttatagaatcgagcaaagttctttcattcgccttaaaatgttttgattgataacattttgttagttttagggtgagtacgggacggcagttcattcgggatttgtatcccgtttgaatgggatgatacctctgagatatcgcccgatacgtagttaggggtggatagcgagccggctcgactcggctcggtcaagctcgttaggataacgagctggctcggctcggctcgtttgaaagctcgagctagctcgttaggctcgcgagccaacccatccaaaccatccagccggcagaagaggagggacctggcggctggcgatggtggtggtgggcggtggcttgctggcgcggcacgggcggagccctaggctgtgcgggtgcggtggcgaggtggggaggaagatgcggacggaaagggaggagttggggtcgacttggaggtccttggaggcgacgccgtggagaaggccacgcggcaggagaccccgaacgccgccgcgtcgtcttctcctcccgtcgccgcggcgagcgactgaagcttgtggtggaggagcttgaagcaactggagcttgtgcccgaaacgccgtcgcgtcgtcttcccctcccgccgcagatcacccagctccgtcagcgcagtgaggcggcggcagtggccctagcggctggtggtggcgaactggcgatgtgtcgtgtggtgcggccgtgccacgtgcggtggatgaggagtgaggagtaggaccgaggaggactagggttttgcttgcacttttgctgttgtctatttgtcttgggcttgggtctttcttttgtattgggctgggtctttgcggatgtctgatggagtcctagctcgttaaagctcgcgagctagctcgagctggttctttatctctaacgagctaaaatgccagctcaactcgttaggaaattcaaacgagccgagccgagcatgtcacgagtcgagcgagctaacgagccacgagctttctatccatccctatacgtggtaggtatcagctgatatcttgttcggacgggaaggtattacatgatacctatttggtatcggctaatacccaggtatcatcccgttcgaacgggataccgttctgtagcatttccataaatttaaaaataaatttatttgatttttaggaaacttatatagaaaacttttgcatgcatgaattgtattgtttaatgtagattacaaaacgtgctcatggagaataacaaatcaagtagccgtttcgagttgctattagaacttaaccgtagtgttgagctagtagtagatatactgcccgttcttaaattttttagatgatcaagtggattttggacaattgcatataacaaatatattatatattataaataacaagtagcgtaaaaaagttacctaaagcaacattgatgaagaaagtaaaaaagaaacgtcatttagaacggagttgcaaaaaaagatggcggcatattattgcgaaaaaaaatatatgtcggtttcttgacattctatagcccgggattcgtgctataaaacaatagtgaagcagcagcgagcggggaatgaaacccacgaccttaaaccatgtgtaccagggcagccagctcaatttttaacttacatacaatttacttttttttccagataatggaatataatcccggcctttgcttaaatagctacagccaattattacaccaattcaacaaaaactcatacctaaataaacaaaagcacacacaaactaataaaaactcacacaacataaaaaaatcacaaaaattttgaataattctatttgtgaatctacatccaaagttagcgagtagctgataaccattgacttaagattacgacatgcagctttcactgacttgatttcttcaacacactttagtagttgaacccaacatcagagctagtatgttgccttgaaaagaacctacatacaggatatagatggtgatttataaaaaccatatcatttctatacaatcatatagccctatttatagcagatgctccaacatacaattttacatataatgtgatgtaactacactatatttttactataattatatttggcatacatatttttggatatttccaatttaaagcatgacatatataaatgataatctatgaagtaaccacaagctaaaaaagaaaggtctgacgggatgatcacttgatcagctttctgtgtgctctcgtcaaagcatgataagcatatctcagaataatcagtcttttctctatgcgatagctacatcctctagagcctacgatctactagcttgttgaaaatatcaaacctcacaatcgaaggcagctgggtttcaagttaccatgggcgcttgtttggagacaaattgctaccgataatgcggcttgatgacactttgaataatggaacactgacagttatcttattctgtcatgcatatcacactaatcacttacacgtcaggagatatatataactggtctactggcttatattgtcttaccacttattgatgctgcgagctgaagctggtgactcggatacgccgtacgtagcaagcggttatccctccatgtgggctgaaacacgttttaatttgtatgacttttaaccttctaaattatttaaaaccttataaaaaattgtatgagctttctaccactactgcacaaacgattttcttggacagctacccttttaaattgcgtgcggacggtaactcggtccacacaggaaaatcggctcgcgaaaatgagccgattttcctatgcggctctcttaataggtccgcacaggaactttaaaaatttccctttttctctcctctcctttatccgctcagctaagtcccctcactcacgtgcgttcctctctctcacgcctcagtcctctctctctctcatgcttcctctcctctcctcactcctcactcctctctcctcggcggcggaccacggtgacgacgacgcgtggcgcggaggccgacaggaggcgggcagcacggaagccgggagcggcgacagcgacggcggcgcgcgacggcctcttccacgcggcggcagtggaggcgtgggatccgcgggcggcggctgtccccgcacggatccggcagccggccaccctccccccgcgcgggatccggctcccctcccttccccttccttccctccccagatccagtggagggtaggggcgttggcggcgggcggtgggcggcgcggaggccgggagcggcggcgccgatgggggtcttcagccggcgtcggcaacgggagcaggcggcggatccggcgtctgggagaccgccggcgacgggagtgggcggcggcagcgggcctcggctagggcggcggcggcggttggatttggggttttggttttgatttttcttttgtttcatctttttattttcccatgcaagcggctgcccgcgtgcgggtgaggtacccgcatgcaaaaatcgcgattttcgcagacccttcattacagacgggcgaaacaaccgcacgtgaaaatgagtttcgaccgcacggaaaaatagttagtgtagtagtgtactatattgtttcctttacgaaacacaatacagacgcatacatcatataaatgtgtgtacactcacccatatataacacgcgcacacacatctgttgacattttagatcacgactacggtatttgcatgatatggggatcattggtaacatggtatatgcgagattgagataaaagaggcagagacaaggatttttatacaacttcgggccccttattcatcagaatcaggtaatagccctacttctattggccgaagccggtgttgctcttattcatcataatcaaacaagtacagcatttaggataacctatttagtcatcgttgacttggcggcatggaaaaccaacacgtagttgacgacggggtagtctttctccttgaatatgtactcgtcgagatcagagatagtgctaaattcctcttattggcctctgtaggcgccagattgggtatatctaggattatctctaatatcaatatttggaggcgtgcattggtgtccacgtcccctctcctcttatgaggtcttgtatttatacccatagatgtacccttgtccaagtagaactagggagaacaatatggatataatccgagtagtccttatagtttccaatagaactctttttgtaattttttatccggaactccttctatataagagatatgattccgtataagacttggtatatggtggtctcgccgagtttagtcgattactattgggtatgtgtgtatccataaccctgataacatcctacccctataaatgcctccaagaaccaggccctacgaacgcctacacgtacaccttaactttatgaggacatgccaatatattttgagattcatggagtcgccatggctgtaccttaaaaaatatagcagacatatcttgagattcgagagacattcgaggactagactgacataccttgagattcacgaagtcactatagataccttgttatcgacagatatatttacaactagtggtaaatgtaaacatccttgtcaagtctaaaatttaaatcatgatagcaggtttcatcatcagaaatctaacaagttgacactctcttgtagcaactattttaattccctttactttatgaattagtttgttaacaaagggtggggcatttattcaagtgaaatggccggtggttagtgaaagataaaaggatttttataatgactatacaaagttaattaaattaattaatataaacgagattagtctacctagaaaccttttaaaaaactgtttgttttcatacacgataacgtggaaaacatacttagggcttgctcagattgatgtcatttcaaatcatatcgttttttttagagttgtcaaatatgttcatccattattttctggccaaactttaataaatagataagaaatcctgctaaaattttagcaatttggcaatattgccaaaattttgtaaagtttattttagctacaatctgaacaaccacttagaaatcaatgaaactactcttttttttatcatatttcatatttgacctattttttttaaaaaaatcaacgattataacacatgggttcaaatttcttgaatggtggggaagcatcagtggtagttcaataattaagaatgtatgatccaaactaaaattaatatgtgattctacttcttatacagctactatataacgttttgaagtcctcactatcaacatgtgagataggcgcacaagtagggacggatctaaaaaaaatagtagtgaggctgaataaactacatcaatataaaccgaacctccagtcccatatcctatgaatctatggaaaaaaatttaatgggagcttaggaggatctccactgtcccgaggacggtagtccgcccccattgtgaatccgccgctgcgcacgaggaggtcaacataacttatttctttacaagaaaaaagaattgcaaaaggagtgagcaatgatttgtggcccgttgtccacgttgctgccgagtgtgaaaacaaaaccacaggggtagtacaatataaacaacacgtcagagatcagacacccacctctccacctccctcctctcctctcctatcgtccccacgcgcactccaacttgcgggcgatttgttttcccccgatttcctctcgtccgatccctccccatcacgaggccggagcgccaccccacactgcctccgctgctcccaaggtatccctcccctgccctgccctgccccctccacctccgccggatttctcagccggcgtagagcggagatccatcagtggtggctcggatttgttttttttttcctttttgggtggtgatttgactccaactttctcggaccgtgtcgagagctttgctccgatcttctttttgaatcgctttgggcgatctaagcgtagactgttctctctgtctagtccgcccattttgtttcggattggtttggttcgtgcctgcgtggtggtggtggtgggggtaggtgtggctatttgtttccaggagaattgggggtggttcggctgaatccccaagctctatgataggtggcgcccctgactggatgtccactaattcgcagtattcggatgcccgctaatttgttcgatggaatcacacaatgggtttttttacccactatcatgttgcttgttttggcacctggcaacgtttgttcttatcccttctgatttgtagactagagatccaaacattgtggttggtcagtggtcaccacacaaatatcaaagccctgtttttcaactcctccttgatcggtacagatttatgtctcctgctatttattaccaatacaaaaactacttcagtgattgtatttctctttgaactggtattacttcgggttaataagaagtatcatgtaatttttaggaattccaattcctgcttgataagaatcagtgattgtgctaaggctccagtgttgactgcaggtgattaaaaacacagaaaatggatggaactgctggctaacagtcgtcaaaatttatatggccataggtaatgcatatcgctggcatatttgtgcttgttaattatgatttttttggcttatttagcaaatatattgatatgtttcccattgtttctgtagataattgtgcgatgtgtgtgggaggtaaaggtttctacctcaacagtaaggagacttccgacccttcaaggaaaaaccattccaaagtctctcagtatcggatggcatttgatgcaccaagaattactaaaacagagacatcaaagttgaagaacctcatttcagcatcattcaaacccttgtctcttaccatccccataggcgacggtttccatgaattgtttcctgtgggtcactgtcatttatagcagataaagtcttatagataagccaaagtttttcatttctgttggctaacaaggggaggcaaaaattgagttgcgctctcaagagtgtacaatgcttacacttgttggcacaagagattcttttgctcagtcacaggcacaactttgtgctggcatgcagctcaaggctccaacaagggcgaaatattcccaaggctttatgcccataggagaatccgacgcatactgtgctctaatacctggcttacctgaagatctcgcaaagatatgtcttgctcttgttcctcggagccagttccctgttatgggttcagtgtccaagaggtggatgtcattcctcgagagtaaggaattcattgctgtaaggaaagaggttgggaagcttgaggagtgggtgtatgtcctgactgctgatgctggatcaaaggggtcccattgggaagttttggggtgttcagggcaaaagcacagccctcttccacccatgcctgggccaaccaaagctggttttggtgtggttgttctagatggaaagcttttcgttattgctggctatgctgctgatcatgggaaggagtgtgtttctgatgaggtttaccgatacgattcttgcctaaacaggtattgttggcttttcataggcatcaataagtctatgcgcagacaatagattttgctaatttaaagacaatcattgcaatttgcgaagactttaaggcttatattaacatgctccttgtaatctgaatacaaacagtacttatttacagaccatgaaatgttcaaatgcaggataataaccagggttttgatatttcgaaatattggactgacccatttgtgttatttgtaggtgggttgagctttctaagatgaatgtggctcgttgtgactttgcttgtgcagaggtcaacggtatgatatatgttgctggtgggtttggtcccaatggtgatagtttatctagtgttgaagtttatgacgcagaacagaataagtggacattgattgagagccttcgccgtccaaggtggggctgctttgcgtgcagctttgaaggcaaattgtatgtcatgggcggtcgttcgcgcttcacaattggtaacacgcgttttgttgacgtgtacaatcctaatgacaactcctggggtgaggtgaagaatggttgtgtaatggtcacagcccatgctgttcttgacaaaaagctcttctgcatcgagtggaagaaccagaggtcactcgcagtcttcaacccggctgataattcttggcagaaagtcccagtgccactcacaggtagttctagtactcgtttttgtttcggcatacatgatgggaagctgctgctgttctctctggatgaagagccctgctataagacactgatgtatgatcccgctgcaccaacgggatcagagtggttcacatctgagctcaagccaccaggattatgtctgtgcagtgtgaccatcagagcctgatgctttctggcttgtatcgccttaccatcatccttgtaggatgccatccgataccactatttactgcttacaatcagagttgaactctcatttccagtgtcgtttgctcaggtattttgatatcaaataatgctccagggtgcttatgctgcattcattcgattgcagcgttgtgccaggatgcactttgtttcatgtattttactgctagttgtagttcacatggttgttgtcgttgtactggacgatgaatagctgataggctgatatgcaactgtagtgtttgtggcgggcaaagaggctaattgtcagaaaagatttgtcagctcttgctgtatgtaaaccttgttgtctgaaacattgtcattcgctatttctgatgctctgtttttccatatgaaaagtgggttcttgcttctgtttgcttgaggaatccttggacctcatttgaacgccttctgcatatcctctagcctttgaggatccaaatgactaactttcaattttttccatgggctgcttgtaccattcacgcaagtttactgctagtggagttcaataaaaataagttaaatttctttctgcaaaaaacaaaaagaacacccttcaagtgtgcagctgcagagcgtacaatacaatgatactgtaccatctacactctttctgtttgaatgaaaggtattagctgcctttgagctgctttattagtgtataaatcaaaaacgacttctattttatgaatcagagtatctctttcttcccaaagaagaaccctatatataaatgtgacagcatcatgcgttcttcgtgaaagcagataaccacgggccacaccaatttcagtaggcggacggttgaccatttctagcttctcaggcactgtaaccacgggccacaccatttcagtgatgccgtcccaataatctggctaatcagttccccgtttgaacatcaaatttggcacttcataaattcatagtagctacgtttgttcattcatcaaatagtaatactacaagtctaccgtagaattttgtaggaattgcagtaccttagcggtatatatttttcaatgatcgatctggtactaactgtggtagttttaataagcatttcggtttcaaacgtttcgaatgttagacagcacagatttttaacatcaaaagaaagaatgctctctccgagttgacctgtgcttgacaatacagcagacagtaaaaaaaaggatagtactctctctgtttcacaatgtaagtcattctagtatttctcacgttcacattgatgctaataaatctagacatacatatatatatatatataatattcattagcatcaatataaatgtgggtagtgttagaatgattgtgtccccgaaaaaaaaaagacttacactatgaaacggagaaagtatatctgtaaaattggaaacctctggaacctccgggacaaacaggatgtcgaagtcaggtgaaccagaaaatttgcctgacaggtcgaagccaaaaacagaagcaatactgctcctcttctactctgcttcactatagtccattcagtattcctcttactctgcaagcgcgtgcaagcaagaagagaagaagaagaagaaggaaggtagcggcggccatgtctctcacgggatgcctccctcctcggccgccatgctcgatgaggaggagaaccagtggaggaggagcctctgtctctcctgtcgtggcgatggcgtccacggcagggtgcgctttgatccatttcattttcattttcctttctgtcgaccttgatctcgcctcgaattttgccgggtttgattaggctaaagggattaattaatttgctgcatgttcttcatcttgtatgttgaaaattgttgattgggagtttcacttcaaacaatttcggccattcgcccgtgctatagttgttgaactgcccccctgatctcgtcatctacattgtgtcatcctttgtttcgttctgaatttttcttgatcgtttttactggttgccttgcgcctttgttcgtcataggggcattggtcgtttttagcttcaagctgttctctctcttttctttttcctttttgcatgttttccttcttattgtttggttctgttcttttatattttcatgtgtacactagtaataatactggtcaattgcattatataaccaaaaaagttcttcacttcttcttatgcgcctttcctagataaaataaaatactgttcgcttgttctacctacttttagattataagactttttagcattatctatatttatatagatactaatgaatgtggataatgctagaaagtcttataatatgaaacgaatgaagtagtttgtttgattatgctagtttgtttgtcacagttcttctagtgttcaggacacccgcctgtagcatccgaaaagcatgaagtcctagagatacagttcagtaaagtgccactgccttcagactggcacaccttcctttaatttagttctagaaggggaaaaaaatagatttcacaattactgttgatttccacggccaatataaagtactacctctgtttcaagacaattgtatttctaccatttaaattttgttctaaaaaagttgtatttgtacaaaggtagaacccagccaattaatttgtgaatgctaatcaagtgagctaattgcttcggatcaccacattaaatatgtctgaaatttagttgaaatataattattttaggatgaaggtagtaaataaaatacagatggagtcagatgttcatatttagcctagtcatgccaatttaggtgataatttgaccagcttatcttacccaaaaaaaaaaaagtaaaaacgtgttactctctcatatagttccttttcactgcaagtgtaccccttcgtaaaaaaaaaccctaatcctagctacgaacctggacatatgcatatccagattcatagctaaggtttatctttttttttaacagagtagtatgcagccgtgctttgaagagagtacttgcttagcatctcaaccagggtttacgttaccaccggtaactgcgcggttaccgtgggggtacggtaatataaatgccacggttactgggcttaaattcaaataaatttaaaaaataaattttgcatggtttttcacggttaccgtggtaaccgtgcttaccgccgggacgcggtaaccccggactcagcagtttggaaaaccgtgatctcaacatgacaatgatttatttacagaaagattacctcgttgccatcatttctgtacgttctacttcgttttatatcatatgttgctttttacttttctctagtcgattttcttttaaaatttaatcaaatttataaaaaaactataacaatatttccaacccaaaacaaatatattatcaaaatatataaaatgttagttttgataaaactaattaacttggtattgtagatgttactatatttgttataaacttaatcaatcataaaagaagtttgaatggaaaaagtcaaaacaactaaaagtatgtaacgaagcgagcaatgattagtatcatctgtactgcatttaatttatcgtaaaattcactgatgtttcaacaatccaatcccacatatccagatgcaaaacattcggttcatatatcatcttgaccatacagtcgccatttctgaatattcttcctcctctgaacctgaagagttggcggcatcggcaaccccaccccgagaggcaagaagcccttcgccccgtggcgcgaggtgccaccccaggtgacccacacgctgccgccggagaagaaggaggtcttcgactccctggaggggtgggcggcggacaccatcctcccctacctcaagcccgtggaggagtcgtggcagccgcaggaccacctcccggacccgcgctcgccgtcgttcggcgacgaggtggcggcgctgcgggagcgcgcggcggggctccccgacgaccacctggtgtgcctcgtcggcgacatggtcaccgaggaggcgctccccacgtaccagacgatgctcaacaccatggacggcggggtgcgcgacgagaccggcgccggcggcagcgcctgggccgtgtggaccagggcgtgggccgccgaggagaaccggcacggcgacctgatgaacaagtacctctacctcaccggcagggtcgacatgaggcaggtcgagaagacgatacagtacctcattggctccggcatggtaagcatttgctccctccgtttcaccttacaagtcgctttgattttctttttctatttaaactttttaaagtttaattaagattatagaaaatattagcaatatgccaatatcaataacatccattgaatctgatattgaatatgttaaatctgatgttgaatatatattgataatatgtttgttttgtgttaaaaatattattatatttttttataaacttggtcaaacttaaaatagtttgattaagataaaagtcaaagcaacttacgatatacaacggagggaatattacatattgtatatactactataagattgctggtttacatttacagatttgttaataggacatgacattcagatgagatttggcggcatgtgattttttttcctctacaatttgctttgcgattcgtggtttagttagctgacatccatccgtgaaagccctgtaacctttaaagtggttaagttttagggttgagatcgaaaagttggaggagttcccttatttagagggcgatcacaatgataaagaaacaacagcggatatcagcagtggagaggttgcgaggttataatagcgtcaccgaagccatgtatggggaggaggatagtggaggcagcgagggtgtcaaggaattagttggttatgtagtggtccggtgtcgacggccgtaaaagatggagaagggcagttacatggaacattagagctagagaagatggagaagaagcaataacataaggctacagggaggatataggtatgaggagaggggtgtcatggtcttgcatgtctctttagcgcaagaggtgatgccggttgtgacaaagggtagtggggtgctaggtgacggagacaatatcttgatgtaatggtgtcaggtcgttggtagggccttgttaacgggtgttttaaaattcttagaagctgtaagttggtagctagcttataaaaatatagaaaaacttggtttttctagttttagttttcaaagtcgttttttgaattctataaatatatattttcagaatctaggtaagaatatgattgtttgaaggagttagagattttgggagaattatttctactagaagcttcttcaaacaaactaggttgagcaagcaaggtagaaggggataagaaaaataggggagttatccgaacagttcaatttagatcgtgatgtctaatggttagaatttcgtgaaattctcatgatccctaaaaagttcgaatattgcgtaggcattctggttcatttgtttactccctccggtttcattttaattgacattttggataatgacacggtctacgaaatatatctttgaccttatttttctattataatatatacaataaataaatgcatgtttacttttattatagtgctttgaaagataaatctataaatgttgttttagtttctttaaaccaaatatttttaaagttatttatggtcaaagttataaaagtttgacctcaaccttgtccaaagcatcaattattatagaaccgtagttagtactcttgtagctcatttgttttgttagttgagaaagggtcttttttttttctttcaacaaatgaaactgtggtagacatgaaaagcgatcactcacacattttttaagaagaaattatacatacatttttttaacaaataaaactgtggtagacatggaaaatgttcactgacacatctttcaaacctaaattatgagcgtgttaagaattaaacccgagacctcaggttaaaaccacaccactcgctgcagtgcatctagaaagttttactcaacacacccaaaatgtttggctagatttcaattcaatgttgtttgcttggttttggttgcaacttgcaaggatccacgaacggagaacgacccgtacatggggttcatctacacgacgttccaggagcgcgccacctccatctcccacggcaacacggcgcgccacgcggggcgccacggcgacgccgccctggcccgcgtctgcggcaccgtcgccgccgacgagaagcgccacgaggccgcctacgccgccatcgtcgccaagctcttcgaggtggacccggactacacggtcagggccttcgcccgcatgatgcgccgcaaggtcgccatgccggcgcgcctcatgtacgacggcgccgacgaccgcctcttcgcccgcttcgccgccgtcgcgcagcgcctcggcgtgtacaccgccgccgactacgccgggatcatcgagttcctcgtcgcgaggtggggcgtccccggcctcgccgcggggctttccggcgaagggcggcgcgcgcaggacttcgtctgcagcctcgggccgaggttcaggaggatggagaagagggcgcaggaggcggcgaagcgggcgccgcccgccgccgccgctccgttcagctggatccatggccgtcaggtgcagctctgattctgactgaatcggtggtaattattacagtaacaagtttgtgtttagacagaaagaaaatctgacaacaccagttgctgagaaagacataaaatagctttaagtctaataattgttatgtgatcttgcaaattaaaatgtgtatactttgtcctttgttgataacttgatatggtacatgaaagaaaaaaaatcatgcatgtggtgttggtttctttgatcactcttcattagcctccatgaatttctgaagtttcttcatcatgaagacaatactcatttctcacaaagtatcttacaactggcaaatttatgactgaaaattgtcgccagtgacacgatataaatagatacatgagtgagaatcaaaagccagattacaggtaaaacatcatcagcattcttcatggactagtgcaggatgctgagaaacaaagccaagataggaaagggaaactgtagaagctgatttatatacttagatatatatatgttacagacctgtatcgcattctatattttctatgcacctatattcaagcaaaggcaaagtatttccattatatgaatctcttcaaatattcaaatgtgcctttatatgtcaccaagaagaacaaaagggcaggtccagtgcaggatgtccagctcttaatctcgtcacaggatgcagcatgagcaggcctgagagggaaagagatcagtgattacattttcattatagtgttgcactgaaaattctgctgatgaattcagatttcccaactcagttgtatcaatctagtttatcactttgaaagacccaatgatataactaatcaaaagaatttaaaagcagaaaactgaaattgttcagattttaatctgccaagtacataagaaagcatcaaatattaagacttgttaggcaaaacatttcttttttagataatggaagcaaaccacttctggcatctacacccaaaggtgtacatagccaaaggtcaaacattccatggatatacaaactgcataactcaatttgcatctcttgtatatacctctgttatgacttctgggtgatcaaatattcaaatgaatttttgcatgttttgtagtgtcgatagtaattcatggctttgtgagaaacagagttgaactagaacaggggacaatgcataactccagaagtgcaatcgaaaagtaaaaccatgatatataaaattttcactatgttcattggtccttattatattccattagtgggacagcagaattacttactgagggactgcctaatgcatctttaagttacttcgctatatatctgtacacataaatctagcatattacaaaacaaatgcacctaaagatgccaagaaaaaatcaccatagtcgccgggagaattgaccataactccataagtaatcttataacctgagcaagaatcatactacaaagtaatgctcccatatggattatgtgggataagtcacaaaagatttgtcgtatagttagggacagcacacagatacctgttgcactttatgttcctgtcttctgccaccagaaggagaagatggtggttgctgcttgacagaagagtttggggtcagcttatcacgcctaaccctgttaaaaatgccggtgtacttctccccagatgccgcattagcatcatcccaatcaccaaatggaggtacagtcacttcatctaaagcctgaaaaagaaaaaaaactcagaatgcaaatgcactttattcagaaaacctctaacacacaatgtgcacatcatttctgaatttgcaaatggagatcgagatgaggtgaagaactgtacaggttcaaagcctctgcctccttgcttcaacctgctccttcctggagtcactgggacacggccatcagatgaagaggccttcctatctggagtctgcatcccagctgacctgtacctggaccttggagaggcagcagcagcagctgcaacttctctgtaagggcttctgggtgagccaccatagccaccatggtccagatgatgctgctgcagcggattggcgtgccgtctcgccacggtttcgcggtggagaggcgatccggcaggccggggatggccggtttcgggctttctttcatacctctgcctttggttcagggcatcatgagaggatggatgcagtggtgacctgagaggaggaggaggctgatcaggtgtttcagtgatcacttcatttgggttggagtaaacaccggtagcagttttcttgctccttctcaggttctcaaacttctgcgtgtacggggtgtcgcctgcggctgaccagttcccgaatgtaggaactcctccttgctgtttggagaaatgaattagcaaacatttgtcatctaaccaaatcatggctgatacattgtcacagattctaaaaaaatgtacagttgattatagaattatacatttcaaattgataagtatataccccataggttgaataactttttgaagagttatcagtagtaacaaactaacaatactaaatcggtgagaaaacaaaagtctgaagggaaattactggaacaacaaaagggaaaaaaaatgatatgagaacaatactattccagtattctatcattaagaagcatgtgcaaacagttgtctccttgataataaatacacaatctattttacgaccccctgattttatcattatcctgtgttgtcaacttgtcatcatgattcatggatgtgccatttgcctttcatccatatcaagccaataaatccgtcgaattctttacaaagaaaaaaaaaacccaagaacatgaggtaatccagaattacattatactacctcccaaacacctgaaatttctgtcatagatctattgtgcaataatatatgtgttctaaataaaaccccagcaacaagaagatcgtttggttcaatactgtgatcggttttaactaaccaatatgaataagatcccctgctttcctctgtaactactaaatcaatcgtcggtggagtaagaaacatcaagtaaaattaaattgcatcatgctacaagccaaaatcctcaataccagcatcatgaatattttaattccgggagcaaaaatcggaaataagcaactcaccgacgtcatccacttcaagtttgatccgaacactgatccagtaggagaaaactgctggtgctggaggatgcaagattttctgtccaagaactgctaatcaatagtatttctctcacaaggcactaacaaattgcaccttctctcccaatcatccagagctaccaaaatcaactgtagcgatatggcaaacaaacactaaggtatctttcattcaaaagaaaactactcaagattcctcgtttgaagaaatacaaggaaaaaaaattgaaaacaacacttttcactcggattccttaacagaacaaatcgaaccaaaagatttcctgaaaaactacaattctcacaagaaaaaaaatgaattaacaaaaaaagaataagctccggcaagactaaaactacaattctcacaagaaagaagcaaaatttggggagaaagcaaactgaaacgcccgagagccagtggaagcaggctgcttcactcttgagacctagactgctagaacagctccaagaaaaagaaagaactcaaatttcttcaggaaaacacaaaaccactccccacaaaaagatcaaaccccctcaagaaaacggccacaatcttctcccttggaagaaaccaaaattgaacggtggtcttgcctgtgcaaatccctcaagaaaggacccaaagggccaaaaccaccttaaaatcaatcagagaaggcacatttctgctccattccgcagcacccgcaagtggtatatatacaaatacgctcataagtagtaagagaggaggaaggagaaggtcttgccgttgacaatgagacaacgccattgttttatttgaagccttcaaagtcccctcatcattttatttttttcttttttatttagtttagtttagaccaagctaatgtttctggttttatttaactgtaataggtgttaaattaatgagtaattggtttgcttttttttttttagtaaaggaaagatactaaaagattggttggaaggcagagttctagtctgcaaaattaatttggagacaactccattatcatgagaatatagacttttcaagcagactgcatatagtacataattaatttggcaatggcgtcatcttgaaatttagtttcgcgaatgtacctgtatgcaattctctccctgtttcattttcaattgttgttgtatttgtgttgaactttattggccccttgtctcagtttgatttcttaattggtagattatgcaacttaacaagaaatcagtttagtgcatgcaaactcaatattgcgtacttaggctgtgtttgataaaagaagaaagacgaaaattgagaagatacgtaaaatgagctgagccattaatgcatgactagttgagtattaattatttcaaacttgaaaaatagattaatatgatttttaaagcaaattttctacaaaatttttttttaaaaaaaacacaccgtttagtagcttggaaagcgtgtgcataaaaaacgatgcactttatctctttctctcgcatgaatgaacacaaccttacttactttagtactcttttcggtcaaaattgtttgacattttcacctttcccttgtctttgaggtgcgatttttaccataattttgtttctttatagatgtagtttttaatgcaaacttatatatgcttagctttatgtgttttcaaactaaacattttattagaagccattgaaaatataagcttacaccattaacaaggtgtgtagaaactatgacatgtacaaaaattaatatgtatacatacaattaatacatacttcccttagttaaaaagaatgaaataatctaggtattatcactccaatgtaacctttccatatatatattgacagttgaaagaagtagttcagattcatcatttttctgttttatatttatacacctcaaaatggttactgtgctttccccttatacaccccgaaacaaatagatatatatttctttgagtaaaaaatatagatattttgaaatgagctaagtattttaattgttgtctatatgcagttgggatgatttgtgctacttgactttactgatcgtccactcgcattaatttagctcatctttattttctactccacttgtgacctaatctaggttgcctgtgctctaacgtaacgtgacttgatctaagtagaaagcaaagaaagagacagcacgttacctgagcctgcatgcatgccaatatatagctaactactactactataactaattctcaaaaaaaaaaaaactactactataacttaccgtatgctatgtgtttgctggattctcctctgactttccttgctagaggtttttaaattaaccagagctggttccaggctgcatcattaattgggtcttgttttcttgttttgctcagaaactgaaactgtgtctcatttttttataacaactttcttagtctcaacggatatgattataatactatctagggtgatgaatattatgagtactagaactgatttcaactgttgatttataagttttacgtactatcagtagaaaaaaaaatgctactactagtagttgaggtggtagtataaatatacacaatccattaaactagcaaatatgagcagtctaaattgatttctaatagagaccattgtaaaaacacttgattgtgttgtcgttacttgattgcttatttggtcgaaaatcttggtttctttctgtcatttctgaaagttttatgcaagcttacaataatgcggctatatatgtgccccatcagattgatgcagatgccatgagggacttttggtggaaaatctctataacaagactaaatgtaagataaatttaatagatacacacgcgcgcgcgcgcgcacacacacacacacacatatatatatatatatatatatgaatatctatttgaaaaaatatttggctttgtaccttcaatttagttaatttggaggtagaggccgggttttaatctattttctaaaaacatctaatttgaaaaaaatgaaaaactataattatctttcaattatgtattatgtttcttatatctagctagtattctttttttctctagaactcaataatatatgaagggtttggccaagggggcttaggcccacatttgcccctgttgggattgtcataattataaatggataggataaatcaaacattacatattctaaacctagaaaaatagcctacaacaagttatatatctaaaaattttatgtatactacctctattaaaaaaatataagcatttctagaattcaaatgttttactataatataagcatttctatattgatccccattattcgaaagccaattagatgcttagaaatggaatctctagccattcaaaatttaaaaattgacaattaaaatgaacaaaaggaatcttttgacataatcttaatatttgctaaacaacgcctaattgttatcctaaaataaatcaacttttatacgacattaatctaaacaaagtgatttgcttcaagatatagggagtaaaaatccttatattttagaacggatggagtatatgagtagactgacctggcgtcagcttatatacctgggtttgggtcttgatcatagtggtatgcaggttaatttagagcacgtggtccacatgagaaaaatgctttacttccttattgtcagtgtcttcgtttggtcaatgcaagccatagcagggaaaattacacaggagtgtacttaagtcatatatatatgcatgtgattgaaaagctgaaactataatatatcagtcggtgtcatactgtcatgcatgcattgtagaattaaatctgctatccgtggattagttcaaaaggccgcagcgcacagttagggattaattaattttagtattcatggctgatgttgacaagttagaagacatgcttataatgcgcgcactagaagtactactcctacttgtgttttggtctcgtgtctgtttgttactggagtaaaacttatttagcaactataacaacccatgctatgtgcaagagaggggatgatttcttttgtttttaacaatgaaaatagtttgaacgatactactgtgttttctattggtagtattataataccaatagaaatgatttatccatattaaggataaattagtaatttattaatataataattatgggtaactttaacattatgttttttcccgtttagatcgatctgtggtcattatattgcgctggcatcatttatattccatcgaaaaagccaaaaaaggagaaaaggaagtgtagtcactacttaatgacaattataccctatcgcatctttttttaacaatagtacctctctatgtttttactaccgttaactgaggtggtggtagtacgaatagatttgcatccttccatctattaaatgagatcaatggttcaaattgtttcctattaccagtagagaccaccgtagtggggctcaaatagtttacaccgttagcctctactggctggcatagaatcaataagtgttaaagttgagaatgacaaaaatatattgagtgataggataaatccttagctcctctaaaaagatgatcacttgaataaaaaggtaagacatatcacacatattctacctagtagttctattgtatcgatgaactaactagatgttccgtgttatttccttttttttttcttcgatattatactcacccttaagctctaagacatggtatttgatcccttccagctttcaaatatttggttttcaagtttggagatgagttttagacaaagcgaagagtttagaggtcaaatggatttatgattatgccatatttttttcaagttgcatgcatgtatggaaattaaacctcatgatcattgttttattgatcgaattgtggttagataaattatgtttttaagtctctctctctctctctccctctccctctctcaattgtttgatagtttcatgccataaataatattatccttaccaaagtacattagaacgtaaacaattcaatttggcaaaccacataacaatgttaaaacgttttcaccaaacaaagttatcataaccaatgcaatataataccaaaccaaggctaaaacatccttataattaaccccagctcccaggtagagctaggtcttggctaattaatttaggggaggaaaaaagaagtataccgtccaaatgtaatgggactttaattcttccagaaaatcaaacaagcatgtgataattaatatgtcgtgacgacgagtcgacgatgtgcaacatacgtgttcctatgtactatacgtttcagacaaacatgataatttgcacgtttctatatcgtcaacccatcttaatatataattaaccagtaaaaacacacatgactgaaacgatcgaaatcgagcacaaagtcttccggtaattaataaactgtcattttcatgctggaccaaaatttctccatgacatttatgatctccaaaacgttaggcaaaaaccaacgcttaactgatcttcgatctccaaaacgtggtcaattgttgagagctgcaactcaattgcgaccgtagggtgacttgctactgcagtcatgcatgtgtgtgtcatcgttggtggtgctgtcgaactacatgctccccaaactcctacagatgttattgagttacatgtaccagctagtttagtcaaaagattaagttgatgagtgaggaagaatataatgagtcaattcaattcaaacttatattgatgtggaaggacggacagcacatttatatttcaatcaacaacttttcttgtgtgtccattcaacccaaagttataagtcgataaggaaagattttggcccatgtaggagccggttcaacccaaaagttcaagtagattttataattcagtagattttatacgctggttaactggctatatatttacaactctagtggacctaggggcctaaccgccctaggaagctacttagactcactggcatactacctctatcacataaaaagttcatttttcagtatttggatacaacgtttgatttttcgtcttatttaaaaattttatgattaatattttattgttattggatgataaaatatgaatagtactttatgtgtgtgactattttttttaaattttcttcttaaatttttcaaataagaaggcttaaaaataaatttattttgggacggaggtagaagcaaaatggtaggcatatatgttgttggtggtccgatcgatgtagtgagctttgcttcagttttggaaatttcctgtgttgatttagacaccaaaatacaaaagtacagtaaagctctactattttgcatccttcgctataatccacagtttaacaatgacctgaaatagcttgccaattttcaagattctaagccaaatttgttaaaattgaccacgtgttttaaatggagtcgtgccgaggttcatacatgtttgaacactgatgcaaagtggaagagatcgagtgacgtactagtgtcgccaaccctaccgagaaaatttcaaccacacagaatcgatgaatcactggatcactctcatgaatatatttttgaaacattcagtaatactccgtatgttctactcatcgatcgaattatgaaggcactataacacatcgatcgagatacggatagccaacgatagcttaaaatatttgactgtaaatcagcacatgtcacaaaccagacgagaataatgattcaaactaatggacagatcaatgatggggcctaagaacaattaatcaagctcgatcaggtcaagtagctagtggtcagtaatgcacagaagttcgtgagttcatcttgttagacacggcctcgagagtaaaatttcggtaactaattaactatatttcctcagctcaagatatgactactttttttatataaaagatatggctagttggctacttatagaaattaagatttgttctaaaatataaaaatataaaatataaggacttgtagagtattattcatctaatttactcaatcttacttctaaccatccttaaaatttccaatcaacccttatttaataaagggcgtggagtaattcataatgttgcctgattaaaattacaagctactctatccattttatatatattataagtcaaacctttttaagctcgaacatatttacagaaaaaacagcaataattacaacaccaaattagtttcgttaaaattagcatttaatatattttgatattatatttgttttgtattgaaaatatatctatatttttctataaatttggtcaaacctgaaaatttgactaaaaaaagtcaaaacgatttgtagtaactcataagtcaaaacgattaggacagtaatttacaaaaagatggagtagtctataactattaggaaagaatcttgagaaaaaaattacaaatataatacttcctctgtttcaaattacttgtcaatataggttttacataactcataagtcaaacattttaatttttaaccataaatttctgtaaacccatattgttcaacattataagatttaggtttttagatttaccatgaaaataattttcataacatgtaattctcatgttaaactacacggatttataaaagttaacggtaaaagatacatattttaagtaatttgaaacggatggagtatcattggtttgttattttgagaatacacatgacctttatatgcagtcgcagagagagatattggagagcccaaagctgcttaaaatatttgattgtatctgcatcaaaacaacactaacatccccacacacacaagggacaattgctcatttgaccatgttatgaagtgtaactactaatttgaccttactttttaaactttgctcatttgaccctactttccaaaatcgaaactgccgtccgaccctctttccactccaccattagggtttttttaaaggagacaaaaaaaatcattttataatataaactgactaaaatacccctaagcagtgaacactaaatcaatcctcaaatttctcaccccacggtcaaatttctcatcccgtgccttcttggcggcatagctagggttcggcggaggcggtgcacggtgaggacggcggcggcggctcgtgatgggagctgtggtccagcggcatcgacgctcggtgggggctgcggtggcggcgcacagagaaggcttcggctgtggcggtggcggcgggagttgcggtggtggcacgcggcggggctgcaacggcgggcgccgcgcggtagggactgcggagatagcgcttggcgcgagctgcggaggcggcgcacacagagggcttcggcggcgacggcgcgcaagagctgtggtggcggcatacgggtgctacagtggcggcatgtgagagtggcggacgaaagggcttcggcaacgacagtgcacgggtgcagaaatggcggcatgcaggagttgcagcgacgcgtaggtgcggcaccgacgacgacacgcgagtgagtgctcccgcggcggcgcgtaggagctgctcagctgcagcagcgacggcatgcgggagatggccatcgagctccatctggttagcctcctgggttttttttttttaagcctgcggggataccttaactacgttttgtgtttttcttggatatttgtacagtttgagattgatctactatctacttctacttatatatatatattactacttaaaattaaaatttttaagaaacgtttccttcgtccctttaataaataaaaaaaccgaaaaaaaaaaacaaaacagaaagagtccgattccccttggaaaaaaaagatcggatcccttaaaagggaaaaaatgtccgagaaaaaataccgtttaaataaaaaaaagcgaaaaaacataaaaaaaaatccgactcccccgatggaaaataaaaaggagagaaaaaccaaaaaaaaagaagagaaaaaaatctgtcgcaaaaaaaaagaaaaataaaagggcgttcgagtcttaaaaaagtccgactccccgactccccgttgagaaaaagaaggcgacaaaaaaaaggaaaaaaaacttaaccctaaaaaaagaaaaaaaaacgtccgactccttaaaaaaagtccgactccctcgaaaaagacttctcgaaaaattgaaaatatttttgccggtattttggtacgtcatctgtatatgggtcggtttttaaatgttcgcttttggactggtactttggtacgtcatccgtatatgggtcagttttaaattcgttcgcttttggaaatacaaatccgcaattgagttagtttttaatttcgttcgcttttgaaaatatagaaggaatcgtataagaattctctttaaaagaactcacatgctaatttgagacgatcggactcctaattgcagctcatgattttcaagatgtttttgccggtaccttggtacgtcatccgtgtatgggttggtttttaaattcgctcgcttttaaaaatacaaaaggagtcatataagaaatctctttaaaaaattcgcatgctaatttgagacgttcggactcctaattacagttcatgatttccaagatgtttttgatggtactttggtacgtcatcgtgtatgggttagtttttaaattcttccgcttttagaaatacaattccatatttgagttagtttttgaattcgttcgcttttgaaaatacagaaggaatcatataagaaatctctttaaaaaactcgcatactaatttaatacgatcggactcctaattgctgcttatgattttctaacaaaatatatatccaagcgaatttaacacagtgaatttcattttaactaaaccatataacaataataagattaaaatagtcttcacccgttgcaacacacggatactacttaaaaaataagaggtgcttccatcgtccgtctaaataaaaaatagaaaaaaacctaaaataaaaaagtccgattccccataagaaagtggcgaaaataaaaaaaaactaccgtatccgattcccatctaattttgttcgttttctttttttttgtttttttccgttttattttctttcacccattttccggttttctttgtccgttttcttttcccctttttgcatattttcttttcaccgttttttctttcaccaatttttctgtttatttcttttatcgctatatttttttttgcggttttttcatcgggccaaacccagcgttgccgccacgttgattttcctcctcatatgcttactcctcctacttactgcaataaccgatttcccactactctctcattattttccctatgaattctcctttcgattcagctttaattcaccagattgaatctccatttaatcatccttatttttttatctcaagttttgcagattgcttcgattttgatgaaccatttaatcgtcgtcattttttatcccgagttttgctgattgctttaattttgataaaaaaaagggaaaagcgagatcaagtggataaaaatccctcaataattttggatatggagaaagattcgaccggatttgatggagaggatcagcttcgttagtcatcgtacgggtacggaactatgcgagctcgagcggattaccgtatttgatgggaggatcggctctgtcatggtataagactatgggagctcgagcggattaccggatttgatgggaggatcggctttataatggtacggacacgatactgttcgacttgggcctacaactccatttgtggactgagccacagagagatagaccgagcagagggagatagcagactatactaggactagaggtgaaaaggacggaaggaatgtgcgttcgtttggtccaaaacgcatgggcattaaagggagtatagtgcgtaggataaaatatatttttacctattgcaacgcacgggtattttttctagataaaacgctaaattgatggacgcttgagtcagataggatccatcgattttttgccatctattacacggcttttatttcgtcatatattctcatgtattgggaaaaaaagcaaaaaaagaaaattaaaaaaacaagcaaaaaatgcgtgagaaaagaaaagcaaaaaagggagaaaaatatggtttttgtcgtcagtaaaaaaaataaaaaaaaaacatgctagaaagaaactgttagaaagaaatgcgccgtttataaaaaaataagccgctcattaaaatacaaacattatcattgacatgattatgcatgaaaaacgtatattatcattagaatttattcacccgttgcaacgcatggatatttttgctagtgttgtaaaaaatttatcaaatctgtgaataagttaactttgtcaaaaatatatcaaatttatgtcaaaattatcgaaatttatcaaacgtatgttaaatttatcaaacccatatcaaaatttctcaaatataacaccgctttgtcaaacctggataaataaacaaaaataataaaagtagggtcaaatgagcaagggcataaacaatatttttgtcatgaacaacgccgttagattgccttcagagaatagggtcaagtctgatctttattatttttgaaaaagagggtcaaatgaacaaacttaaaaaaacaaggccatcaaaacagggtaaaaacacaattcccccccccccccccccccacaaaaaaaaaaacgatgcaaatgcggaggcgtagcgtagggaggggggggggggaagaataatcaggttcgtggtcaactatatattggccagtaaacggaaacgtgaaaattgcacttagaagaacggctcatgcgtgtgagtaaatctttagtcccgtcatcccacgaaatcgctaataaatgaaaatgacagcgacgacgacatctctacggccagattattttgggaatttacagggaacttaggaaaataccttaagtgatcatgacatatttaatttatatattattgtccgagggattgaaagaaatatatcggcaaattgtttggaagaaagattgtaagtgatcccatgaatatatgatggagaactctttatagaaattttataccaccttaccctatcatgtcacttgactcttctcacgacgactatgaactcgcgaagatgatgctaccccttgttgaatgaaccatgctagcagatagtactgttttgcttactaaaatttaatactctccgtgtccttagccaaacttgtttagttttgactaagtttatagaaaactttagcaatatctataaaaccaaattagttttactaaatgtaatattgaatatgttttaataatatgtttgttttgtgttggaaatatgataatttttttataaacttgatcaaacccataaaagactaaacagaggaaagaagtgggaagtaaagagaatttttccaaaggatttaaatactccaaattttctatgtttttcatttaaaaactgtggaagagagtggagcgacattgtatggagagagaaggtaggtgtacattttttttaattcatgtaggtgccttaagcttaagagatctaccttaaggcgggcttaccttctattgtcaacattgaagatgccataaggccttcaaaatacaaattaacctataacttggctctgaaatactatgccagatcgagcaacagatttggaaatatgcaacagatttggaaatatatggacataattcgaagacatggagattggtagacatactcatttttaactagtaccctgtaatccccctactgactccctctactggagcatgcccaagcagcatcaggacccaacagtagctaggctacaatcagcttgaaaattgcatacgatggaactgttcatgcacgaagctgactcgagtcctgtcaaactaagttgcagaaaaattaggaaaaagcttaaagttcatgtgggtatttatgttttattgctttaatcgttggaagaaatatattgggaaattctttccaagatccttccatctcgtgcaatctggcgaccagaagtgagcgcagtgaaagatcattcgctcaatatcaatatttctgtgcatttgtgcttcaagcaaaggtgaaacagagaggttcaagtgtacatggaaattctatacgatttaaaggactccaaagaaaggattagtgatagcagaattcagctcggctccagcagtgttcaggacggccttgtcaaccttgtcccttgccaagaacaagaactcgttgccttcaagtttctcaaatccacagagctggagaaactctatgcctccatgcagattgccaaccctctcctgcattgtaccgaaacagattataagtagcgtgttgttcttgaaaggataacagcggatcattttaccaggtcaatatgtacagtaattattttcacctgaaatgtagcgttggtcagtctgatcttcctgaatttctcctcgtcaggatttttagctacattgccaatgtaggtaaggagtgtttgaaaagccctcttcactttagcatcgtcatcctgttgcaaaaacggcccataattgggtcaaattgaataccaaacatataatatgattatatcagcattgaatgattccactctaaaactacagggagaacacaatttttggtatagtttcaacaaacaatagaattctcaagtctttacagttgcatctgtattcacatgcaatgaaggatatgtgtcaatctgcctgacaaatatgagtaacatagaagatgatttcaagttaaaactacatgctaccttgttctgctgcttaagatttcttaagcaatccctcatgcgctcggcctttgtggctggcctgacaggtaatgccctctggaaatccatagaacagagttagatggcaataatgatttcaaaacattgtttatttatacaatctgcaattatattctttggcctactaagttcggatctaaaggcctctacaaaagctgttccaacaagaaatccattgactgatgtaaggcataagatctgaatgtttcctgagaaattcagaatcagataaaatttttgctcgcattcatctcagcgatttggttcagttaggcaattcaggttctcaagaccagtacagggtgcaagttcaaactggcagtaggttggtctaaatgactaaatttggatcaactgctaattatgaaaggaaattcggatcaactgctaattacgataggtgtaccttcttctcttcaaccggaggtggtgcgcttggtttaggagcagctggatcttccgggggcaatccaagtttccttctcctttcagcctggtaattagaaagaaataattgaggtctaattgccagagtgtgacacttacatgacaaccatacaaatatccccaggttatgtcgaagcaaatatgtaacgccagaaattcttatataaataatagaagaaatgatgagatggagaagatggaaaccttgtcctcttccagtttctgacggattttttctctagctcttttctcctcttctttctcaagtcttcgcagttctatcatgctgcaggtggtggtaaaaacagtcaaggggtggagaacagaatactactagtcaaaatacagaaaaatcaaaaggggaacaaagaaccaaccgtttcctttcattatcctcctcaattcttttggcttcaagaagctctttaccgatccgaatcctttcctaaaaatgtctaatatgtaagataaaatactggcaaaaaatgaacagaaatatatgccacatataatgtaaggaacaataatatgctattaattgtaatattggaaaaagatccaccaaaattataatattgcaaaggtgtaactggaaaatgccaagatcacatcacatcaaacataaaactggaatttgaggggaacaaccaatgattttcatgctttggtattagtgctcatcattatcttcaaatgaagggcatagcgtaatttgtacttgttgtctagtagaacggagacaaatgagagaaaattttcatctttgatatcaactctcatcagtattttcagatgaaaaatatagtataatttgcacttcttatccagcagcttatatcaaaataggggacagtaggctgaagtccctgtaaagacatgataacgtgacaaaagaaaacagcagataccatctataccttcaactctacatattacagcaacaaatttaagactagctcagtacttcagacataattgcacttccaagtaatcttatgcagatttcttcatacaaattgacaaatttgagatgagatttcatgaaacaaaatcaataagttccagcaaactatttgtgttatgttattgtacaagattgctggcaggtggaatcaaagttacatgaaaatacatcataaagggctattgattgtaatgactaagcataatgcatgtcttttttggatatgctgtgcaagatactgactaaaaacacatctaactgcacagaagaaaccagatatataaatgtgctgcaggtaatcttgattcatacatttctaaatacattaaataaggtaaaaagaagttgagaacaaaccttctccctttctctttccatccttctctcttcttcttctttctttttacgagcacgttccctacaaatcgagtgagtaaactcaatagtttagtaacaaaaagttaaaatcagaatcataacgccagatctgtggttgttccagtgttaatatgacaaacggagagcaaatattgaacaaagttcctgtttaaggcggtacgataaaaaagtgcacaatctgcatattgggggttatcatgtgcaaagaaaatacgtagggaatgtaataaaagtatagaacttcagggattaaatatgagaattctattgtcatttatattgagtttcaagtccaataaaaattatcatttttaaagcagtgaaaaaaattgtcgtaccaatgcatgcgattacaaagcccaaccacatacgacaaagcatacaagtacttaaatgtcaattgaactgatttcaacgaggaaaaggtagtgctacagacagacacaagtcaatgcaattttctgaagatatatataaaaccatcaactcattaaagataataagaaagcaataagttcatgaacacaccttaattcctgagctttaatcttcatttcctcaggagacaaagagggtttattagcctcagttattgtattagccggtacctgagagatgaaagaaggtaagtgtaaagttatgtactggagagcaaaaattttctggacaagtataggtataacacagaaagaattcatctattactcccattggacacaattaattgaacctctgaagtgggaggttagatatattcaaatgtgcaagtttggtcctagatacatgggcatacgcaggggaaaaaaaaccaaaatggacaacctatgccaatttttcaaatgtttgaaatgcgttttcattgttacagtaaatacattgagctgcacaaataataaataaatatagtaaaagttttgggtattactgaaactccatggatagaatgtcagaggtcagacagtgcaattcagtgtagcactacacaagcacgatgaaaataataccaaaataaccacttaatatccaaaacatattattttttcagcaaggggcaatttagcacaccagcataccaaaacaaataaaggtataatcaattaatcagcaacaaaaaatataaattcatcataccagaagcggttcgtcaatatctggatcttcttggtgctcggaaagccagttaatggcaccttcaatagtgctattacctagaggaaaattaaatgggtgcaaacaaagttatgaattaatcatggtttgcttactgaaggtgttatgtttatttaactaatatagatgagacaatcataatatataagtaagactgcaaaacgtagtcttattgacttctggtccactgagacagttttgtccaaaagcacagcaaatagttcagctttcaatgcatatataatgccttgttttttctgtcatattgtaaatttcggtccacaggcactacaatgcagaatgtatgtctaattttgcactcataatgtatcttgttgcaatgcacaagcactagcattatttgatctgcaagactcaatagcaaagcatatactttccaatcgaggtcgttcctttattcaccatatgctgaaatccttggtccagaatttactgtgataaaaagccttctagccgagactttcttagatcaaagtctcaaatagctcagtcgcacgagcgaacatatatacacttgaacagttaatacttttctactgcatctgcagtctactcctctgtcccataaaaaaccgaatcttagggatgaatctggacactaagattcggttttttatgggaaggagggagtactctagtaataatttgctaataaataaaatctaagttggagaaagaacttgacagcatggtacaaatgttgaactaagacatactatcttgctacaccataccagaaaaatgaagtgccctagtggcacgcgccgtcgtgaaccccatcgcctcgaggtccgccagcatctccttgttaacctccggcgccaccatctctgccggaagcaaaaagccaccaagattcaacactctttgccacccaaaggcggccacagatcataaccctttctatcatctcaacaacaaccacctcaccttgtggctcggcgcttgccgaggcatcgacatccatggcctcgccggccggcttcggcggcgccgcctcgagatcaattggcttggccgcctccatggtcttgtcagtgaactccgtgtggcccgtgcgcttggtgtgcaggtccacctcctgcgccgcgcaagatcagagatccacacaaccaaccaggtgagactaaaatcggatcgagaaccaccgaatccggcggaattcgatcgagaaagtgaaaaccaaagggaaggtggggagggggatggggggatctcacggtctgggagcggcagggcttgccgcaggcggcgcagactaggttgaggacggcctcggtggactcggagaagttggcgtggttggtggcctcggcgtgcgcctgcgcctcctccacgctccgcagcagcacgccgcagtcgccgcaccgcagcgacagccccgccattgccggcgggcggcggcaaagagggaggtgcttttgcttcgccgcggcggcgaggtttagacggagagagggggattccgctcgcggcggcggcgagaagacgaggagacgagaccaagtcgctcaggtagtccagatcaggtaattattaagcggaattttttatatttcttatagagaggaaattaattaacctgatttgttacggagtatacgtatgtacgtactgtattccgaacgggaagggctcatcttctcctcggattgaaggatctggtttattgatcaacggttgggattactgtttttaataagaaacatgatataaatcatgtatgcgctcacaatatacgtacactcaaccttataaacgcacgtaactatatttttttatactaaaaagagatcgatatatctagaaaatgttgaatttagtaagtttgatttcagtgttgacataaagtcacaatcatggtaatgaacacccaaatttcatggataatatttttttccttgtccaaaatttattacaggtttgttaagattgtactagtataaatggacaacaatatgatcatgcatttggctaaaaaggttatgcttttgatcagttccttgcaacaagttaagaatattccataccttttacagtgtttttttccttattctacgttgtgagagataggagtatttgatatgttttgcttcgtgtgaacaccttttagctagtgcttgggtgttttttttaaaagaaaggcaaaagctttgcctcgcctcagagctagtgcttggttggggcacaagaagaaattgaattagcatatttctgaaaagcaaaaatggattatcagcttgtttggtttattagatgacttgaaaaaaaatacacgtatgtagcaacgagtgaaggctaatttaatcatattattgttgaacggtttaactaaggtaaaattcacggtgggaactgcaattataagtttgatcatgtcaagttagtatgcaagtttataaaagagatttcttatacgtctccttctccttctttatttgtaaaagcgaacgaattcaaataccgactcaaacacggatttgtatttccaaatgcaaataatgaacttaaaaagcgactcatacacggataacgtaccaaaataccggtaaaaacatcttcaatttttataatagtagagactagctaaatgcatgtgtgttgcaacgggaaaaaaaataaaattacgctaaatattaaattatggtttaatttttttatctaagtcatattttttttattaaactcaaacaaatctgaacgtagggagcagtgttacgtaggaggagaagatgggctttgtattcatcgagagtatccatgcatctttcaaaagatttttatgatcatatgtcacggtctaagattatgtggagatgaatcgagatgaatgaggatagattggattatagtagatgaaataacaagaaacggttctgaacctaaacagcgcgacgctctctgtctcactgagaaggcaggccgatgggcactaagataaatcttgatctaatgcctaactgatctggaatagggtccctccttatatagatggaggactccttaatctaatcctaacaaaccctatctaatcctaacaaaccctaactctatccaataggcctaggattcccggcccaaagcccatgacattactcccctctttttaagcagctcgaggcacaccccgctagactcaaacaaagtaccatagcctaaacaaagattcacaagccttttacatctcggctgaaatatatactcctatataattaatactactgttgtgaacaaccctacttttacttttatgttgtcatcatagatatggacaggtggaccccacccagaagccttgaaaggaaagtgaggcccatgccagaatccaaacatatctaggccaacatggatcagctgcagatcgaagcccagcccaccagtctagcccatttaaattgcccagatgaggagaaaagaggagaaacccttgctcctcccgtagatagcgctgcctccaacaacatgcgcgtgaggagcgccgtccgcgagaagagaagttgggccacgccaaaagaaatcgcccccaacttcgacttgaagtccttgcacaactgccgcgtccacagttctcaacgcgcacatgccgccaggaacgactcagccgtggtcgagccgcaaacttcgtgaaccagctcgcggacccggcgcgatctgcgccatcacgacaagcgaatgccgcgcccacccgtcgcgctagtgaatcgcgccgccatacgccggctggctctgctccaaccgtcgccgtgttgtgtcgccatcgaagtggaactcaccgtcgtcttctctgactccgttgagggcgccaacagcgacggcaccatcgctaggcccagcggcgaggccgaggttgctcgcccacctgccgttcccgcaattcacgccgcatgtatgtcgctatcttcccgcgccaaattgtacctgccactctcggaacttgcgccgccgctcgaggaagcgtgagcgcctcgccgtgagtcacgccacccccgcatggttgcagaacgccattgccgacgaccccggacggtgggctgggctgcgcatgcgtgagtggcggaggcaagaggcatcaccgatgctaatcctagcagcgcaccacccagttgcgccatagttggtcgccgatggaacctgcagccgatcccgccctatggtcgacgaaatgacgtaaaggaggttgtcggcgatggcctgccatggagtggcgtcaccgccgattactgccaccatccgtgccgcttgaagacgcgccctcgtggtcgcaaggacgctacatgccagtatgatgattcggcatcctcaaggaaggccgccggctcggctgactgggctgccaaggcctagagttgcgccaccaagtccatcatcttcttcgagatctcggcaaggccttcgctaatgttgagaaccacagcgatctcggcacccatgggcacggaaccgaagctctgataccaagttatcacgtgttaggattatttgggatgaaaagggacgaagggaaatagattggattatagtaaatgaaataacaaggaacggtcctgaacgtaaacggcgagacgctctttgtcgcactgagaaggcaggccgatgggcactaagataaattttgatctaatgccaatctggaataggatccctacttatatagatggaggactccttaatctaatcctaacaaaccctaactctatccaatgggtctaggattcccggcccaaagcccatgacatcatatcacacagatttttaatctttagattaaaatccaatagacacagcaaaaagacaaaaagcaactaagaaacaccataatggatactaattgccatatcttcaagaaaaagaccaaacccaatataaatttcaaaacttacatacgaagattcaaaaattacactgtaacttacaaaagttacaatgtaagttttataaattacactgtaaattacaagaaaatacactgtatatttaagtgggaaaatcaagtgagagataagaaaaaaaatatttcgattgagatgtagcaaaatcgatcacaaaatagggagctgccaatctcgcgttacatctacaacgttctgaatcaatcacgcgcccatcatgttctcgcggactgagtcggacatctaccacgtgtgcattgcgaacccatatagatagagtcggataacaaacgaaagaataatgagtagataatcattattattattattattttaaaaaaagtataggtaaagatctagaaatcgtaaaaggattcggatgacaattaccaaaatcttgacaaaaacatctttaatttttataatagtagagatagagatagagaagaaatagaggtatggaacatagtctggttccaacctcttcctccatcaaaaatattaatttctatggataattctagatattctaagagtcttttttatggaggatgtacggaatctcttcaagatgcggtatgaagctataccgatttttcactgacaaaactgtctcctaagtcctaaccaaacgctagagagatcaattcggttctcaaaaaaaaaaaagagagatcaattccattccctcaatcaaatacccggcaagtatgaccaacttgtccaatggaatagccttcttactaccagggtttcccttaccgtttttagcgcggttaccgcacccccgcggtaaggtggttaccgcggtaactgcgcagttaccacgaaaatcacgtggtaaccgcaagacataccgtgatttcaaaaactgaaaaggttactgtggtaaccgcgcggttttgtaaaccctgtgttggcaacttttttgacaagttgacaagcacgatcgcagcaccttaagccttacggtgatcctagagtcgccaaccacctcgatctagcaaagagctaaacctagatgggttttgataactaaaccggctagcggagccgatttctagataactacccgcctcgtgggcaaaacggaaggttttcaggacaaacctacaaagagatgtcgcactctcgcagcggcggcggatggtttacggtgcaaaccgacaaagatggacaaactaagagaaaactaaaagcaatatgaaaaacgatttgattgattgattgtagattgatttttacaatgaaccggccatgtcccttatataggggttggtcttgccctctacaggcccttctccacgtccaactcggggtagaaactaaaggaaacccgaaacatgccttcccgagcaaggaaacctcgagacccgacgaaacacagtcggactcggacctgccagtcagaccggccacacaccgccgatctgaccggccctgaaccggcggtctgactgcccaacacacggcggtcagaccggcccactaaaagaaaaccggcagacttccaaattttggcaatctttcctattttaatcctaggtgctaaatttgggtgtaaacaccctgcttaccactctaacggtgaagaactttgccacaattccttcaatctttttcccaacttatgtgggcttattcggattaccagatttgcacaggattttggggagaatactattcactaagaaattttcatttcctcccattcggatcgcactaaccggccataggaaaatcgaaggaaagtttccctcacgaccgatttcacaggaaaaacacaggaaagccacccagatcttagcttcacgatggatttttggttggaccaatttttttctagtttgattcccctgtaaatttttcattcccacggccattttgtgattcagattagcaatactctgtcaaaataattagtatcagtttttactcctataatgtgtattgaacacattagtaaatacattactacatggtggctacgagaacatgggctatattgacaggaaggtggcaattggtttactcatagactacaaagtctaaacaatatttataacactggttaaagacttactagtgttgtaagctggtagtaatttttcggccatctaagaacagtgtcgaatgatgtgggagaattcatacaagtaagtacttttgaaggggggcatccatgtaagtaaatttattacttttcaaggtgcagagtgggaagctgggagcaaatagaaaactcagtaaatttgttacttttaaaatatggggagacactaggaaaacaaaaaattcaaaagaaaaactagatggtaaatattttactgaaataggaaaaaaaatctagagagaaggaaccagaaaacatgaaaaatttagatggttaatattttatcgggccctttgatgaaacacaaatgagaaaaaagaaacacataaagtagggtggtaaaaaacgaaaaaaaccagacggagaaaatgtggggtggtaaaaaaaaagaaaaactagatgaagggaacattttgtggtgctcgaactactgtttcacgcgctaaataggagtttattagcgcgtgtcaattaataaactcctatttagtccaagtaatactatatttctttctaattgaacaagtatgtgattttaaaatttaagggagccaatgtgaaatggatgaggactttcaaagtggtgtaataatatacattatgtggcccaaatgtcagtggtaagggatggtgtgagacagtgagaatggacatcaccactactacattttaagttgtctaaatttccatctctttttatacaacaccaacaaattgccatggcctttcaagaaaaaaaaaacattgttgttgctaatgaaaaccgtccttatgtggagtacattgtagtataaaattgaagatgttcccgctgatactttggtacgccatttgtatttgagtcggcttttaagtttgttcacttttgaaaatacataaggagttgtataagaaatcttttttaaaaaaaactcacatgttaacttgggatgagagtcggactcctaattgcttcagaattcttgcatgaccacaagaaaacaatgtacatgatatggctatcattccaataaaagttccaaattagatatcaatactatcattataaaaatcccatataatttttagacaaaaaaaatctaacaataattaatatgattaaaatagctttcacccgttgcaacggatattttatctagttaactataacaaatgcaatgcttcgtagtcacttttccatgcacacatagaattgttgtcaccgtgactgcaagtctgaaacccttagttcatcaggcaaaccgcaatacctcccggtcatatttacaaggttatgcagcaagaaacattagctgagtgaactgagcgaagaaccattacctactcaagaccaaattttaaataaaatgaccaaactcatgcagttaagatacaaatatttacaagaaaaccttttataacaggaatgtgtcaaaccacaaggtaaactcatgcaaacaaaaaatgtgaatacgatgaatgcaagggtagaaatattgagcagaatggtatttatcatagagtgaactataccaaaaccatggcagagtgccaaattaactgctggtttatgaaattgacattacagtccgtgaaatgaagtacacagtggattatgaagattaagaattaatagcttctccgtgttactgtcaccaggcaactgaactcaagctgtggttccaatggaattcctacaagagatgtaaggaatgcattagggagtacagaatgaactgtcatcaccttcggaaaatactgcttgaggtaacctagtgatccagtcaagagagaaaataaatggcaccacagatggaatcaacttaaactgttagactaaattttagctattaatctatgaaccatcttcatggtaaacatataattttcacaatatgcacctgcaacttaggtgaaacaatcttgtctagctaaccttatccggaaagccactaagccagtattactcttactgtttttaaagtgtgacgtactcttataatgattcactactttaccttttcatttttgtccttttcaattttattaggatattttcttaagaaaaaaatcattataaataggtacttatcttacattgtcatgtagagtactggttgaaatttaacatagaagtgagttccgagatggttatatttgatattaaaattctaatccatatgtagctttgccagaactgagaatgcaaagtacattcctagcaatttaggctaacaaaatgttagtaacaatcacaaaggtaagctgtaatgatgacagagaactgaaaagtttgagaaaactccatgcattgttcacatatgctctgctgtaccaaatcccattccatgtcatgtatcatatctcaacgaatgtcggcatcactgatatgtgcaatcttaacccaatcatggcctacatgtttttggcatctcttcttgagctcagagctgcagccatagatgtgcaggctggtaagagatgctggcatatctggaagtgtctgaatcttaactgcattgtttatatgcatggactgcagggaggtcaaggttgtcactgcttgtggtaaacattgcagatgagaagcattagtcagaactagttcttcaagggcatgacagttatgcaacagatattcctcaggtaagagtgctaggttaggtccaccagaaatttgaagcctcttgatggtagtgacgcttctcaatggctctctaagtaagattgatgggtggtcaatatcaagttcactgagattcagagataggccagatgaatcagcatcctctggtgacagaatagatgaatcttcaacaagcttgtcacagctagcgattgtcaatgacatgagcgatgcgagaccttggatcccgataagtgaaaccagctctttgcagtcccaaatgaaaaggtattcaagatttatcaatcttgcaaaggcttccactgttggaaggtgtgcgattgagcaagcatttaacaccatatgagttagccctatcaaacctgcaaacagttgtaaagggagttttgacattgcacaaccatctaaaaagatccgtttcagatatttaagacctgtcaatgagtctagtaacgcaagttcagcattagcacacaatccaaaagtgatggttctcatagtatggggcaacatgatctgtcgtgcgatcagatttgggcacttcacaatttcaagggttttcagggaggaacatgaactgaatgaatcttctggtagacatgataaacttgcacattgttggatggacaattcctcgagagcataaagagaacacccatgccataaagttgttatatacgggcagttggatatcattagcttagacagagagaggttgaacattgatgatgaacttccatcactgctcacaaaaaatgtcggcatagcctgtaaaccagcatgatcaatttcaatttgtcgaatgctagtaggtaaagtcggtagtcttctcagctcctgacaatcacgcactgctagtgtctcaagccgaggaaataagttttcaccctccaatccaacccattccgtgcaaactggcatgttctcaatctctagtaccttaagggattgcaatccagaaggcttctcaccacttccataaaatgatgaatccacacactctaccgacttcatgttaactatgtacagatattgaagagaaggtaaatgggtaccaagtgntaatcaaaantgtnctcaaaactacacattttttttttttatattattatatagtcaaatcataaataacctacaataaataagacgtccatataaagacgcaggcacagantantagcgacaaaaaaacatacacacactactaaagacacacgacgtcg

SEQ ID NO: 59769 - DNA, 31954 bp, Oryza sativa
  unsure (1)..(31954): unsure at all n locations
aaaacaaagagtaaggattgaaaagggaattgctatacacacccttcctgcagcctccagcttccctccgccaatccaccatcgccgttggattcgtaatcgtcggacacctcgaatcgccgcaaaaataaaggcgagcacccaaccgcaccgcaacctcctttcgatcggctctcccctctcttctccttccccccttcccctcctgcaagtaaaacaagcgagagactccccccctcaatggcgtcccggatcgcgaggctgctacagcaccagaaccgccgcctcctctccaccgccgcggaggcctcctcccgccgtccgccgcgcgctcccctcagcggcgccatccccaaggtaaccccgcggcaaccggggaggttgtaaccctaaacccgcttaaacccctgcgcgcctccgaggtgttcggcggaatgccgacaccggctcgcatgcctctgtcgctgtttcattgatagcttcgtgtttaagtgagctttccggtaatgtgatgccctagttaggtccctgagccggacctaacgcatgccaggcgcaggtttcactgaagtattaattgttgcttagggcaatgggttatgcggtgagctcatctggagtcttatcgccattgtagcatgtggttcctgttgaatctatatacttagagcctaaagcaatgcttgatttgttactctaatagtggtaatgaatagtgcctttttatttttctatatagacacaccattatctccgacctttttattttctatatagatacaccattatcctgaccttgtttcaacttttaactgttcctaatccgagactgaatagatccttaagaagattgttgaatctgttcattgtgtgataaactaatagttttttttgtgtgttttctgctctaggtgacatatatgtctttttttacctttcgtcttttttttttcagcatgaagttgcaaaggctgaaggtctaagctcatcttcaatcctgaagctctctactttgttcatcaagtgtctatttatgcaagtttcaaattttcttatatggttgcatccatgtttctaaagatgttctgggtattattgcatctaagaaatgaccgctgtttcttgtgctgagtggcacaacatctcctacactacatgttataaatgttgttacttactttgctttaatttaactgcaaataagcatagaagctaaattgatagtgcaaataagaataacatgttagatgtatctgaatgctcactaaactcacagtgtggtggcaaatgtactcgcatccctataaatttcatctgctacctcaattttggttccttcctgatcatacttttagggacaatctacatataattattttatctgcctacctgctgcttgtcacaattttttattcaaattcttgcaatattttttcagctacatcaaaagaattgctagttgctgacatataatatgctttctttatgaaacatatattatctgctgatcaaagattttattttttgtttttttaatgttttaagcatagtatgacagagagttgcatattctaatttcaaatattgtacgtactctttcatatactggtttagagagcattactgaatgcactgcccttgtaatactaagtcaagcatactcttcatacatcaaacctactagactgaaatgatttaagttgttgcaaaatgatagtatgctatttactcaaaaatgaaagacattagtgaatcttgtgttgttggcttctctaacgaaattgtgctgaatactcaataggcattaaacctcagatcaatactcaatagacattcaatgaagttcatatttacagaaaattgtttctcatctgtatggtctcatcaagtcatcataactttattaattttcagacatttaatagtctcacgttcatgttcttttttgttggatcttgaccaacaatgctttgcaagttgcaacatcttatctatatttatttagtgctgagtgaattttcttttgggaaactttgcagcctcatctttaaaaaaatcaaggtggtacatgatcaagtcaaacccttcaagtcctctcacaacacagcgtgaaagccacaaagtatctactcatttagttaggccttctgcatcctactccacacaagcttcagagcagaacccaaaagaggtaagcaacagcttgtctgttttgctatttaaattgttcaatattttgttcctgcttttttttatcctctgtgagtacaattttcatcaatgttgttggccatgttactgcggattatcaagtacaatacatgacactattaagcatgccacctcagtgagcatttgtatgcatacatgtgtaatcttgagtaggcttcttttcatgtcatacaatcaaaactgtcaggaatcttgcctcagggaactgctggatcaattgttgactaatgtatgggcatcatctcagtaatgtggtggtgaataatcttgttagaaaaaaaagttaagagttattcaattgctatgagataggggtgattccgtatatgtcggaaatataatgttttttcgttatatcaacatagttaactgctaggtgctctggtgttcataatctcagtctacccaaatatgctccgtaattttacttaagccagaagagtagactatagtactacctcatacaaaaagggaattccaaagaagatgaccacaaagcctaggtgtcacctaagaaactcagtagcacctagtcaccctgagcggcccatgctcagcaatctaagctgggaggctgcataattagccaaaggcagtccaagtcagagcaaggcatggcagtctgggtaggcttcttgttaggctgggcaaccaactggatggcaagacgttcactgctcctctcacctccaccctcctggcattggctactgaatgtggtcctcaatctttgctggctggagttataagagagaggaagggcagctcccaggcagagaggaagggaatagaggtagaagagacaggtttgctctatgccccatacctccttactggcagggcagtcttgtctatggtcttaggttttcagttggcaacgtattgctggagaataattaaatcataattcccatcaacaaactaatcacctgacacatatttgtcgccttgtaatctcaacatatacattgctccgaactgtaatttttatcagacattcccccctgatttgttgttttctatttcttattttattgcttataaaagactgatgtcttcatcctcagggtacaaaagacctgaaaactgttgaagatccatttgattcccctacctacaacatacctgagaagccagtgacatttgctgaaggggcttcctacagtcttgtaatagttgcgggacttggaattgcagcagtggctggatatgctgttttcaaagaacttatatttgaaccaaaagagtaagttttctgcattaattgttaattcttttgacttaggcacttagctcaacaacaagtactacaatctttagtcccaggaagctgggtggactagaggtgaaacccaagtatagccaggagaaccaaaatgttggatctctaacttccacatattcctaatactactaggaatgataccggtgaaagaattatgtaaattcttatgtagttctggcacttggatgttggatcgccaacttcctcgtactcctatccaaacccaaatctttggatgcactccatgccttcagtggtctttttaccactttcttccatttcagtttttatccaacccctgcctctcctatttttcacatggcttaagattccacgatgaaccagttcctcaggaagcctccattttgaatgaaatcaaaggtactttaataatatagttgctcgcataattgtatggcttatgacagtaaaatacattcaagtctaaccagttatgataatttggtaagtcctacaaatatgcactgtgcaatggtctttcttcacattgtagcgttaatattttgtataatatggaaatagttcctttttatttattttttaaaaaactaatatcacacacacatttattaatccagatgtttctaggtttgtttatgaccctcacatgtagccacttacggtgccaaactttaaagaaacaatcagtaagctatggattttttttcttgtatgctgcagcagagtgccatggcacatttctgatttgatcctatgcaagtcacttagcaagttggcatgggtgttcttgttacttcctagtgaaagttctttttgtgcttcgaatctttttcttatgttaaatgcatatattattatatgcaatttgaaagagcttgcactgctgttaccattctacaggtacaagatttttggaaaagcgctagcaagagtacagaatgacagtcaggtttgtggacattagtgctattccacttccttcatacatatcatattttccccttggtacaacttcatgttttcacacgttttgtcaggttacagcaaaaattgggtatcctgttactggatatggcaatgaaagtagaaatcgtgcagctcggcagcgcattcctaacaaggtttggacagatgaggacggtgttgaacatgtggaggtagcatatattcttgcctctgttgttctgtctcttttaagtatgttgatttatttgccactcaagtttagtgtggactgtaacgccccgattttcgttcgggattaaaaaaaaaacatttaataatgcattttctagaaattaaataaaagataaatcaatttaatcaagtggaataatgggagaattaaatgtttttctgggcgtgacatggacacatgctccttgacattttattatatttatatggcatgggctaatggcttcatttaactgaggggagattgtgaatgataacatagcaagaggaaatgagaaatgagcacacaagcttcttgactagaaagactgtttgagtcaatgccaataataatacttagaagtagatatcatcgtgtaatggccttctcgatgatactttgctctttgtgtaatagtcttcgtatgctcttgcacttgactgttgtttggttacaactagatcgtcgggtgtaatctttatggtctatccttgcttaatgcaaacatgttctcagttgtcccatgtattctgtgaagatacaattctttgtttattgggaaagggggcattaggacgggttttgatattaagacatatagtttgcatggttatgcacacggttgaatttgattgatcactcgaaacacactcatcttatttaggtaaacttctatatccgaggaccacatggagctggaaaggtgtattcagagatgttcaaagataacaatgacaggagttggaagttcacataccttattgttgagattgtgtctccgcatcgtgtacaactaatgttagaatcttacgtaccagcataaggatgcaagaaacaagcagttagcagtggcagaattgttgtaaggttcatgcctccacacttacctatccaatgtgtacatctctcatatttagaaatcatcctttgattacagaagttttgagttttgatcttccccagtagcacaactatctgagtctgatcatttctggtatcttaaatatggtgtagcatggaaggacctaatgttactttgttcagctgaaggccattaagatacatgcatacatcacaatttttataacactgcttaaacaatggtagaaacaagagcaagattaccagagttcggttcctgttttatttgaaatcttcttttatatggatcgtccgatgttctctggatatcttgaaaaaatgtattcgataacctttcataattcttttacttatttcaagccagagccagaggtaaaaaggccatacacgggctgacgggaagcaatctccaagttcttgaaaaacaagtagtacaatttttagttgaccattcattcccctgaccagcgatttgtgttttaccgtggtttagatgcattcatcttaaccactcaaatatttttagaagttaacgtcccagaaaaggtgagtttggcaaatttagggagatttggtagttctctctaattacgtattacctgttaaatatatcatgcatatttaaaaatcatacagttgacgtatgtgcacttgcaactattgggttagcgggttagttgtaggtttaatttaatttttaaaaagtttcaaggcgtgttcctaaatttatgtgcagtttcttcgtttgctaagttctttttctgtggaaattttattcggaagaacctgaccattttatgatgaaaaataagcttaatgatagcggcccgtacggatttttaaatacgttctctatatatataaaagcttgggctccgtttattgaacaactctaccgttacctatatttcagaattaagagtaatctgtgaatttcttttgggattattattattttaatggtacatcgtatgaatggtggtcgcgcggattttttttttctaaaatagggcggccctattttggcaaaaaaaaaaaaaacaggcggccaccatttttacaattttcaattaaaataataatattagaaaaaaattgcaatatgttctctgtaccgataagatgtacttcaatttcttcaaacacgtcgccccaccaacatttcaaaagtgaaacgacacttcgcagtttgcaggtaaaatgtcaacttttgcatgatcatgtttgtaactcgtccccaatgatcaggccacttccggacccctggtcatcttttatccacaatgagatcagaaatcccagtgcagattctcacttgctttgcaaaggtcgtgcaaattcagaggttcggtcacctcattactttatcattcatagaccagagccattctcacattgcacatactcctccgtagtacctgtatatgctggacacatattcttctttttttgcccttttgtctctcatctgcaattgcaagagccaggttcagagcttagcatggctactactactaatccatccatctgatcactatcaagcctctatttggttcagcctttaccagggttgctttcatctgttagatcagcatgcctgattggagccaagctacgactactggtatagcttagcttttagattttaatctacctgctcccacaatgcaaggagtgggtgtatctttcagggggctcaattctttcctgtggatgcatcgtgttgtcgattccattttgtccaaagatctcattcactctcgatttctatcggtgaagcggtcatggctcgcaaagaaaattgtatggtatggggctaagaacatgaaagcttatgttcgttgtcaggaccaaatgatctcaggattaggtgattcgtcgaatcaaaaagatagttgatttgtgatctctgtcgaatcagcaggtcaacgtaacaaacacgcacagagagacagagggttactgtccatagactacagctactcacattcttttcagattattcaccgaactactacggtgttatttctttcacgttttcaaaaatacatttttctcaaaagactttattctactacgagcactttgctgtatgttattcgttaagttttttttttcaaaatattttaattcatccctataactaagtagataaaacccatcaacaatccagtgaatagttatatcattcttttttcttttgctgaactctaaacgaccaattgacacaagcaattatgtcactctttttaatctcataggcccattgtttcttctagacggtgacgacctacggctgttgatgaggcacacatcgtaatctgttagtagttagtactcctaacgaagaagtttggcgcgtaccagtgacttctgatgggttaataatatctctcagcattggtctggaaaggtgttttgatattgacttatgaaggtttcaactgcatagtaaacacactgacgtatgcatattagcttggaataattggcagtcactgctgcatgatgcaggcaaggcctgctcaaattaatgatagaactagaagaaactaaccttcgtactacgttcttggccgacgcttcggatgttgaaacattcttcacggtcttcgcaagcaaagcatatgcttcacaataattttatacggtcattttcgatgacatgtttcttcttatttagcttgccacatgccactaatttcaacatcaaaatgttattaaagttgcttgaagttttctcaaatcaatccagagggccaggaagtacctgaaacagatcggttgcttgtgtttctcaccaaaatgtctccctaaagcatgcccaatatcttgatcagttgccaattctccactattatttcctatccatttcctctgtgtctgtcatcacatgttcagcagagaagacaagcagaacaacatcacagcttagggggtgacattaaagaagtaatactactctccccacatgatgcatgcccatatccatttcatatgatatcaaatcatattacagcttcttccaagtgggcagctggggtcacctatgcaaatatcaaggaaatccctaggaccatacaaaatttggctagtttatgtaaaaacacagaggtgtggttttgtgctactagcaacagcatctcataagagacatgaacagcacaacacatcagggactgggataccataaactcccctccttcctcctacctccaggatcatggcctacctggctttcagctaatcagccacctaccaaataattccctagagaccaagtcataacaaaagggaacccttaattagtactaccactcaatcactcatggtgaataaaagacttacctagatgatgcctcagaatccaaatgatagcaccatcattctctgtcagtgtggacctttttgggaagatgaaataatcagaagatgaacatatagcttagctagatgttaatcatgcaggtccaatcaacatgaataacaaaacaaaggaaatggattaattagttcctcctcaccaaatcctcaacaaactttaactaacagcttggtactagtactgcaacacaaatgttcccttctctcctctacttccctgctggcctaccaatctaatccagtactacaaacaaagtcaaacaatccttcagtcttctcttcacctccaaccaccatgacagcaaaccatgaaacacaatctgaccaaaacacccctgcaccaccccaaattaattaaccaggctaatcatccattaagagactaagcaccaccactgaatcttcttccaagggtggtaatgcacactgtttcagagtttatcagagtttcagaagattcagagcaagggcaatcatggcaatatcagcttgagttgagagctccagttaaaccttccctatccaattccaactccctccctccctacacaagcaacaagagcagcacaccaacatccaagaacaagaagagcaagaagaggagaggagaggagttggaaggtagagagagacaagccatcattagccaccaaatgcaggcatgcatcatatagctgacaggacaagaatcagaggaagaagaagaggaggaggaggaggaggaggagacagctgctgccatgtcgtcgtatgaccagatgctcgcgccgcttcttggcgccggccggtcggcgtggacggcgcacgacggcggcggcggcggcggagaagccgtggtgaggcagatactcaagtgcacgaggtggcagctggaggagacgacggacttcgtcacctgcccgtaccactactactgcgacagctcgtacccgggcgactaccacgccgccgtcggcgtgctcgtcgccgccttcgccgcgtactgcttcctctcgacgctcgcgttcacggtgctcgacctggcgaggagcggcggcggcggcggcggcgcgggcggggtgagggggatcaggaggaagtacctgctcccgtcggggccgttcctgctgccgctggtgctgctcgtgctcgccaaggggcagcggatcaacgccgtgttcccgctcgcgcagctcggcccggcattgctgctgctgctgcaggcgtcggcgctggcgttccggaacgaggccgacggcgacatccggtacgcggtgctggaggcgtccaccgtctccggcgtgctgcacgccagcctgtacctcgacgccgtcgtgctcccctactacacggggctggaggcgctccggtggtcgcagttttccggcgagtgcgcgacctgcctctgccgcatggagcccctcgtcgtcggcggcacggcggtgcggtaccgcggcctctccaagacggcgctggcgatcatcttcgcgctgtgctcgcggatggtgtgccggatttacggcgaggagcggctcagcgcgtggacgcggtcggcgctggaggcccccggctgggtgttcgtggcggccgacgccgtctacctcgtcggctgggtcgccatcgagggcggcgccgtcgccgtgctggcgtacagcctcgtcgccggcctcgtcttcctcagcgtcttcggcaaggtctacagattcttggcatggttggagacgagacaatctcaatggaaatcaagcctctgccatagcgctgtatgatactactactcgtcagaaaaaaaaaatctgtaaaaagaaaaaggaaaccatttcttagctcaccttttgttcatttgtacaatgattcacacaatgagaaaccacagttgtatttttttttcatgcttatatataagttctctgaaacaaatttgtcaattcttggacaagttttctgaagccattctgaactttttctgatgaatcttcagagtttcttttccatttttcgatagggtgtttgagagcagcttcctgattatagcacacattagatattcagcttcgaattaggcacgtgtactacacttttggggtataattagtttgaacctccgatttggcataagcatgtccgggttagtacccttaggttaggtcagagtgccaccattttggcagatgagaatggtgccatgagaagtgaatgggacaaccggcaatgatgcagtgacaatgtggtggttcaggacatgtcaagtttgatcaagcaaggacatcacaactgatggcttctgcgagccagttcttggaggcttcctctctgagaattgtttccttatgctctttctcgttgtcagcttgtcatcaatcaatccttcaccagtttgagccgaagtggttggagcgtggttggagctttcacctgatgtctcacctggttgcgatttgagccaatgcaagaacagcacataagtacatactcactgcagtaaactgatgcaaggactgcagagaatctgattctgatgaaatgaaattgaagggtggcgacaatgagttttagaagtgatagtaaatgtacttttgtcgcatagtatttggccctacaattcgatctgcaatgaacaaagtgtttgacttggctatatggaatcccagcttttttagcctcgtgcattgtctgaatttcgaaagaaaaggtcgttgctttttataagaaaggtctgaaggaaagagtcatctgcataacgccttcagacttcccctcgagcatgattaggtaccggtgatcaggccaacgaactggaatgggtctctggtcaagattattgtacaaaatcaatgagttcatcgtgcattggaagcaagcttaaggatatagttgattgacactagcatcttgtcactttcagaagctagtggctgtggctacaattgtgcaggagcaggacggctcatgcttgtagcatccttgtcttccaactctttcccttggctttacaaccatgtgcatataaagttctgatggtgccatgcgctttgggagtaactgaaggtgcatcggatgtacactaatcaaactccaacttttggggctcctttgaaacacaacaattctgtaggattttttttttaaaaaaatagttcattcttgcaaaaattcctccaaaatttttcaatgatactaatacaaaatgatttcattcactggtgtgaaacattatctttcatcctctcttgggacatggtaatagcaaggttactaaaatcgcgatcctgaatcggaatcagaagttcttagtagtatcacaatcttggaatcatacataaaaaaatcgtaaaatcgtagattctacctatatagaatcgtagaatcaagcaccttaattagaattgtaaagtcgtaaaatcgtaagagagagtcgagattttgacaactttgggtagtagttaccattgggctgaatcatgtggtttaattaaagtttaaactagagtttattatttcagtatgattcagctactttccattgcgtgttgaggcaagattatctaagtgtggacctggtcgctgttgtggcagttttattaggtggtcactgttctgacttgagtgtacgctatagtttagtttatgaaaaatcatgtagcgatctcggctcctgtagcggcgtctgattgcgtacacatgacatgagtattgatttacaattgttttgggggaaggctaattaagcacacgctttgactgcctctttactaccaatgaccatatgtcgatggctgccttccttgtcactgctacgaacgtttgccgtcagttcatcataagcaatttgaatttgaattattaaagtttgattcaatgccgactagtagtctcctttggaatatggaatgcaggaatttcaaaacaacttttccccccgggcaatttggaaagatttttacataactgaactaaaatttttaaaatgtctgcagaattcatgcggtccagagaaacccgtacaattctacaagcccacaatccatttcctgattatctcaaaccagcagataactcacatttttccaaaaaatgaaaatcataacaatttttgtctaagtcacacattttcactcagcgaatagttttcaaactgcgaagtacaatatgcaaattatgtgtcaaactatctatatcttaatatctatactgctttaaatgatgctagtggtaatatctgagtttgtttctaacgccacaaactgatatgtaggaccataaggtctcacgtgaattttttttctttgcatatgacattatatgcttaatcaactaactatgatgtgaacttgtactttttgcttttaattgtatcttttcctagaaaaaaatacccgtgcattgcaacgggtgaaggctatcttaattttattattattatactgtttagttaatgtgacattcactgtagaaatttgattggatactgtttttacaagatcataatctataattaggagtccgatcgtttcaagttagcatgcgagttttctttaagagatttcttatatgactccttctatatttctaaaagcaaatggatttaacaacttactcaaataaaactatgtaattccaaaagcgaataaacttaaaacccgactcaaacgcagatgacttacgaaagtactagtaaaaacatttttaatttttataataagcatagaagagatagagatataatatccgttgtagcgacctttaggtcgtgtacaaaaaattctcttaaatccggatagctgataaagagaaaaaagaaggaaaaaaatacaccagaggtcccttaacttgtcatcaagctacaaaatcatcccccaaccacaaaactggatatatggcatcacttaactcacgaaaccgttcagtttaggtccttcggtggttttgaccccagggttgtccgacgtggcggctaagtcagcgtggatcccacatgtcaggaaggccacatcatcgccctctctcctctttctttctcctcatctctcccttcctcggttcctcctctttctcactcttctccatggcggtggtggctgcgaggcgggaggagggcggcgccgcggcagtggatgatgccgggggggaggggggcgatgacgggggagaagggagggcgttggtgtcgatggcggcagcgacgcgggagaagggtagggcattgccgcgtgggcaaggtcgaggatggagaccccggcggcggcgaggtgaacgacctcatggcatcgcacaagcatggcggcggcccgacggagctctgctgctgccaaagatgggcccgacaggcatgcatcggccgtcgtgggcgagcgctgggtggcggagctcaaggaagatgagggcgccgctgccaccgcctcctcgcccgccgctgcatcgtcgggcaccagatgtcctctctcgcctcgtagccgccgccgccgccttgtcgcccactgccgcttcgctgggtgccggatgtcctctcccgatttgcagccgccaccgcgtcgctgggcctcggatctcctctcccgcctcgcagccaccgccgccgccgcctcgtcgccaggcaccgcgtcgcccactaccggctctcctctcctgccttggcacgacgacctcctccccacccgccagcagccgtgcagagagaagcaaagtgacaaaagagaggggatgaagggagaggaggggaaagagagatggtgatgatagacatgtgggtcccacgctgactcagtcgccatgtcggacaaacctgggttcaaaaccaccaaaggacctaaagtgaacgattttgtgagttaagggatgtcatatatccggttttgcggttagagtacgattttgtaactcgatgacaagttgagggaccttcggtgtactttttccaaaaaaagaataagcccgcccaagaggttaatgggcccggcccaacttgatccgatgcgggctgcggccaccgactccgaataagacaacaagtccacgggagacttctcttcgccgtcgtgcacacgcgctcgatttcctcgtgtcccttctctctctcgatctccccctcgctttgctttccccaaatcgcgcagccgccatggaggagaagaagctgtccttctccatcccctccaaggcccggccggccaggccggccttccgccccgccgacaccgacggcgccgccggcgcattcgacgacggcgagtactccgcgcgcgccccggccccgcagttcgtcaccgagttcgaccccacccaaaccctagccaccggggccgcgccgtccgtcatcgcgccgctacagaactccggccacttccttaaccaccgctcccgcaagcccttctcgctccccaccccggaggaggaggcncgcctcgncgcgtncgccgccggcggcccctccttcgtgctcgacacgtnncaccgccccgacaacccctcctcccacatcgcctatggcctcaccgttcgcaacgccgcggcggagttggagaaggcggcggagccggaaaagacgcccccgcctcctcctgcagctggtgcccccagcggcgaccttatgctgcggaggtacaaggaggacatggccagtctccccgatcaccgcggcctagatgagttccgcgatgtgcccgtcgagggatttggtgctgcgctgcttgctggatacggctggtcggaaggtaaaggtattggcaggaacaataagggggataccaaggttgttgaatatgaccgccgtgccggtacacaagggttaggctacaatccctctgaggccgaccctaagaagactcgcgctggcgaatgggttgttggtgggaacaaggagacccagaatggaaatgcgaagaagagagaccgtgacagtagaggtagaacagaggatagagactcaagctcccgccagaagagatccggtgagcggagggcagagagagaggtccaagaaaaggatagaaattctcgacatactaaacaagttaagattggtggtggtggaggtgacaagatgcggtggttacacagcgatatcaaggttagggtggttagtgagaggttgagcaagaagctgtacttgaagaaggggagagttctcgatgttgtgggacctacaacatgtgacataattatggatgatcagtctgagctggtgcaaggggtagagcaggatatgctcgaaacagtcctgccacggatgaatgggctggtgcttttgcttgctggggagcacaaaggattatgtgggcaccttgttgagaagaattcagaggaggagaccggagtggtggagctgtccaatacaaaggacatgatacgagtgaaatacgaccagatcgcagaatatattggagacccagagtctcttgagtactagttcttcttattcttgaggagccagcattgtctaccaagagttcttctacgtgctaggtaattccaatttcttcttaatggtaaactataaagttgctgcttggacgtgaagttttgaacaaatttatagttttgctttgcagtaacatatttatgtaagtctgctacatagtgattgaagtctctctgagaccccgagtaatgggtcatcttgttttcatgtctcctttgcgtttgtttctttctaaagccttaagtaaactgtcattggcattctagtaattagcaacttgcaataattgatgattctgatagccctgcaatgaagggttatatatcaatgttggaagcttcctgaacatcctagcttctttaaatcttttacattgctatgcgtgtgaggacaatccttatggttattactgagttgcataggctgtaggcatggcctgatctcactgttaaacttcaatatctgcaaactaagcttgtgaaaaacatttttgtatgcatcacattatattatacatttactgtacatttataattaggaattttgttgaatatcagcatacacaactcgcttgggactaaagtataatgttctgttgttgattttcctggacatcataatgtgtaaatccttggaagggaattcttctttcaaatatttgtagagcctttatggagcatactaaaatttgtggagttttcattaaggggtttttgatgatttgccactctttagattggagatttgatgatttaccatcttgacccacatgtcatgaactcagagggtcccaaatgtcattgtcatagggtgacaagtggcaaatctgattattaataggtattgcagcacttatatgagttaatataaaaacttgctcttattttgtgattatcttgtatgttagctattgattgccattggaacaccgtgggatccaaactttgtagatcataataccccatgtcggtcgcatacacatgtggagtgcttcacagccataccattatggtactaatttcacttcaaggacacgcatgaccacaatagttgggccacagtattatactcacctgcctattaggctgactctctttacacttattttaaaatgagcttctatcatgtgtgcatattatgaacaatggttgcttgtatcgatttgatgatgataaacatccacagacattaccctgtgatgccataatcccataaccacatcaacgggatctaattattgcaacacaacattaaactggtaaatgtggattatgtttatcatttctgatgatacagtgcattttgttgcacccatcatacagttcccatttgtggtgctcatcatacagttccctctttttattttgcgcccatcaaacaatctaaaaaaacattgtcctgtgattttcctcactaatccattaacacttcttacaccttctggttcttcatttgcatgctgacaagtaatggggttatttgtagaatcaacaatgagaaggtcaataaccttccatcaaatatgtcatgacccgaggccatgactagataaacaccgttgggaagatagtcgggcggtgtcggctcctgtagaagggatacagattttgtctagggagaagaacattgttgggagggatagattagactaattgatattcattgcttaattcataataaacacaaccccatccttatatagatggtaccaacttgacccctaagtaaggacttaatttatcttatctctaactaactaataataatatctctaacttaattgatctgggctgcctatgggcctctgccttccggcccaatgcccatgacaaatatgcataaacttttgactaagttcctttggaatatcttgaatgcaccctttcggtcagcagcttccagttatgttggcacatattactccatagtgcaaattggtttaagcccattatttcttattcactgatgcataaatgcctggattttactgtattactgctctagtaatatagaatataattggtgggcctaatttatgtttttaaaatggaggaatgcacatttccccgaagatgtccttgatggattgtaactttaaggtgttaatgagggttacataaacctgaaaacagagaagccaattgcttatggatgttgcaaaaaaggcaagtcttactccacatgtatgtttcatcttgcatttaacatgtgatgatgtccgcctgtttttctcttcttttggcatcagtaacttctgcttaaccataatcagcaacagctccatcaaacttaatctttttttctttggcaataatatcaatcttgatttttgcgaactatctcgtaaatgcatgcagttaaacctcctaactaatactccctctgtttcatattataagtcgttttgcctttttttttctagtcaaacttttttaggtttgaccaagtttatagaaaaaaaatagcaacatctacaagaccaaattagttttattataacattgaatatattttgataatatgtttgttttgtggtgaaaatgttgccatatttttctatacactcggtcaaacttaaaaagtttgactaggaaaaaaaagtcaaaatgacttataatatgaaacagaggaagttctcttctttttttttctttttttttttgggtgaggaactaatagttcaaatttggtttccattgttatcatcctgaactcatacagatctatccaaaattccttaccacaaatagcaacaatttcataaaattttttttgttttggtaataccatcaaatcttgaatttgttaagtatctcataaatgcacagattaaacctttcaacagtccaaccattatctatacaaaactaaggccctctttgtttaggcttataagccaacttataagtcgaaaagtctaagccaaaacaaacaagcagctttttcatttggcttttttaagccataagccactctaacactattaagccaaaagctaggttggagaagcttttttttggcttatatgagatagatgtatgactctaccattaaacttaggacattaaatccactggcttataaatcatataagccaataagctgacttaaaagtctaggccaataagcctaagcctaaacaaagagggcctaagtatctcataaatcctcggattaaaatcttctaataattcatgtcttcacctttatctatctaaaactaagtatctcgtaaattcacgaattaaaaccttctaatagtccatgttttcactgttatctatccaaaactaagtaccttgcaaattcacggattaaaaccttctaactgtgttttcactgttatatatccaaaactaagtatattgtaaattcatggattaaaaccttataacaattcattttttcaatgttatctatcacaaaggctcattaatatgtaccaattgaaccccatgcttcactttctctctatataaccttccatgtaacctcagctcactgctcatcatgtacaatcgctgcacaccattctttcgctgatacataggcaagctgtgctagttaccagctaggagatggtgaagtgtagggcacgcacgactaggaaaaagattgagatcaagcgcggggacaagaaggtacgagatgcatgcttttccaagcgccacactaccatcttcaacaaggccaatgagctcgctatcctctgtggcgtgatggttgctgttgtttttgtctctcccaatgccaatggcgggattttctcatttggctacccatctgtcagctctgtggcaaatcgcttcctcgccaatgctccaaacaacaccagtgtgagtagctcaacccaaagcgggagggatgtggaaatccgtgaactagaacgtgaagaaagagagttgaaagagcatctacaagcttccacagatcagaataagcttctgcgggaggcaatagcagcaagggatggagggcaattgatgcttctcctgcagagtgattgtagtgagttgggaccaaaaggtctggtgagaggaggaacaaaatattgaaggataatgccatgcgtgtccatgttttagcaaaaccataatttctatctggttgttagtgtgcacccttggcttggctctccctgtaatgttgcttgtagggtttgctccatgggaattctctatgattattttgccaaatgatgagaacaaatttatcataataatgttgtggttgtcatatttgcaaggactgagtgcgtagatctatatattaatattggtggtgttgtgtattttattttacttctagtgctcagttctctttagaccttgtttcttttaattccagctgctctaatctcttgtaattggtgaatttatattatttgtcctgcttgtgatgttatatctatctacttgtttgtatgtttgttgcatcaaatatagttttcatttcgtgggaacttataccattatctcattgtgatcattaaccatcagtttaatctttaaacgtcttgtctgtgcaacatttttgcttcagtctctcgtaatctattatgttcatggtgaacttacctatccaatctttaaacccatgatgcatatgcaggtgaagctgaaagtagaagtgaacttaacatcatagcctacgcaaagcggtgaaaactgacatgctttcagatgacacatgtaccattctgtcccatgggtttattgacaatcaactggattttatgtatttgaagtatgatgccctttctctgattcgcatatcaatggaaaaactcaaaaccgtctctagattttgcagatgacagttacgaagttctctgaattgcctcaatcatgtcttcatttctaatttgtagctcttcttcgttccacaaactcactgcttgtgcatgatatatgcaggtggcagttgtgcggttgtggttccgcaattctcttgttggcattgggcttgatcggttgtgctggctgctgcagcaaatactctttggtttggattggggctgactgactacagctgcgctgctgcagccagcacttccgatcaggctgattactttctgctaatatactgtgagataatttcctgtgcagaaatattactattttctacattgtactaaacaacacacggagacatacaaatcgtgctattttccagtttcgtaattccgtatgacaatggaacgatacagttaatgcacatgcccccttgacgagataaaattccacggaggtcgcgcaaggagaggtgcgtgtttgatctgctaatacgttggaggtcgagcaaggagaggttggaggtctaatgtgttggaggtcgagcaaggagaggtacgtgtttgatctgctaatgccttaccgtaaaactgtcgtagcacttctattttgatctaacgtgcgccatctttattttaacatgtagaacgttatctaattgaatgaatattctattttattccttgtgtttgtgagccatattttatttattttgatctaacgtgcgccacctttattttaacatgtagaacgttatctaattgactgcatattttattttggaatgtcagctgcatgtttgattgatgtacgatgatgtgaaattgttcatacgcatgtgtcgagatggataattagggggtgtaggtggtgttcgtaagaccaaggctgtggccacacagccttttagaatgcctatggcactgttgccgttggattgagatcccctgactagtattttcagctgtttgatttatagcgaacgaaagatcaatcgctacagtactgaaaaacagtagtatggtattaatgctattttcaaccttactaaattttggtaaagttgcaaaaaaagtggctatatttaatttgccgccaaattttggtaactatataagaaatcctgtcaaaattttggcaagttaccaaaattttatgccaaaattgctaaaatttggtaaggtttttcttttagcatcaaagtgaacataccataatttactgtttcaaactattgtcacaggaaacaactacaacatcactgtttttgcactgtggcgttagactcattttattgtgtctctggctttaacgcctaaagtcggaggatctggatctgttgtcgttgactatcgtaaccacaactcaagctgacgaagatagccttaatgggaaaatgtaatgtacagacctagtaagccccgtttggtagggctccaaactttaattctcaactctaaactctgaatccaatgagaaagaagtgggcatgaaaatgtttggctagattggttagctccacgccaccacgtcctttgttggcattttgtcgaacacttggtgttgtcgccggcgctactcagcctgcgcgtcgccgccgcccgccccgtagccaccacgtcctttgtagccacccgctcgccgtcggtcgccggtgtctaccgaggaagatggaggagagagaacgtgaggagatggggtaggaagggatagttcagtggcattttggtgtaaatatactaaaaagttaaagggtagtcggtcttttagggtggagtggagctatggagcaacaaaaacccagctccgtccctgtagtacaaatctgtggagcagctctactaacttcgctcaaaaaatgaacaatatataccgtttggcataactctagctctaggtaaattggaattgggagctgcagctatgtcaaacggggtcttgattccacattgattatgggtttacttatatatatgtagctgtggtcttttcatagggttgggaactaatcccgctaaccgtaaaaaaaaaagcgattcattagcgcataattaattaagtattactatttttttaaaaaatggattaatatgattttttataacaactttaatatagaaagtttttgcaacaaacacattatttaacaatttggaaaacgtgcacgcgaaaaaacagagtgggttgggaaaggaggggggagaacacagccgtagtattggcattatctgatagaaatccggcccctgtactgtacccatgaatacgattacatctttgctcaacagtcaacatcttcctaaacttgaaacttagggtgtgtttagtttaaaaaagaaaatttttttgtgtcacatcggatgtttgaccggatgttagaaggagttttcggacacgaatgaaaaaactaatttcttaactcgcctggaaaccgcgagacgaatttattaagcctaattagtccatcatcggttcctccacgaccttggctagcgagcggtgccctcttcccaaacttaggccggtgcgcgcacgaccttgcctgaggtgtgcttgctaagttgctatcgccgcatcgcgcggtacttaccccacaggtcagcgccctcatcatcacggcattacacatcgaggggagtagccatccatccggcactgcactgcagccactgccagtgttgggggaggagaagccgtggctcgagatctctctcccagcgccgcgccggcgctggccgtcgcacggctacacgctgccccctgcccccggtctcgcgtggcgcgtggcggcgtccgctctcccccgcgggccgtccgccgtcgcacccgcgcttcgtcacgcgaaacacaaggattctcccgtacgcgcgcggctcgtcgccggtggagtcgcggacggcaagaggcgcgacccgttcagtgcttcgcgtttccatatgccggaccggaccggcctgtggcccatatcttagcctgggctgaaaccgttgccgctgcattgcgcattagctcctagtacgtattttccactgatttattactacttccaattttttagagcgtttcaaggaatcgtttcctagagagccagttaaatgtacgtacgatcctggcgtccaaaaatacaatttatttttttatcagggaatcgatagatgtcaacgtcgattctatctgtgcagcataatagtacacttgtggttgggttgcagcatgcagactaatcattttgctatagctcactcaacgcacttatataaatataaatatacttgagtgaaaactaataatgttggcgatcagttagcatgcacttgctgattatcaactaatcgtccaattctgagagggccaaactgctggttgttaatgagggacaagcaaaccagctgcaactgaaaacttcagctcatacaagtttcagtaagagccaaagcctcccacaactacagtattaaaaattgatgcgtatagtttctgtatgaccaaactgatgatagctagtcataggttcattgcacatttcattgtatttgcactcaggctatacaaaattaccctgtctgttgttgaaaacaaaaactacataatatttgattgctccatgtgtgttcaaattacaacagtggatatcaaccaaatacatataatgcaagtgctataattgtataagaaatgcaattcagtcatatatatatagctgatttaccaaactgcagtaaattaattaacagcccagcgagctagatagaacatccaaccaacccacacaacgcagcacgtcctgctgctgttctatgcaaagacaagccccgttttctttataccaacttgcaacagtcccatgagaaatgattagtccaatgtcaattaggggaatctcttctcagatcatagtgtcctcatgcttaatgacaacagcagcgttagttaacctgcatgtagcgcttccctgagaggggagccgataaactacaatatcataatgcactctgaattatacggtagcgccccggccggcctcgtgcctaacggttcagaattagtttaactgattaatgctttgtattactgtgctcttgaacaaccagcatatacatggacggcggctccagcactgaattccagtgaccctctgaaacaatattttgccatttcccaaaaagtatgtactgcataatacagtaatttcagagaaccaaaagagtattcatatatgcagtcagttctgttacttcttatccatgtgaatcgtgatatctcatgtggttaagacgatttaataaagttataattaagtcatgtggtttttaagctagaagggagggtatgtatcaagcatcggcatcaggctaaaaaaggccaagcgaatatgctgctgctgccggcaaagacatttttggggttcagagaaaggggatgcaagaaaagtaagagggaaaaaaggggcagaatgagaatgttcatcctgtgcgttttttgttgctgaaacaaagtgcacgtcgtcacgccgagcaggccagtcccttcttgagcccggaataaagcttagtgtgttcctctttttgatcacccaaattcgcctttaaattcaaagtcttttaattccttatctctcccttgccgaacaatgcacagtgatctcggagtactgaactactgatgatcagatctaggctggccctaactattccccggatcgccaacatggtcacgttttggagcatctcgatcgatcgatcgatcgttctctctcccatgccattgccatccattcactcatgcaatgcatccgtggctagcttacgcacgcattaattcaccacgcacctgcagatggtgagctagctgctagctgactgctgatctgcctcgtccaagctgagataccacgaggaggacgagggcatacgttctcgcaataacctatatatatatatattaggtgagagataaatcaatgaatgatcatacattgattagtctctggtaaagaaacaaataataatagtctgtgttgctccatctttctctgctcgatgctatagaaaaaaaagaattatttgattaattaattacaaaataaatatttgattaattaaggcgacgtcaatgagagggtcgtatgattagcagcacgccgtagggaagacttgagaaaaatagtactaacgaaaaccggggaggtggtgtggtgtgaggggtttcgcatcggcgcatgtgacgcgtcgccggccgtgtctcgtgcctgccgatccatcgatccatccatgggagctagcgatcgatccgctgcccgaagctggcctggccggcacggcggttgaatctgccccgctctcgattattgcgtttgagggtgtgggtgatgcatcgtgctcggcaggcaggctgcagcatcctcctgcattggtggaattcgatgtgtgtgtgaatggatgtacctgttgaagtgtaggcgtatgcatgcatgcatgcatgcaccagcaattcttcagagtttgcatgtattcgtgctacatatgcatgggaggtatatacctgcaggctgcaggctgtattttaagtgttccaatgagcagagatttccaaacaagtgtgaacagttgtgattggtttgttattacatcttccccttgttcacattggtgcaccgacgacgactgttctctgaacatggtcagccgtggcgcatctggcgcagttcttgtcagtcccggctccaacagaccaacaggacgattcacagcccttcaacaacgtactgttaaacagtactactacttgtttttcttttccccgccggatcggttaacagtagtacgagtgcaaaatccctttctcttcagggattgcgaataatttgcgatgccaagttgacaactcgtcgcctcctctgatacgacgatgcactcagcctgacgacgtttccactgaccattgcgatcgagctcaactgactcgcatgaaccttcttcagctagccgagcatggcatgcctctcttcaggcgaggcgagcgaaaaggaaagaggaggagtgcatcgtcgcatggaagtgcgggaaagcgcatcagcggacggaacaacgcccagctgctgcaaaggcgcgcgcctcccctgcagtaaacaatccccttttgagccttttcctctgccttttctgaaccctccctttgttactatctgcctctccacttaattgctttggctaaaatcagtacatatgcagctgcctttgcaaaaagctcactagtattgcttgctctcgcactcgcatcgcacccagcacacagcagcaagcaaatcggcatggcaagtggcacggcggcgctgcatgccaaacgagcgcactgtgcgctgatgcacacagcggcatctctcaaatctcacggcggcgtggcgcgcggcctggctccgcgatccgtgtgcgtccggggcgcacgctacgtgttcgatctacctgctaccgactcgcaatggcaaagctcgatcgatcggtggatctctctgatgatcggtggatctcgctgctatgtattcgttttttacttttgcagttttttcgtttctttcttttcttccctgtcgccagacaatgatcgtttggtcaattgtgttgtctaagaactcacagctttcttttagtatattgacgtgcaattattttacgtggaaaaaatctgatcacctcgagaggctgaaaattaaaagggcgcggcacgagcatggcgctgtgggatatggcggatataaatgcgggacttgtggatgcaggcatacgttcatgcacgagcagttgccgtccccaatgattggataagaatatgtaagatcgatgcatcatgcatgcacatcatgtaacaggagaggagccagcgattggaggagtttgatgaagtgtgtgtattatatgtagcttctgggttcggaccagcatcggtattcatcagtatggggtgttgtttcatctcgatcggtcgaggtgaggatttgtcagttgtcagttgtcacacacgtaaatattgctacattcgtctcaaaatataacaatatatagtatgagatgtgatgcatcgattttaatatgacgaattaaacataagatctatctagatttatagcactaacatgcgtattattccataccatattgttatattttagaatgagtagcttcagagttactggctccggcgttttctgcctcgaatgctccctgctacggccattgtgagcaggtgacaggagatgggcaacatgctacatatcagaagtcctgctattaatttgtgaaattctggccaatgatctactgtgtttgtaaatttatgtttagacttctgagtgcaagaagggatttacttaggagttaataatataatttgaacataattaatgcagaactctttcaattgaggtgataatgtagcctagccagctaagcaagaccaaatgttcgattgggaaatgttggagaaagaaattaatggttgaatcccacgtttctgttcattgcattgttcaagagaaaataataattctctttcaaaatcaaaaacaaaagagaaaagaatcataagattctaaaggaacgtaacaacgcacagagctaatctgtcagaactggaactagtactctaatttaatttccacatagaatcttatgtttataagatgaaagggcaaagcattgtgtgcccctgttttctgaagtctccgataaaaatctgaaacgaaatcaagctcaaccactcattcagcagagttcattacaaataagctaattgagaccattagaaggaatcgagtagttgactgaaacaagggatgaagtttctccatatatgaacatggatcaaaccatgtcaacgcagtgacatacatcgcctcgatctttgtacaaagcgcctcctcacaactcataatccacaccacacactatacaaaagtaacaaattaatcctagctaattaaacaaaaaccttgcaaacgaaacccaaaagggaagcaaatctcacaaaaagggtgcaaatttatagcttgactttgttcgtctttgccttcttggatcggctgtcttgactccagctcatcagtttgcggaaaaccccctgcctttcctcgtaattcgatttcctcccgaagctgctgcgcttcttgcctcccatgctgttccagctccccagcttcgccttcttgtcgccggcgccggcggccgccgagtccttgtcgggcaccaccggcggcgccacgcaccgtatgagcgcccagtccacgccggcgaagaacgggtgcctcttgatctcggcggcgccgcgcgcggagcccatgcgccgccgcgggtccctctcgagcagcctgccgatgaggtcgcgcagctgcgcggcgtcggcctcgccgtcgagctgcgggtacgtgacctgcttggcgaggatgttcttgagcgtggcgtccttggcgtgccccttgaacggcgtgcgaccgtacacgagctcgtagaggaagacgccgaaggcccaccagtcgacgccgttgccgtggccgctcccgctcacgagctccggcgcgaggtactcgtgcgtgcccacacagtcctttgagttcgccgtcgtcggctcggcgacgaactcgaactgttccttcgcgttaacctcgtcgccgtcgtcgccgctgccgccattggcggagaagcaggacggcacgattctattcttgcgccggctcagtttccgaacctggcggcggcggacggcgggctccacggacgccgggagcgcgaggtcgaagtcagagagcacgacgtggccgtcgccgcggagcaggacgttctccggcttgaggtcgcggtacacgaagccgagcgcgtgcaggtactcgagcgcgaggagcacctctgcggcgtagaacctcgccgcggcgacgggcaggcgtcccccggggcggcgccggagcaccgcgtggaggtcgccaccggagcagtagtccatgaggaagcacgcgtagcggccggcgtcgaggcgcgcgtagagggtgggcacgaaggggtggtcgagcgaggagaggacgcgggactccgccagcacgtgggtgacacgtgacgggtcgtcgtcgcggaggtcgacgaccttgagcgcgaagagcggggaggcgggcggcgagctcttgaggcggcacaggaacacccgcgcgaggtggccgtggcccagctcgcggatgaggtggaggtgcgcgaggcggaggacgccgtcgggcgtggcggcccgcgcggccgcgaggagcgcccagtgcggggacgaggaggacgagtgcggccgcggggagagcgaggtggaggacgagaaggatcggcagggagatgcgagcttccgcgcgctgaaggtggtggcggtggtgaaggaggaggtggaggcggaggcggtggaggtgaaggacaggtccagcgcgccggcgccggcgtcggcgagggagggagggaagtggggcaaaatgtcggaggagagcggggacggcggggcgtggtcgagtacgtccattggcggcggcggcggcggcgctgcttgcatggcacggcgagagggaagatgaaggaaggagaggaatggaaagcctgggtgggacgcggggtgggggtggggttataaagacgtcgtggagagagatgcgggcggaagcggagaaggaagcgggagatcaacggtcgcgactagggtcagattccatatggtttctgtaatcaatggactgatcagatttgctacaggtgattttctgaaatctcagccacctgatcagggcaatccaacggtcagatttccttcgtcagactcaccttgggtgggtgaagagggagaaaggcagtggggacacatcgggtgtgtggttcgcagccaaacattggcacgtctaacacagaaaaggagattagtacatgattaattaattattagtttaaaaatttaaaaatagattaatatgatttttaaagtaacttttctatagaaaatttttacaaatcacacaccgttttgcagtttaggaagtatgtagtaaacgagagattgggggttaggaacttgaaatgaagaatgcagcccctaaaacacttgaaattgttatctttactaaggaaccatacacaccgtagcgcccgttccgtcgtggcgcctagtgggaaaactatctcttaaaaatcctaaatgcaaaaattgtttctttatttgttgtccagtgtccgcgccattccagatctcaaatccccaatccatcgtcgaatccaaaccctaatctcaaatctgtcccaaatcaaatcctctcgaaaagtctattttgcctccctcgagtttgtgggccgatctcttctccccggcccatttcctctcagcccatcttttctctcccctccatcctcgcccgcacgtgcgaggcacgtgcgccgctcgggcactgagcgagagagagagctcgctctatctttttttcctccatctctctctgctctcgctccctctcgttgtctctcctgccgacgccgcccaaatcgccgtgccgttgcttcccgcacgcgcgtgcgcaccgtggtggccgaccggccaatcgccgacgccgtcagcacctgccgcgcctgagcccgcgtctgccgccctgtagccgcgcccttccaaaccgccccgccgtcatcgccgtcgtcatcgacctggccccgccactccgcgtgcatgcttccaaggaatggaggcagagctcctccttcatctgcctcatcgccctctctccctctttcttttcccaaagaggcaaggggcaagccccttttcttccttcc

SEQ ID NO: 59770 - DNA, 24340 bp, Oryza sativa
ctaattctcatgcaaaactaattgcagatgggacaaaagcgctatttctattttgccggagtacctgaaaaagttctatattaaattgctaatcaactttgaggagtttgagcaccaagtgtccgacaacgaaaaatacaaggttacttacaccaaacaagaggtagaagcatccaaatatctctatgggaaattttttgttattaccactataagttatattcttatttagcgacaaccaactaaattttgaggtagcgcgtggcaaaaaaaaaaaggaaacttgattttgggtgagaaaagcgaaattacatacttttcaagtgtcaacataaaactaatttttgcacatatatgttcgggtattattatgttgtagttattaattttgttttatttgcttatagtttcaaaggcagtctacttattacctacaagaagctgaatggtcctaccagaaacacaagccaagctttaaagatcaggtggttttgtccaccaaatcctcggccgtgcaattagtgtgtgtggctgctatgattggctggggtaatgcagtgacgacagaagcattcgagtgggcagctagtggtaatgatgcagtcatagcatgcgcaaagattggacgttttatgaatgatattgctgcatttaaggtacatatatagtagtattactctcactgttctattcggcttctggattgtgaaatcaatactagctttatcccataatatgcatagccaaaatataacctcataatacgggacagactgagtagtctgtgattaatagacatttttgtcattgccttttctaatcaatatgtccatcaaaattgtaaaaagtaacaatatgaaattattttttacaataagtctactaatgtcattttcgcttgacaagtcttaataactgtaaatgtattaatttttcatgattttgtggctcgtctacgtatattaaaaacatcatctatttaagaacggaataagtaaaaaaaactcttttcaccaagtagttaaatataattctttttcacattttcatatgcattatacacatgcagtgtggaaagaacaagggagatgttgcgagctccgtagagtgttacatgaatgagaatagggtcacaagcgaggtcgcctttgcaaagattgattcactggtcgaagatgaatggagaaccacgaaccagacccgccttgagcatggtacactgctgcccatggtgcagcgagttgtgaacttcaccgtttctatggtactcttctacgatgacaggaatgatgcctacacatttgccacacttcttagggagattatagagtctctcttcgtgaggcctgctcccatctagaccttaatggttaactttctagccaatgtggcaatccatctgcatgtatacttgtattgaatatgcttttggcttctgttattcatgttaacaataaacttgtgtgctaagctacttaatctgcatgtgtttcattttgagtctgtatgcgtgagcccacgatctatgtggatagccatcgcgaggagtcagttgtgagggcatccgaggctagctcgctgtccgcgtcgtgcgccgaattcaaagacacgtcgtgtggctgtggggatggacgcagctagatcacggcggcagaatcggtcctggtggttgtatttccagtttttgagttgctttttttaaggaagtaaacagaaaagcagcaatggttgcgctccaccaaaatgatttcctctgtttcctctctctcagctatttgcaggtttagctacagttcgcgtgtgttgtgtttggccaaattcccgggctcgatcgttgggtaaatcctgacaattcatgttatcgagtaatggatccatgttttattacttcactaccgtgtacaaaaccagcgtgggccttatgtgattaggtgacggcctacattaccctggcccgttaagctatgttggtatatatcgacgaccggaaccatcctatgattttcgtggggtaagaacctaggtcgaaggcatagcgtgcctatgacccgggaacacggcgcgtgcacatctcccgcgacgtcatgttcgatgaggcttcacagtggaggtgggatggcgagacggcgtctgacctctacaccgactttgtcatcgagtacaacacggtgtaccacccaagcgctaaggctggacaacatcaaggccacaatggatcacccacgccggccgcgacctcgtcacggacgacatcaagctcaccagcacgcggttgaacaccttcggtgcacagagatgcatctgaggtggaatttgtgtcgccaccacttggagctaaagagaacctcgacgctgatcatgatgacgtgctgctccgttaccgcaccatcgagaatgtgttgggatcagccgcgccgctggggctcgcatgacgggaagttctggaagaactgatgttggtgagcggagaagagcatgtgtccttcaggcaggctgagcaagaggaggcttcgcgtcgcgccatgctcgacgaaattgcttcaattgaagaaaacaagacctggagactggttgatctaccgcctggacatcgaccgatcaggttgaagtgggtgtacaaattgaagaaagacgctcgaggggtcgtcatcaagcacaaggcgcgactggtggccaaaggctatgtgcagtgagccggaattgattttgatgaggtattcgctctagttactcgtctcgattctttacgcctgttgcttgcccttgccgcgcaggaaggtggaatgttcatcacatggacgtgaaatcagctttcttgaatggggagctagctgaggaggtatatgttgcccaaccaccgggattcgaagttgagggggaagaaaccaaagtgtactggctggtcaaggcactgtacgggctacgacaagtgccccgagcttggaataccaagctggactgtactctgaagaagctaggctttgtgcaaagcccgctggagcatggtttatatgcacgcggtgctggcggttcgagactgctggttagtgtttacgttgatgacttggtgatctttggagcagatgatgccatgattggtgattttaacaagcagatgatggttgaattcaagatgagttatcttggccctttaagtttttatctggggattcaggtgattcagaagggggtgccatcagtctgaaccaggcagcctatgcgacgaagatcgtggagaaggctggccttgtgggatgcaatccttgtgctacacccatggagccacggctgcggcttagcaaggaaagtacaacgccattggtagatgccactgaatatagaagtttggttgggagtctatgctatctagtgaacactagacccgatcttgcgttcgccgttggatatgtaagctggttcatggagagaccaacggacgaacacctggcagctgtgaagagaatcgtccggtatctggcgggaacgatccatctgggatgtcgctacacaaaaggtggggagaagaagctgcaaggctatagtgacagtgacatggctagcgacattgacactcgcaagagcattaccgtaccggcgtgctattctttcttggtgaaaatttgatcagctggcagtcacagaaacaacgggttaacactctcatcatatgagtctgaatacattgcaacaggaaccccctctagcaatggatttatgtattgctacaagtccatataagtgctgcaaaggtctacagcaacgcatttagtatgtgttgcctatgctggcattgctaggttatacacgttgctgctcggtagtaatatatagataagtgttgtaaatatccgttgcaagttagcaacaaagtgcaaaacaataccagaagatttatatgcactgctattttcaattgccagtgatcattactcacatgacaatatttctattaataattcaccgcaatatgatgtacaactgatttcattttaaaaaaaataattcatatattataagcataaatctcaatattctttacaaagacctcacagagatacaatttgtcaatacaccacaacataatactgactagtctagccttacactaaaaatattttatatcattttccacaaactttgcttcaatattcccgtgttataggcaaatgtccaaaatatgaaatcttcctgggactatttaggcgtgaaagatcaacatttacttgtaagtatcaaagactggaggagataacaaaaaccactgatagtagtaaacaaaatgaaagctagttgattaccttttagttcgaagcatcttcaggattatgtattgtatgtcttttgctgaagaaaatggcacattgaaaatctcagcacttatatactttatttgggaactaacaagaagcaggaacaccttcatcgtttcattaaatagtttttggaataaggtttacatatgaggatagtaggaaaagttgcatgatttctttctttctggtactgaagataaattatatccaagtgtgccgctatggtcttatatgatttccgactctacatgctcttctgtagcaataccaagttatagctgatctaatcaaatgaaattgccacaaaattgacgtgctcaaatttatcactgatgcagtattgtgatatattatgagtatgtatatatacgacaacacttttaaatgctacaagtctaggacaccaaacatgaaagagtttaagacagcaggctggaggcatctttgtaattttctatgttgttgtcccctgcaaaaagggttggcagatcaaaacaattagttgatccagaagttaatacatgtatttgagaattaatataatagatgtaaaaaatctgtgaagtatgtatatatgatcttggttcttgaattaatattactataacgcagtttcagtttcaggaattattatcataggacacaaccccattgtttatgaactccatatgctctcgtttcagtcagaacatggctttgtttgtgtaagtaacataggaaaaattattattagagcttagaagactagggcataggtttacaatatcaatcttataggccttgttatttagaatatcagtattatggaaaaagaagatgaacaatttctgcaatccacatctgcctgtatgtattaatcagcaagatgaaaatactgcttcctttttgacatgcatatgtatctttcgttgtggcatgctcatacccatatatctaagatgattagaggaagttgtagccttctccgtggaacaaaaattagcaacttaactactactggttgattgctgcagcaaggattcgtaaatcatatgcaccatcgacacaagaaaaaaaaaagaaacaaatgaagtagatctgcagaggaacagagcagctcagagcaagaaagaattcaggagcagagagcaaaccttgatctacagttctacacggtccttgtcgcacagctgccgtcgtttctagccagactggatgtcccccatgatctgtgcgtcgccgctcgcccgtcgctgcaccctgccaactcctcccatgacgccgtgcctagcgtcctacctgcgcatcccaccacaccatgcctagagaccatgccattcccggaggccgacggtcggcttgcagccaccgcgccgcaagagattggacgggatgggggattcagcgatacctttcgggatccgcatgcagcagggacttagggttggccagtttgggtgggcttagtgggctgggcaattggggagctcatatggtcaatgcgttgctggattgactcagttactggtagttgtggacccagcaacacatgagagatccgttgcaagccatgtgttggtggaggggggttcgtgttgttgtggctggggagatcctgtcaacactggaggggaacttgtagacatcctgacgagcaaaattccaggaactgcgggaacaaattggtatgatttcggtagactcagcacataaggcttagggggagttttgttaacaataaacttgtgtgctaacttagtttatctgcatgggtttcattttgagtctgtacgcgtgagcctatgatctgtgtgaatagccatcgtgagggcatctgaggctagctcgctgttcgcgtcgtgtgccggaatttgaggacacgttgtgtggctgtggggatagacgcagctagatcacggcagtagaatcggtcctagtggttgtatttccggtttttgagttgctctttttaaggaagtaaacaaaaaagcatcaatggttgcgctgcaccaaaatgatttcctctgtttcctctgtctcctctgtctcagcgatttgcaggtttagctaaagttcacgtgtgttgtgttccgtcaaattcccgtggtcgatccttgggtaagtccatgttttattacttcactatccgtgtacaaaaccagcatgggccttatgcgattaggtgacgggctacattgccctggcccgttaagctatgttggtatatatgcttttgcccacttctttttttccttctcactggtggtatacacacttgggctttctactgggagagtatgtgggctggaatgctggtttgagcagccacatggatttgctgactttacagtataggggatctttttttttttgaacttctacagtacaggggatcttgattttgtggttcgccatgttgatttgtttttggctccaatagcttgaaattctgatttatatgtttgacatgtggtcatgtggagatgaaatgggagctttgaaggagacgaggccaatttttgttagaggtatagcattttgcatggtgacatgaaaatatcattgtgtggattggcggcctttactcgccagatgcctatgaaaagcacttatttttttgtaagcagtgatatcgataagggggcattggtttgtggagcacaattgctctgatgtattttggtgttggtctgagttactttttggtacatcaaagtgattttggtcttaatatgggttactttttggggggttttgattccttttgatgaatggactgggacactttttggttgcaatgaactgctacatctctgcaccctgcacagtgcgggatccgggattttttgttttttgaacgtgaaccaaagaagctattgctatattcctggtggttctgtttgtaagtgaatttttctcgaatatgcaggagaactgcatatcattgcatacacgcaaaccctcacttcctcacaacggttcagcaaaccaccaaaaacaaaatatcaaaacaacaaatcgaagaacaatagcaacatgacctctagctggcagcagcctcaagctacaccaaacctctggtccaaaagtttccttcttcagcaatctgcactaaagctgtatggatattttgggtacaataccaataaatgtataatcattctcatacttccagaacattcatgcgccaatatatgatcagcgtatttatgccacgcttctagctggtcgggatcaccaagttaatcatcagccaccagctacataacacaatatcctccacccttggtgagaagtctggcaacagaaaagcgatagaagagggacaaccaaacatacctagctagagaagacaatgtttgcaaaattgtatggggttgtctcctgctcctggtcaaatcaagggcagtgatttgggtgaggcaaaccaagggtaagtatatcaaccgtccaacgccttgtgcgccgccaaccatcaaatttagaaattgtaagaaattacatggctggctccatattttgccatcaacgagtgctaattgcaagaaatttcatcgtacaggtgatttagtctaataaatgccatcaccgtcagttttctaccgccatctactaagtgataagaaaagaccattttaccccttggtactactagaaaaataatttatcgccacgaaaaaactcgtagtatcaatgctaaaattgtggcaatagattaatgttgctacaatcttaaaatcgttgctagccgtggtaataaatagcgtggtaataggtgttgtcgaaacgacaaccgcatacgtcgaaagacgtggttactcaacagtggttggaaagaaacgaagtgtgttaattttagaattttttactccggatccccccattacatggccccaggggactatttatagcttcattacaggttcttactactagggtttaggttatacaggggaatttatatggttgcccttacgaaagggacatttacaggggtacataatgttatggaggctcatgggtccctgatgggccgtcgggcgatcgccggccctatagcccctaggcttgatgggccggaaaggcttcttcggccctcgcgggggcgaactcgccatggcgaagtcgtcttccttcggcagatactcttcgccttgcacccttcgcctgggacgcctctggcttactcgcacgacccctcgcctctcgccgttcttgctccatagtcttcgccacgggtttcagcagatttggtcgaagggcctcatgccatccgccaacaagcccctcacgggcaagggtgagaatggagcttcggccgagaccgtgcacaccatgtggtatggtacgcggcgccccctttcgaccgatgctcctgccgaaacctacattgttcctgcaaataaagtttgttatttgtacggctggtattattttgccgctcttcgcctcctgcggtcagtggtatatatatttttttacttttcctgggccgaaaggaacagtattgggctttcccttcgtgggcttttttactgtgctgctcggtcgatgggaatttaccgttttgcctacccttgtgacacgtggcgctttcttactggtgggtaggcgaaccatcgcccgggtgagctatatattcccacccctctttccttttcatcaccacacttaccatttttaccgcgtgcgctctcttcctccgttctttccttccacagcgtttcctgacccctcaggtgcttcgcccattctcttccttcgccaacgcatacacaccgttcgccatggcccctcgcaagccaaaacctgctttggcgaaagggccggatcccggccgggttgatgacgacagcaccgcctttttgggggtttctcacgtggacgacgtcgagctggcgaatttggtcagctctggggcgttggttgaggggcaggctttcgccccagggaaagccgtggtgccgaagcctatcgacaatcggacggtggtgttcgccgtcttttttgaggcagggctacggtttccgtgcaacgtgttgttgccggagatccttcgccttttccagttgagcccatcggcgctagttcggatcttcatcttcgaatgggcgtgccggacttccgggtttgagcctagcgccgaactcttcggcgccatatttttcgccaccgtgaactcgaaaatggtgattaccccggctggaacaaagaagacagtgttcgggagcgtgaactttaacgttcgccctgagtggtccgatctctggccggtgaacgccgccatgtcgaagtgggaccaccattggatggcgaggtggttctttcacaccatccccttcgaggctggttctgactcggcgaaagcccttcggtgccgtcgcagggcgattgcgccgaaccggaaacccaagatcgccgtggacggcgctatggaggcacggttcgttctactccgtaaggtttgctcctgccttagttgccgtgacttggtggaggaattttgtatgcttcgcatctttcccctctcccagtcatggcaagtcacggttgatcaagacgaagagattgacggtttgccgaagttggttcttcttgagggaatgaacagtaagactgttatttcgctatgcactcctgtgctttgttatgttgccttgttcgacatttaatgtagctacaccctttacttttgcagtgttgactctcgaccaggctgaagccgaagcccgcaggatgatcggcgatgtatcggtcgtcaagtatagcgagctgctgacacgacaagcagctggccgggcaaactgggtttacaacagtgaattgcctccccgggcgaacccccacaaagccgacgacgatgcaggaccttcgcgaaagcgaacgcgcggacaagtgaagcttgtccctaggaagcgaagggttcctgcttcgtcggattccgacgccgacgacgaggatcatgccgaagagcatgacggcgaggaggaaggggaggaagaagaggaggtggaggccgtggcgaaaaggccgcaaacgaggcgatcgaagaccgcgtcgacacccctggctacactcctactccaagtcccggccacaacgagaccggggtggagtcgaacagctccccccttcgacgaaaggatgtggaaggggcgaaggccctagttgcgttctcgtcgagcaaggcggcgaagggaggtccggtcaagaagatctctaaaaagaaaggactcgtcgacatcgctcgcgtttttagtgacgacgagtcttctgacgagactccgacttcacccgctggccgcagcctggacctttcgatcgcccccattcttccactcggcgctaatggggcaggcagcagcgccatcaccggggcttcagcctccgccgaacggatcatgatggctgcggcgagggtcttcgggagccctctgcgtgaaccagctatttcgccgttagtcaagacgaaggggaagggtgcggccgccgaagcatctgcctcggagtattcccttgcggcgccccacttcgcccctggtgatttcgagacccgggcggaccttattccctttgtggagggagtaagcaatcttgtcctacctgccagcaccccgagcctattcaccgaactaaatgagttcgatgaggggtgttctgctattaaaagcttggtagttcgggtatgctttttctcccttcatcattttcctctccccttttcttttacctgtctcataattaacattttgttctcttcgcccgctcgtatcttgcatccagattcttgcggctcactgttcgacagagcgaaccgcgtgggcccgtcttgacggatttaagaaccgtcttcgggccaaggacgacgaaataagccgcagaacttggagatggaggcactcgccaacacactcaaagaggcgaaagctgaaatcaagcgcctccaatccgagttggagaaaggaaaaaaggctagggccgaggtcgattgcctcaaggccaaactggagaaggggagagaggccatagcggaggttgatcgcctgcaggccgaattgaaggaggaaaaggcccattccgccgtgctgactgattactataacctcactgagccgaagatggaagctcttcgcctgaaggttagcaaggccgaagcgagcgttgtggatgagtcgcagcggttttcgcgggagatggcgaaaaccatcgaatccgcgagaacggcttgccaaacgctccgcctcgcgcttactgacatgggcgcgaaggtgcgaggggtctctgccgaagatgcctcagctttcgacttctccgagtggacccagcaggctggcggttcggtttcggactgtgccactacgtacggcaattgctgtgcgcgtgtatcagcggccttcactttgggccttttgcaacagttcgtctgcgagcacgtcgccgagttccctaactatgcgaagggggactgggagattagtgcgcagaacattacgcctgctcttcgcgcgtggcgaaaacagttctggcagaaggacggcccgtccgctgccaaggcgcggcttttggagcaactagcaaaggcggaggcggcagaccggagcgaagaagaggacatggcaggcgaagagggtggaggcgatgcccaggatcacccagaggtgtgaggccctccgccctttccttagatttttgtagttttccttcttctttttgcgtttgcctgttgaggcgaacgatgtatattcggcaggctgccgctaaccctccttactgtagccaaaaaaggtctctcgtatatttggaatgtatgacacaatcttagccaccttttgatggtcgaagtctttggcgtattattatttcgctcatttcgcattatgccataccttccttttttttcacctattcttacaatgtaaattgtgttttgccctttctgcactgtctaccagggtgttcgccgaaagtcgtgcattcggcccccttctgggagctggcgaagtcaaaacgagaaatttgtggcattgaagggtctgccgaaggtccgatgcccattttggcctttttatcgcgaaatggagataaacagtcgcagctataaggtttttaaggttgccggctggctgcgggcgtaccccaggcgaaccttagaagactacgaccttgttcattcaagacgtttggaggatatggctcgcttttggcgaaaccatcagaagactaatcgtcaggaagcgatctctcagtgtcgttacagtttagtcagtgtttcgccccctactcctcttagggttgtgtatgatattagtagtgatgacgaacctagttcgcctgaccattccttagggagagatagtgactacgggggcgaagatgtaatttacttgtaagctgggctgtattgtattgtaaaccttctattcttcgattattttttcgaagttaataacgatgtgttttattcccttttcgctatttttcgcattgtcacattttgtgcttttgttaggtcggaacatgtcatcccctttgcgtatattagcgaaataggtgtactgacttttcagcttttcgtcgttcgttttcgatccgtagcgttctgtgctgcaagaaacgcttttgtttttatgttgatcgaatgtaacggcgttcggctagttatttttcgaaacaagctgtggcggtttcaacgttcagcgagcgatgcttcggccgattcgtttcgcccccctggcctttttcgttgatcaggtgtttgccttggggtttttccacaaattatcaatcacacaaaaataaaaagaaggcggaggacacaagggttttatactggttcgggcctccgtggtggataatagatctacatccaattttttttgtcttttttcattttcctcttttttttcttttttttttcttgccgaaaggcttacaaagtgtcgaagggcttacatgatgatatgtacatttttacaagttggcgatttggatgccacccgttctagacatagaagcgcttgagagaggcggcgttccaggaatggtcgaactcgtcaccttctagtgccgccaatcgaaaagatcccatcctagacttgtgcttgatgaggtatggtccttcccactttgattcaagcttgccaacagcaatcgggttcgctttcttccttaggacaagatgaccaggcatcagctccgtcggttgaacttttttgttgtaagttgccgaagtgcttgtggtatactggcgcatgtgcttcgactcttaccccctccaagagttcgagcgacacctcgcgcccctcttcgcccccagagaacatcacccttggtgagttagcctctagctccgctggggtcattgcctcatcgccacaaagaagcataaacgggttaaacttggttggtcttgtgggggtcgtccgaagggcccagagaacagatagcacttcctctggccatttgcccttcgctgccccctcgagccttttctttagtgcttctaggatcttgccatttgtacgttcgaccgccccatttgactgcgggtgcacgactgacgcgaacctgatttccaggttaagtccttcgcacatctctctgaacttgtcagagtcgaaccgcttgtcgttgtcagtgatgaactcttttggcactccaaaacggcaaacaatgtttttccatacaaacttttgtactgctgccgaagtgattgccccgaggggttcggcttcaatccatcgagagaaatattccacagccacaattgcgaacttatacccgtttcgcgccaccgggaacagcccaatgatgtccagtccccatctggcgaagggccagattggcgcaatgggctgcaaatcatactagggcacggtttggcttcggccatgacgctggcaactttcgcacttcttgattttctcaatacagactttcaacatagtgggccaataaactccttgtctaaacactttggaggccactgttcttgcggcttggtgcgcgccacatagcccctagtgtatctcctttgccatttcctcgccttcggcgaaagagatgcaacgaagtaagggttgaagtaccccggagcgatagcgctgggccgagaccatcttatacttcgtggctctgagttgcaagcgctttgcttctgcttcgtcttccggaagccagccagtttcaagatgtttcacaaacggggttcgccagtcgtatgggtcttcgctcagtttcacctgatcgattgccatgacctccaagctgtccacgggcacacttggtgcatacaggacttcgaaaaagatgccaggcgaatgtgggccactagaagcagcagatttcgccaaggcgtctccttcctcgttccggcctctaggtaagtgttcgaccgttatgccggtgaagcacttttccatggaccgaacggcctccaaatacctcttcattccttcttcttttgcctcgaaggatttgtcaacatggcctgccaccagcttggagtcggttcggattagcaagcgccggactcccagtgctttcgcctttcttaggcccagaagaacggcttcgtatcctgctgcgttgttggttgtgtcgaactgcagccttgcagcataccgaattggcacaccattcggcgaaatgagtactgccgcaatgcctacccccttgtgcgaccacgaaccgttggagcacatcacccagaattgttcgacaggcttgggctcgggggtgaatactggtgtccattcagctacgcagtcagctagcacttgagacttgacagcagtgcgtgcaacaaaacgcaaatcgaacggggatagctctgccgcccacttgctgagccggccagtaacttccttgtctcggagtatttcgcccaaggggtactatgatggcactatgactttgtgggcttggaagtagtgcttaagcttgcgcgaagccatcaccagggcgtaagcgagcttttccatttcaatgtatcttgtctttgctccttgcaatgcttcggagaccaaatagaccggtttctggccgaactctgtttcttggacgaggacagcactaactgccaccggcgaagctgctaagtatagtagcagtttgcttctcggtgctgggcttatcagagctgacgggctttgcaggtattgctttagctcgtcgaacgctgcttggcattctggtgtccaattgaactttcccgagccccggagggtcttgaagaagggcaaacctctttcggctgcctttgagaggaatcgactaagtgccacaattcggcccgcgagcttttgtacctcatgtacactcgacggaggcttcatttgctgaatggcgtcgattttcttgggattcgcctcgatgcctttttcagaaacaaggaagcccaacagcttgcctgcgcgaacgccgaaaacgcacttctcaggattcagttttatgcctgctgcgcgtaagttgtcaaaggtctcctgtaggttggacacatggtcgaaagccttgcggctttttacgacgatgtcgtcgacataagcttccacgtttcgccccaactgcttgcaaaggaccttgtacaccagcctggcgaaggttgctccggtattcctcaggccgaaaggcatcctgaggtgacaaaatgtgccgaatggagtgatgaaggctgttttggggatgtcgggcgggttcatgtggatctggtgatagccggaatatgcatccaggaaactcatgagttcgcagccagctgttgaatccacgagctgatcgatccgtggcaaggggaaatcgtctttcggacatgctttgttcaggtctgtgaaatcgacacacatgcgttttttgctggttgacttccgcaccagcactggattcgccagccactccggatggtcaatctcttgaatgaccccggccctgagtagtttttggacttcggctttcaccgcctcttggcgatcggcggacatcttgcgcaacttctgttttcttggcttggcatctagcttgactgccaggtgatgcatgatgagatctgtccaaacacctcccacttcgtcggggctccaggcgaagatatcaatgttctttttgagcacctctaggatgctcccagcttcttcttcacccatgtcgtcccctagtgatacgagctttgtggggttggcatcatcaatctgtacctttattatcttgctgtgaggggtgggctttggcgcgtgcttcggtcggtcatacggttcggcctcaacattgtgcacttctctgttgattatggccagatcgccttttgaagcggccgaaggctgaagccccttgaccactatcactcctgtcaggccgggcatcttgagcttgagataattgtggtgggaaatggcttcgaacttgttcagggttgcacggccaaagatggcgttgtagttgtacgggatgtcgacgacgtcgaacagtacttgctcttcacgtctgttctcccccgagccaaaagctatcagcaaaagtgcttggccaaggacttgaactgcctctccgccaaaaccgcgaagcgatgctggtgctggggtaagggcttgggtgggcaaccccatcttggcatatgcttcagcgaagataacatcggccgaactccctctgccgaccaggattcgtcggacttcgaagccagctctctcggctgagatcacaagaggatcttgatgcgggaacataactccttcggcgtcttccgacccaaaagaaattagctggttcagatactgcggcgtccctttacccgccgaagtgatgttgtggaccgttcggatccgcatcttcttctgccgtttggacaactggcttggcgggtcagcccttgtaatcacttggattacccttcgctgtgcatcttggcgttgttcggctgggggtgctttctcctgaactgcttcacgaggtgcttcgacagttgctccctgctacggccttggatcttgcatgttgccgcgttgcctaatgtttcggcattgctccgtggtgtgcgaagagcgtccgtggaaggcgtagtagaggtctttttggaccttcttgcggaccggctgctgatggttgcttgcttgctgggcgtcgaactccttgcggagggcttgcacttcttcaacagccatcacagccttgcctgcatggtcggttctgaacttcctccaggtcatgagggcttggccttgccttggcggctgtccttgaatcgccggctaaggctagcgaacagcgaggggaggtggttcggcaacttgaacttgtgcttgagcttgagcagtggcgacggaagctttatcgtactcagcttgtatagcttgccgtcgcttggaatcctcctcgccccttgcgaaaccgcaatgatgcgaagtaggtgctcaagtgtctgtggctccttggtggcgatttttcttgtgagttcgccctcgagcagaccagccgaagcggcatttatgaccgatgcctcggttatgtcttgaacttggcaccgggcttgcgagaagcgacgcatgtactcccttatcgactcccccggcctctagcaaatgccaagtagatgttgctacgtcttcggctcctcataggtgcctcgaaagttaaggacaaagacatcgcgcaattgctcccatgagtaaatgctattggctggcaaattgaaataccaagaacgggtgatgccgtctagagcgagatgtattacctttgccttggtattttcgtcgccatgagccgcttcaatcgcggactcgtagatggagaggaatttcttcgggtcagtttcgcctgagtagcgtgggacgggtgggaatttgaactgggctggaattggacgagtcttgattcctccactcagcggtagccccttttcgccccccgccctatttacggcaccttgctgtgggtacggcgtggcgaagggcgaaatcacggcttgtgcatggggttgggccatggatgggtcgaaagttggctgttaccatctcatggaggcttggattggtgcttggtttgctccgaagcctggagtttgtgcttgctaccgaacggttggcgcctgagcagcattgatgaagtcgaactgcggtccttgactccatggcgaagcccccagacctggctgatttgacggcaaccaactaggcgcaccttgacttgtattcccctccgggcgagccaatggggttgtacttgaaatgttgtggggttggttgagctgctgaaggaaagcttggagctgcgactgcagagccgaagccccttctgccattgtttgtggcacttggccaggtggctgatggtgcacttgggcagcgaccggctgagcttgcacttgcatgtgaggggccggatccgctgctgcgggcgatggctacccggcgaagtacattggcgcttgcgcgacttgtggcggaaggtgctaggtcggcacttgcggatggacttggagtgggacatatcctgtcgaatactggaggattggggcccacgtgagcttggttcgccttgccgcctcgtatgcttgttgttgttcttgcatttggcaaagcatgtcttggagccgtgccatgttctgccgcatggcttccatgtcggcttcggtttgtgcttcggggtcagggttgacttggacctgcccagcagcgagcggagctgaggccgctgccagctgcgatggggcggcttggggcaccagcagttggcttgtcgaaaggatctccgccctggtctggagtgcccttgccgccgcagccgccttcgccacgttggccacgttcgacacctgcacagaggcggcaagggccgaaggcagtagtgatggcgcagatgcggaagcagatggcgctcctccatcttcggccacgggcgccgaaggctctgcttcctcttcggcagccatgtccactccggcgtcgctttcctttcgccttgtaaccttctccttcacgaccttcttctgtggcattcgctctcagatgtttcgctcggaggtccccacggtcggcgccagctgttgtcgaaacgacaaccacataagtcggaagacgtggttactcaacagtggttggaaagaaacgaagtgtgttaattttagaattttttactccggatccccccattacatggccccaggggactatttatagccccattacaggttcttactactagggtttaggttatacaggggaatttacatggttgcccttacgaaagggacatttacagacaagaagcagaggaatgcacattaacagatggcgaactccgcttttctcggtgatggcgatcgtgatggcgattagccatgatgcctccctcgccgccgagtgggtgggatttccaccctggtaatgagatcagggatcagtgtcgtcgtctccatggtactccggtgcactcttcttctttctattgctttcatcctttcaaattggtggtggacgtcccccgttccacttttcgtcttgaggagtcctctgttgccattgctcttagagcttgtttgggaggttcccctgctggattttttgtttcgcatctcaatgatcggtgttacaatttctgtgttcgtgacaaatctgttggtttgtggatttacaacctccgatcatatatttgccgtgattatcacatgaggtttttcttatggcgtgatggtggtcctaattggaggtttgagtttcgtcggtgggaatctgagcagctcagtgagtggtctgttgttaagagaaagaaatctatgtctgttaaatcaaagtctgttactgttgcttcatcctccattccaatctctaaggtttttaaccgcttccatgttcatgattcctctcgttcatgttccaaatttctgattgcaagctcatcagatccgaactctcagaatccaatctctgggcctaaagtttcgaaggttgttgataaaccctctgatccgattcctaagcctactcccagtgctgggcctaaacccttgggtagtggtccattcaaacggttttcccctagggttcgaaaagtctgggttaaaaaatcggttgtcaagcctaagtccccccgtcttccactctctgctgctgcggaaaaccccttttctcgagaaagctctccgtcttcaatggcgaaccttcatccaaatcctctccgattcatccctcccggactgcatttgcacccagctgggcctcatcgacgccggcgagtggactcagttaacttcactccctcaatcatgagtcatgagcagtacgtcttggctctggtccttcctccgttgcctgaagatcaatcggatgagcatcgtgctgagattagggagtttcttgatcaggtcaggaatattcgtgtgcttgcttccttcccgcatccgaatgctgtcgctttattccagattagttcacctgttcatcgggatgctttagttcttggtgagcccattgcttatgatgcggttcatgaggtctgttttgttagacataatcagggtccgaattggcgtaatgctccctataatcatagaggttgggtcatgttgcttgatttcccgctggactatgttactttgcataatgtgaaacaagtcatttcaacctttggtgagctggactggtggtatgattctgatactctcaagggtagggttttggcaagagtatggtataaagatttagactctgtgccacagtatgttgtttgggagcaaccaaatgctccaaacggccagtcatggactatctatgtttataccctaaatggtgagtttgctgatgctttccctcttgatgatgatctgccgatgggtgaaggtcctgtgtatcctaatgttaattttgaggatgttccagcttggcaatttggtaatgtgcagaattttgatcaggaagagaatcagggttgggataattgggatgagggtcaggacaatgtgaatgacaatgttgattttttgcctgagattccacagcctactgatgtgctacaaattaattcctcctttgctagttctattttagctgtcaattcaggtaactctggttctattatcagtatttctagtagtgaagcaagtgagattggggctgacaatagcttgatggtccaggaagtttcctgttgatgctaatgttttaaagaatttatgccagaggtttcctcagattatgtttgataagaattttgtcaaggatgcatccttttggtctgccttaaactctggaagtgttcttggtacttctagctgggcttcagggaatgatgttcctgttgtttctggggctaatgaaattcttgatcctgttccacttgctgttgcgccgcctcctagtgtttttttagccctcactgattctgacgccccagttaaaccagcaaaaaggacttacaagaagagagcagttggatctgccactcctgttgttgctacaggattaagaagcagcaaaagactccttgctatttttgatgcacgcaaattgagttttaaggatgatattcttgttgagcctgatcctaatcaaggaattgggaaacctaggggcaagtctgtaaaaaagctcaagcaggttgctcatgaggtgggccttcttttctcaggaagttctctgcaagaatctgacttcatggaaggtacagctgaagtggaaggtcctgctgattgccctattcctctcctccagaaaatggccactgatctttgtggtgttgctcctcaggatgtgacacaggaaagcctcctggcttctgctccaaagtctgttgatgatgaatcttgagtttctaagtctggttctgtttaggtttcctaggaataaatctagaactttgtcttgttctatgttccttagccctagtggctttgtttatcttcagttatgttccttcgtgtcctatgtttcctctccagactattgctctgtagtctgttctagcttgccccctttattttttgcttggaccagtcagctcttggctttggaatgtaatttaattatgttctatttaccttgttccttatctactttctatgagtaatcttacaagaaattggaatattctgtgttggaatgtgagaggtgtaaattcagcggataaatgcagagctgtcaggcaagctgttgatgatagtagttgctcagttttttgtttacaggaaaccaagaaggaaagttttgatactgcttatgttaagaagttagctccgaaacgctttgattctttctctttctctccttccgttggagcttctggaggtatcttggtctgttgggttgttgcaatctttgctgctaatgttatttgtatcacccggtctgctgtgattgtaaagttctttccaaaacactctgctgagtcctggactcttgtttcagtctatggcccgtgtgttgatcctgatagatccctctttgcccagtggttgtttgatttgcaaattcctgacaatgaaaattggatcctcttgggtgactttaacttttacagatctgttgagaacaaaaatagggcaggttgggatatgaatgacatgatgattttcaataatataatcagtaatcttggtctccttgagttgcctttgaaaggtaggtcttacacgtggagtaatatgcagaattcacctctcttggagcaacttgactggttctttacgactgtttcttggactgcttcctatccaagcaccttggtaaagcctttggctagatctatttctgatcatgtcccatgtgtggtccaaatagaaacttcaatcccaaagtctaatctcattaggtttgagaatttctggatagagcatgagggtttctttcagttgatttcttcaatctggtctaatcatgggactggtttggatgctgctaagaatataacatcaaaatttaaatctcttagaaaaggtctcaaaaaatggagtaaaggcttgtccaagttgtcctcactcatagcaaactgtaatctggtcatagcctttattgataatcttgaggagataagagatttgaccttggctgaatggaatctcagattcattgttaaaaggaaagttttgcagtacctgagatataagcaaatgtactggcagaaaagatgcactataaggtgggcaacttttggtggtgagaatactaaattttttcatgcagcggctactgagaggtacagaaagaacttaataactcacttgcagacagatgatggaagagttttaacccagcacaatgaaaaggcgcagataatttttcaaacttttcagcagagaatgggagtgtctttgctacctgttatgcactttgacctgtagagtttggtttctcacaatgatagtcttacccacttgtctgaaaacttctccatctctgaaattgatgaggttgttaaaagaatgcctactgatagagcacccggtccagatggttttaatggatgctttattaaaagttgttgacctattattaggcaggatttttacaccctttgtgctcagttttgtgaaggtaacttggctttggaaagtttaaatagatctttcattactcttgttcccaagaaatcaacacctgagagggttaatgactacggaccgatttctctccaaagtgtggctctcaagcttttaacaaaggttcttgctgataggcttcagtctgtaattacagaactcatccatcaaaaccaatatggtttcatcaaaggcaggacaatacaggattgtctctcttggtcttttgagtacttacaccagtgccaacaatcaaaaagggagatagtgctgttgaagttggactttgagaaagcttttgatactatagagcactctactattttggacatcatgagacaaaaaggttttgattcaaagtggttgaattggattgatttgatcttttcttcagcatcttcttcagttcttctaaatggggttcctggaaggaatttttattgcaaaaggggtgtaaggcaaggggatccattatcacctcttttatttgtgctagatgctgatttactgcagtctgttgtcaaca

SEQ ID NO: 59771 - DNA, 8284 bp, Oryza sativa
  unsure (1)..(8284): unsure at all n locations
caatcacagctcacatgcaccaatgggctagcaagctcttcatgaacacatgcatgtcttgcccctgtgcatggcatccggccatgtgcacgcatgcacaacataagcaccactgtccatgcttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttacacttccagtacttgtcaatttcccatcacaaaagaactataaccacacatggtttcacacgaagctacggtggctcctagcgttcaagggagaggatacaacactaagcatacactaccccgtctcagggctatcaagctcgtgcccaagtgtcgcccggtgccggagagcagcacgagcctctccaaccttgccctccaggaaccagccaagcttcccagacttgcaagtgcgacgaccacaagcaccatcaaacgcgatgcgctctattgcgttgaatactatggaggagcacaatggcggaacacgggaacagtacggtgagctcctacttcctcgaagtcgtcgctctgcccgattgtcaccttgccaacttcatctcggccatcgtttttccgttcatggctgcatcgattggctactctctcacgctaccgtcgggcccagtcttttggagcgcgtgtgtagctcagcgactaaatagtcatcggcttatgttctttctcttcatttatcccctccagctcactattcgagcctacatggaatcactatcaccagcgttcacctgaagcttgcttggtcatctctcccagacccatctattttctggtgcaggggtgggcggtggcacgctccggtgtcacccgttgccgctgggagtggatacctatcaatttttgatactgtgccatttccctccaccaatgttgcttcagcttcatgctgccggaagtagcaaagccattgctggggctgatatttcgggatttggtccctatgcagtttttagcgtgactacaactcaaatagtcacactatggttgttgatattacattcaaggattcttggagcactgttcaacagaaaaaaaaaacacggtatagctgatacaacaatggtattgtagctctcgatatatagacccttcatctgaaaaataaattgatatgatatgatgccgttactaacttgcggttctagttaggactgcatgttatctcaatccaattgtgaggtgtggcgtttaccagatccagcaaaggtaacgcctttccagtttcctcagcttgtttattgattgctgttcacttgatccggtcgataaagtgtctgctttacgcaatgccatgctacttttttttttccacgctgttagtcaatcaggcgttttttggtggtctacgcggtagtgttcgttgtctgttgtctgtagattctagtaaatccaaacagaaaagacaatcccctgcaatgcaaactaaaccaaagcttgaactgaacggtgtggttagattgttcgtcggcaagctagtgagcgcagctctacaccaatcgaatcgtgaaaatgattattcagaaacaaagattcatattgccgaactctagtaccgagtaccgacaaccagcatcaatatcacctctcctcctccttccataacgggtggtgttggtgtgccctgcacgtgaagagccgaacaagcttacacgcgagagaaccgctaatccgtggaaagggaagccaagaaaaacctaagaaaagaacgctcacatgcgcgccgggacggggcctacccccggcgggcggcgtgcaccgccatgtgaccgcgccatcggctggcccgcgtgtagcgtgctcccccccgcaagcaaaaaagccgcgcggcatccgattctgcacgttgctgtgctgcgatcgctcgtccgttgatggaatcagctaccatgaacgcacagatcacacagacgctaaacgccaatggcgcgcgggccacaccctggacagagcacggcgcgcagacttttgtgtggatttggaccatatgcagacacgtacatgcccagtctacatgaacagagggacccgttcttcgctacccgtagatggtttacaggccggcgtacgtgtctagctgcttatcttttctacggccattttgccgaatttgcaatggcagctgcttggctgttcgagaggtataattcctgaaagcggaaaagtactaatcctatttccactaccaaagtgcacggctaattgaacatcccatgtgacgcgagtttgggcgtttgacaagctaagctatagctagcaaaggcgcgtgcttccgttccgatcaaaagctgtcctggagcacaaacacgccatgatgggttttgccgtttcctgtgcaaccaaagctcccccaatgcacctcgtcggtggtccaaaaacactgatatgccgcggcagtgcgggcaccgtccacggccaaacacactaatccaacgccaaactccactatcaccggcgcgaggagaggcggagcgcatcggtgaaacagagcccacgaatgcgggaaacacacaccgggaaaaaaaagaaaggtggaggcgagacgcgcgcgagaccgacacacattctccgccgcgacgaccggcgcttcagcacgtgaacgcgcgctgcggttgctgtcaccttgagaaattgacaaaattttccacttcgattaatcaccaccgtagtagtagcagactagcagtacaaaaaaaaattattacagattgcgaccccgtaggtagtagaaacagagtgacactggctatgacacgtgtatactggtagtactcactattactagtaactgcacgcagcggccaaccactggatgcgtcgtcaccgttgcacaacgctggccgtagctgtaataacacggtaacagtaggcaggctgcagttaatgaaacgagacgcgagcgatggatgggatcgagcacggtcccggcccctctccgtcctgccggtttgtggcggaggaaccaattaacgtactcgtggccgtagcgatggacgatggaatctcgccgtactactccaaagaaaggtaaaaaagaaaaatgtaatcacctcatcaatcctcactagtggctaattactcactgtaatagtacggtagaattcgagttactgcgtgcgtgcgtgcgtgctagttgcggttgatgaaggcgacgagcgtggccatctcggcttgcgcctgcggcgtgctgagcttggtgaggaagtagacgtggccctcgccgggggtctcgtagagctcggcctgctcccggccagccgctgcttctgtagtcgtggcgtagtaggcgcgctgccatgggctcaagcgggcctgctccgacacggtgaccagcacgccggagcaaccgaagcgctgccacgacgacgccgggagcgcgagcgggttcgcgtacgggtggtcgatcgggtacttgccggcgcagatgaagctccaggtgcgcgccgccgactggaggtaggccgggtccatggcgtcggcgcccatcggactccgaccctggaagtacgggtcgagcagcgccacgcccttgatcctggccccgccgtcgaggccctcctcgccggcgcgcaatgcgaggttgtgcgcgatgtttccgccggcgctgtcaccggcgaggaagaggcgggacaggtcgccgtactgggagacccactggtccgtcccgggcgccgcgttcgccagcacccacttgagcgccgcccacgagtcgtcgtacgctgccgggagcgggtgctccggcgcgaggcggtagttcaccgacacggccaggacgcccgccttggccgcgagcgtgttgaggtaggcgtggtagatgggcgtgaacgccgactccgacgacgaacgcgccgccgtggaagtaaagcagaaccgggaccttggcggtggcgcggaagctggggaggtagagccgcgcgcggacatcgttggccggatcaatggcgacgtccctggacgacacgccggtgagcacgtncgtcgacgccgncaccacgtcggtgcccatgagccgcttcaccctgccgctcttgtactcgatcaagaacggggagaagtcgaacttgaccgggtccccacccaacggcggcacgcgcattccccgcctcgccgccggcgccccgctgccgccacgcgagcagaggaggaagaggaggatggggagcaagatccgcgaggccatcggggggaggagacacgcactgctgcgctgcagctggagagtggcagtggcagagtgtggagtgtgagagagtgaactggctcggctctccgctgcctgcgagtgtctcggagacgacgctgccacgggatgggtcgggttttatgtggagcggggcagccgacaaggctgggcgcaccgcaccattttccgggcgcggatcgtggtgggctttcgaccgctttaacggcgcggcccgggccttctctttcccgcgcgcgcgccaccgtgcatgcaccgcatgtgcctgcgtgcccgcgcggttcacacttcacactcgatcgcttcgcccccaaaaaagttcagagaccatctctgaaatggcgcgttttctgcacttaatttacacccgaaattcctctctttttgacgaactgtacagcagcgctttatttcatggttagtactactgttaatgctaaactatgcctggttgtcagaacctctgctgatcgatgagtttaaaagattcaggtttttctgaaactgtcagttcacacgtcttttactaatcgtttcggcgctgcaatgctacggtacaaacctacaacgacaagccgaccctgagccgctcgttgcttgaggcccatcgaccattcaatgcccttcgtacaattaggcaattagcacgctcgctttgtgttggttgtgtgcccgtcttcctactccacacaccggcgcttcgcctagatggtctcgcatggtaggactaggagagtatagggtgcccccatatcggcctgtctcagttgagtggggcggcacgtaccaattactgctcaattagtggcctgaattgaaagattcagcaccgtcacccaagagcacgtccctaactttgtcgcaaaagcaaggaactcgcagtgatgcccggagcttgcacaacctgtactcgtgaaagtttagggctcctttgaatcacacgaatgaaaaaacagagaaataggaaaaatataggattctaacaggaatgcaagtgtaaaacagaggattgcaaaacacaggaaaaacataggaatgactgtttgattgggccgcagaaaaaacacagaaattcgaggagagataaagattcaaagaattctttccatgaggttctacctcatgttaaactttctccaaaacttgcatgggaaaagacaattcatagaaattttataggattctatagaatccattccttaattcaaagggctatctctaaaatttctatgaatatcctttgaatcaaattggggggggggggggggttcagtagttgtgtgttctggcagtttcactgctgacaaactgtttgccactactccagctctctcccctttttgatcgtgcggtttatgcagcaatcaccattaccgatcccaaagatctcggttgatgataggctttcggtgccgaggatgatcatttgcctatttggtgcttcctttgtcatcgggttatactgccggcaggatctattaataaaccttaggtagcgccttctgtgccatcgatgctgtgctgtggcgccaccaaacccaataattccgaactgaaaccaacctgacatgacatgagtaatacagcagcaacatcgtgcagacacgtagtgatgcgatctgctgaaatggaaaaggagctcctatcatatgtacagtgctaccgcgttatgtgatcttgggaacgtactgattccgagcatggccgaatcaataaaccaatctgatgcactggttcattttattggttcgatctgtggtgatcatcatgtgggggcaatgctacaaggtgtgagctttactcctactatttcccggctgtaggttgcgttgctctcggtgtaaaactagctcccatctactaacagtccatcttgtactaaattccgagctgccgagctgtgcccgttcttaaataggatgacaatgatctttgacagcgatttcgagtcatcattctgaagatttggagctgctgaaatgacgagccgaaaaaaccgtttctctgctctttccgaagagaattttcctcacctgtgaatggagcagtcttgtaatggatctgaatgtgcatcagcctcactatcgtatcctgctgtacttcaaggtttggcggaaccgatgtgtcggatcgaccctgcacgggttctatcaccacgaagctgacctctcgacttttctttgcctgaaaagctgaaactgttttgcgatccataacgctaacatgatcactcatggtcccggatcactgcatgtaactatgtaagtatacacatgcatgtgtgcgtgttctaggtcgccggagctcggaaggaatgcgccatgaatgatgttgagcagatcggcgcactctgcatggtttgcctggcgaatgctgagcaaacgtgagcctgcttctgctccgtgccgttgtactcctatgcgatgtccattccgccctacgctgaattttcacagaatcactgtgctcctggtgagctcaggcttgtcagtgaaactgtaccggtcgtagcccaaaggacatgccaaacaatctgcaggagtagtaattatggggtgtttagattcaggtgtaaagttttagtgtattacatcgggtattatatagggtgtcgcatgtgatgttcggacattaataaaagaactaattacaacatatgtcagtaaaccacgagacgaatttattaagcctaataaatccgccattagtacatgtttactgtagcacaatattgtcaaatcatagagcaattaggcttaaaacgttcatctcgcaaaatagtcacaatctgtacaattagttattttttagtctatatttaatacttcatacagatgttcaaacgtttgatgtgatatggtgtaaaattttaggatgaaatcaaaacagaccctcaaccatagtaccatactccctccgtccaaaaaaaaagtgaatctaggactagatatgatatattctaatataacgaatctgaacatacatctatctagattcgttgtactaggatgtgtcatatccggtgctagttggtatttatgggacggtgggattacacagctggtgaattgcactgcacatgactcagatggtgtttggaaaggagggactaaagtttagttcctctcacaaaaattttagtccctaccataaggacttgtacttttgtgcgagggactaaatttagtccctagttcccaaaaaccacctcaagtatgggcgtatggcgtcctgaacagaactgtttattactcccctccatcatcgacagtaacaaactgtactacttctagactctagagttgcatggagtgccacacagcggtgctgaactgctgcctggtcactgccatatcctgcatccaattcgcctgtcagagcatcagtctgttgcgaagctgtactgaacttccgtgcacgctggtttaaaaaaaaaaaaacttccgtgcacgcacaggttcggagcgcacttggcatgtcacatggtggcaactttgcttcgctagcttaagcaccgcattcacgaaccacgatctccatccagatgaatgaatttcgacgaaacggtgccccgttgcactgttctttacagaatgttgatgggggtgtgcgtgtgtgtgtgagagaaaaagagaattgatttccagtctgtttgtacctcgtgaaagttcagttcggagtcctttccagctaatatgttctcgcgaacctctttttttgcgagcaatgcgagcaaatgcatttgttgagcacaggcgtgactcccgtaactgtgatgagcgatgcatgactgtgctc

SEQ ID NO: 59772 - DNA, 1129 bp, Oryza sativa
cactcaggacactgtaggacgatggcagtagattgcgtttgaaacacgcagacttgggcgaaaaatgtttccgtgaatactactggtactgggaggctgggagcatcgctaactgtaccaaacgtgcgcaccaaccaacctaaaaccgatcggacgacacgcgcgcaccacacagtaccaccacgcccatgtgcggcgttcaatgcggtccggaaggcggaggccgacgaagaccgagacatcagcggcggagcggcgtcgtcttgtacgtggctgcatctgcgtgtacgtggccgcgcgcacgcacgagtccccagcgcgtgattgttggcgacctccgctcccggttcccggccgcgcgaagcgaacgcacgagccaaagtagtaggagtaaactggagtagtagtagcagatgccgcaaaacacggtggaaaccgtggaatcacgcggcaatcatcgcgaaaactgtggcagtgaccacaccccgcaatgataacgtaacgccgaccaccgctccgcgaggttaacgccggaaaatcacgcgcatcaatggatgcgcgactcgcctcttttcccctgcaaccggggctgctccggcggttgggaacggcgagtgattcgatcgagctcctttccggcgatgattagatcggctttatttcctgcatggttgttgcatggccaggaggagcccacgatgtacagggcaccaactctgggcccacaccattttgtgtcccgtgccctccgggaagagagagaggaccaaaggaggagaggcatccacaccaccgagctcgtcggaaagagagaaagaggactggaccggcgccggcgatggcaatgcagccacctcggaggaagactgggccggcaccgacgatgacgacgcagccactgcggataaggatcggaaggggtgaagaagaggggagggggagaggggagctcgaggtcgatccgcgccgtcgcttgggccacaccgctgccaccgtcgttgggggtggaggagagggcgccgccgctactccgctcgacagccgccgtagcgaggaggaggagaggagtggtggtcgccgcggagcttgtccgcgcgttggccaggaggggcgcccgtcaaaggaggag

SEQ ID NO: 59773 - DNA, 10939 bp, Oryza sativa
ccaccgtcctggtgttagtcaattaaaatataccatctagtgggctgtgggtgcatggttgtgatggtcgcgcccatggcacttgaggaccggttcgcgggaaaccctagaacaattcctcgtacttaccacaagctagcgtgggcaacggctgggcttgtagtgtagctttcctctagttgacgcatccaggcaagggtgggcgtgatggtgcggggcgggccctgcgacagcctctgtcgctttcggattcaccgaggcacgagaggggactgtccgttgcccgctagggacgggggtgaaacctgaggtgtggtgtgcttggctagagggggttatgtgaagggtcctgtcacggcctctttccggtatgtcgtggtggcatgtcggcgcacggaaacgtgtcgtgggattgtgtcttgtgggtatagttgtacacctctgattagagtaaaataaataccctttgccgcggattgatgatctgtttgatcagctgaaaggagctagggtgttttccaaaatagatctgcgatcaggctaccaccagttgaggattcgggtagaggatattcccaagacaaccttcaccactcggtatgggttgtatgagtgcacggttatgtcttttggacttaccaacgcacctgcattcttcatgaacctgatgaacaaagtgttcatggaatttctggataagtttgttgtggtattcattaacgatatacttatctattcaaagtctgaagaagaacatgagcaacatctccgtctggtacttgagaagttgaaggagcaccagttatatgccaagttcagtaagtgcgacttctggttgtcggaagtcaaatttctgggtcacgtcattactgctcaaggcatggtagtggatccatcgaatgtggagtcagttaccaagtggaccccacctaagacagtgtcacagattcggagtttccttgaacttgcgggttattaccgtcggttcattgaaaatttcttcaggattgccagacctatgactcagttgcttaagaaagacgagaaattcaagtggacagctgagtgtgacaagagttttgaggagctcaagtagaaattaatatctgctccagttctgattctgcccgatcagacgaaagacttccaagtctattgcgacgcgtcctgtcacgggcttggatgtgttttaatgcaagagggtagagtggtcgcttatgcctcgcggcagttgcgtccacatgaagaaaactatccaacacatgacctggaattggcatcggtggttcacgccttgaaaatctagaggcattacctgattggcaaccgctgtgaagtgtatacggatcacaagagtttgaaatatatcttcacccaacctgacctgaatctccgacagcgaagatggttggagttaatcaaagattatgacatgagcattcactaccatccgggcaaagccaatgtggtggcagatgcattaagcaagaagagctattgcaatgctttgtgcaccgaacgcatgtgtaaggaattgcagcaggagcttgaacatctcaacttgggaatcgtagaacacgggttcgtggctgctctagaggcacggcctacgctcgtggatcaagtcagagcagctcaaataaatgatcctgagatagctgaactgaaaaagaatatgagggtcgaaaaagcccaggatttccttgaggatgaacatggcacaatctggatgggagaaagattctgcgtacctgctgacaaagagctgaaagatctgatactcaccaaggctcatcagactcagtactccattcatccaggcagtaccaagatgtaccaagatctcaaagaaaaattttggtgggccagcatgagaagggaaatagttgaattcgtcgcactctgcgatgtttgtgagcgagtcaaaacagaacaccagaggcccgcaggattgttaaacctctccagatgccggaatggaagtgggaagagattggaatggatttcataacaggtctgcccaggacatcatctggccacgattcaatctgggtagtcgtggatcgactcactaaagttgcccatttcatcccagtgcataccacgtatacgggaaagaaattggcagagctgtacttagcaaggatcatgtgtctgcatggggtacccaagaagattgtatctgatcgagggagtcagttcacctcaaaatattggcagaaactgcaggaagaattggggacccgtttgaatttcagcacagcctaccacccgcagactgatggccagaccgagagggtcaatcagatcttggaggatatgttgcgagcctatgcgcttgattttggcagagcttgggataaaagtctgccttatgctgaattctcttaccacaacagctatcaggccagtctacaaatggcaccgttcgaagcgttgtatggccagaagtgccgcacacctctcttctgggatcaaacaggtgaacgtcaattgttcggaacagaagtgctaacagaagcagaggagaaagtcagaaccgtcagagaggctaagaattgcacaacctcgacaaaagagctacgcaaacaaccgccgaagagagctcacttttgaagcaggggattatgtgtacctccgtgtcactccgctccggggagtacaccatttacagacgaaaggcaagttggcactacgcttcgtgggaccatacaaaatcttggaacgacgaggaaaagttgcctatcagctagaacttccatccaacatgatcggcatccatgacgtgttccatgtgtcccagttaaagaaatgcttgagggtacccgaagaacaagccgattcggagcacattgacatccaagaagatctgacttatgtggagaagccagttcgcatcattgagaccagtgaaaggtggactagaaacaaggtcaccaggttctgcagggttcagtggagccaccactcagaggaagaagcaacctgggaaagggaagatgagttgaaggccgcccatccgcacctcttcgccagctcttccgaatctcggggtcgagatttcgtttatgggcggtaggtttgtcacaccctgaagttctttccccaagcctaaattggatttataaatcaccgagagaaaatatcggtgtaaaagcaagagagaaaccctaataaattaatgcaaataataatcggaattggcatgtggaatttttcttgagttctacatgttgaaatatgctaacaagatttttggaggaattttcagagctctagaaaaaattttaaccaattaaaaacgagcacaagcaatatttaatccctggaaattcatttcccttttcttttttcctttttccctcctttttcccaatgggccgctatcacgtcctaataaattcatcccaaaataaaaatcattctctaaaaggagtaatagaattaattaaaattcgaaaagaaattggcaagcactaaaatacgtataagaaaaatttgaatgtggtccggagaatttttgttaaattctccttggtctaaaaggagccctcaaattttacttgaattttcagagcaacggaattatttattaagcaacaacaacctttatcaaagtttattaaaaagaaaactaaaaataaatcctccttcctcctttgggccaagtctggcccaaagcttccctctctctctcggcccacggccaaagtccttccctcctccctctctttttccttccctctctctctcttgggccgccctccctctttcccctcggcccagctccctcctcctccctctccctcccgagctgcctctccctcctcacctcctgggccgcctccaggcccaagccgagcggcgccctctcgcccgtgctgcgcacgtgcgtgcgctgacgacacacgccccgcgtgggtcccacccccggttgtctccttcctcccgcacggcctcttctctctcccgtgcaaaccctagttcgttcctccctcgaatccgcgcgatttaagcgttggattccaaaattaattagggggttttaatccccattccttcctcttcaattgcctctaattttctccttgaatagcgccttcaatcgccgggaacggacgcgccaaccccggccaccttccatggccgccggccggcttttccgccgccgttccccgctcctcccgtggccggctccttccctttgcctataaaatggaatccccatcctccgatctatcgttttagccccctcccgcgttctcccgtggcctcaccacctctccccgcctcctccctctctctcccgtgccgccggccgacctccagccgcccctgccgccgcctcagcacgccggccggccgtgccgtcgccttccccagcgtcgcagctgcctcctcttccccggcgccgcctccgattcatggggaaattgccggagacgcggccccgccggcttcaagtggctttgcctccactgtaccatctccagccatccctgccgcctcgcctgagcgccggccgacgtcgttgccacctctgtcggtgctgctgcgccatcctcttctccggcccggctgtggcgtcgcccgaagttcgccggaacgccgccgccgcgccaactgcctattcctcctcgtcggctcgtcgccccgctgcaccaccaccttcaccaacatcgcagcgttgtgttccacctccgcgcagccgctgctggctgccatcgtcatttcctcgtcaccgttcgtcctcgccgatcgacgtcccatcggtcgcccggctcgtcgtctcgctgcaccgccaccgtcgtcggcatcgcagcggcgtgttccacgtcatccttgcctctgtgcagctgctgccggctgccatcgtcatctcctcgccagccccggtcgtcatcgtcgtctcgttgttcccggtcgtcgtggcgttcgtccctccgtcaagccgttctcatccgtcgtccgcgtccgtcaagtgtgccgctgcaaccccatcgtcgtctttgtcctcgcctccgcgtcatcaagctctgcgccagccacgtcttgccttcgtccaaggatcgccgccgaagtcgccccctcgccgttcgtctccgccattcccgtccatctccgccgcgcccgttcgccgtcgtcgttcccacgcctcgtcgcttggtggtaagggtccgtcctctcgctgccccgtctagtcctttcagtgtcacccgtgcccgttgtgcggctgtcgaccccggtacccgtgtactggtgtcggtagttgttcgcttgtgcgtgtggtgaccgtgttagtgtgcacgctcggtagccacgtggtttccacgtgtgcagcccgcgtggtgtctagtggagtccgtttgtcggccactcgcctcggttggcacacggggtccgcttccatcgacccgtggaccgtctctgtgtactcggtctaccgtggtcccttaggttgacatgtgggatccacatgtcaacggcgcagccttcctgtctttttgtcacgaccggaattgacccaacgggcgttccttacgtgcgtgtattattccttgtcccaggaggcaaggtacaccaaaagttgatacatttcagagtttatcaagcggaagcgtaaatagttaatttattacataggcagcgaaggcccagcacacacaaagacaaacgagaaacaacggaagactagggcgacgaccacaggcgcttgacggcaggcacgagctagacaccaaagccttcatcttccagggactcctcttctgggtttggaaaaattgagcaagactgagtacaaccaccgtactcaacaagacacacccacaagtgcaggataaatgtaaaggagtagaagggggttatgatataaagggttagggtttgcagtaaacagcattaaaagacacttagttgctcaaagctattttgtaaacacgtttctagagctatacaatattattaatcaaggcggtgaacccacacgagcctgccttaacccaaggcctctgatgattcagaccgaactggtaacccgaccctgggtaccagctcgtcccaagccaagccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccaccacggtatacggacggaagacgtgacatagtttccaacccatcctagccatagacaagagtaccgacccaaccccacctacggccggaacccccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaatagaggcccgaagaccggtccatatatggccgaggtgctactatcaaaaccatgcaccccgagcccagcctaaaaccattttggggattttgaatagagggggcggtgtgaatccaattccacaataatcaaaccattccatagtgtccaggtgatgagaaaatcccacagtctagagttgtaaaaccacctaatgttgcctaattaaccagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaatgaagcgataatgcaataatttaaatcaaaataattttataaactgggattcaatatgttcaaggatgatgtgacttgccttgctcgctttcccaaacgtcggcttcaacctccacgaagagcggatattccgaagctgcagcgtctacacgaccaacggaaaagaaaatgcttttactctaataaactccacataacaagctgaaacaaaaaacaaaaatgggttcttgacttcttaaggaaaaattagagacttgaacggtccaattccgagttccaatggccaagttatggccatttgaagtttatatgctctttaaatgaatatttgcgaatttcttcatttaaattttaaataaaaaaaggtttattgcgtcagccgaggggaggggcgcgcggaccgggtccacgggagtggggcccacgcggcagccccacggtcgacgatggaccgggcgcacccgggctcacaccggccggcgccgtgggtcccacgcgtcagccgcacccgagggcgtgggcggctgacgtccgggccccacgcggcagccgctcggtgcgcccgaagacggccacgccggcgcagcggcgggaggcggcgcgtgtcacatcctgatttttgtttcaggatttataaattatttaataaattattattagaatttatattaaatgttcattaatttacaagtgaagttaaatgtgggaaataaaatttcctaaatataaagcatggttggatttaatttttattaaattctccatggttaattatactctctggaatattctcggatttttcggagctcaattcctaatttttaatcatacaaagagcatttcagtaattacccacatattaaattaatcattaaatggtctaattgtaatttttttaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagcccagccggaaaagtctacttgtcctccctgcgctactgttcatcttccaactcaggcagagcccgagccagccgtgccgtgcacagtgccgccgcctcttccttccaaatctcgcctccccgttgctccttttttccaattttgttgaggggaaatattcctcttatcctcctctatctttaccccaaaaatcggagctaatcgttgagtatcttatccgaatcgaactcgttttcgagtttatctccaaaaccgagtttttgattttccggatcgatttcttgcgggaggagtccgatctcttcaatccaaggctataaataggaccccctagtcctcctctttcgtttgccccctctcccgtgatctcccgtgcctcgtagcgccgccgccacgtgctccaccccgccgtcgtcgccggccgagctccatccgcgtcgtgccgccgcctccgtcgtcgccgcgggtcgccgtcaccgccgtaaggtgcgcgggagggtggagaagcccggccgcctgacccccgaagccgctgatcaccggagccccgtcgccgccgtcgaccgaagccgcgccgccgctagacctagtcgccggccgtcttcgttcgtcgtttggttcgagggtgagtaccgttgggttcgtctcgtcgtcctctacgtgtacatgtcctccaaagtcgcagccgaccatccaatctccggcgaggtcgccatcttggtccggccattgatgaggtcatcatgacgtcatcatcgtttttcttttttctgtttttctaatagattaaatcttcggaaattcataactaaatcatcgtaactcggttttgagtggttcaagttgctaaattcatctaaaatcatctacatgtttgtttactttatatgtactgtttatttggtttttattagtctttttcttcgttttgcgtgttagcttgtcgtttccgtcgttgcgaaggttcgtgattgcgccggaagtattcaagaagattaattgaagaccgattattgcaaggcaagtcacacagatcctaaacacaatcctttgagcatgttgatcctatatttaaattctctatttatttcaactgtgtatttattttcgaatgtcaccgggtggtgtgaacttattcctttgttatggccaatttgcattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgatagtggtgggttgtgagcacatggttttgagagtcgtgctcatgacaattaaggaccggttcgcgagctactattgtgaaacattaatcgtgccaaccacaagccagcgtgggcaacggctttacctttcgtatagcatggttcattgcagagcacaagactgagaagtggcggagataagcccacgggggtcgctggggagtccatgcctctggttattgagggggtgattatgatccaggaaaggtgcgctgtagtggattgtgttgtgcaaggggtattgtcacagcccctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttagagttagatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgttgagtatgtcatatgctcaccttgcaataatcaatcaacctcagttgaagaaaaaggatccagaaggagaagacgtttggcttataccccagttgagctgcctgtgggagtggagccggagcttcgctagaccgtaattccgctgcagttttcttttcttttgtaagtatgtaacgctattattgatgattatgtatattaaattgtcagtttgtgtacctcggctgattcctggatgagggttctatgcacaaattagttcggaaattactagtgaatttctgggcgtgccctaggcacggcggagcggcggccgagagaggggagggaaagggggaaacgaagcggcggtccacggctcaccccgggtcgacggcgacgacggaaacggcgaccggagcggaggaaggtggcggcgtggctcgggtggacggggtcgacggtgctccggcggtcggcgaccgaaacggagaggtggacgaggtcggcgaggatgcggcgaagccgaaggaggcggcgccgaggtgggaggtggtccggggcgacgacagcggcggaccggagctcggcggcgacggcggagagagagcgacggcgcgagctcgattccggcggggagagagggcggtgagtggcggaaacagtggtggggagctcggggagggtttatatagggttgggagtaagagagggcggccgaggaggggggaatgggcgcgggagacccggccgccattaatggcgccggcgaggttaggggagagg

SEQ ID NO: 59774 - DNA, 4756 bp, Oryza sativa
atggcccgcggggagaggagagggagggggaaggagatgggccgagccggcctaagagggagagggagggaaaagggactttttagagcttttctttttataaaaccattttaactttgtttatttcttaataattattatttgtgctctgaaaattccactaaaatttatttacgcattttagacttttaggaaatatacaaaaatcctccaagccttatttgacttttaactttgcacattttaattgttggaggctttcacacggattttaattattctaggcataatttagaggatgtattttagagtcgttttgggacgtgacacttttccaggctagcgcttacacatgttttatagttgcaaaacctaactataataatccgcaaatctccatataacagcattaaacttcggatgaccatgtcttggtcatacgagctctgaatcgagccgttcaagtctcttaatgtttgttataacttaaagaaccatgtgctttgttttaatgtgttgttattgcttctttataggcttgtagttttgcttgtgtgcttcgcgtagctttcgtcgttccggaggttcccgaagtgtggttcatggtcgtcgccgaaggttcggaaggccgttctctctgagcaaggcaagtcacatcatccttgagcatattgaatcccagtttataaaattattttgatttaaattaatgcattatcgctttatttgaattcccgcgttaccactgttttatttagcattacctattaatccttgttatagccttattattgcaattgttattatcaccttgcttaccctaggcaaataaaaccccaactagtgggtactcgattaatggttccactagtatgaatttaggtacatgcttcgctgattaattaggcaacattaggtggttttataacttagactttgggaatactcatatcacgtggacactatggaatggttggcttatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtactaaccacatgtctaatgggtaaggcttaactcggtgctcagtctagtcctgaacaaaaggacacggatagagatggatgaagtcgttgcgacgatggatatctctgaggcaaatgaaggctacgcgagctgcggctcggtaatcgagatgtctaggcaaatgaaggctacacgggtcggtgcccattagtcgagatgccatggcactggactagtacacgggtggtctcacccctatgcgtgtggcgcacccagtctagatcctgttgctaggggctcaatcctggcctgcctgtcccgggataccgaccgtaggcagggttgggtcggtgcttttgttcacggctaggatgggtaaaagggttatgtcacgttttttatgatgggttccaattgcaatggaatgcagagtaaaggcgtgtcttgtgggtaaagatgtacacctctgatcagagtataatctattcgaatagccgtgccctcggatatgggcaagcctagcaatgtacccaagttagtggtttaattcttaaaatttgcttaacaactaaaatatggaatggttggcctgggttggcttgggacgagctgggacccaggtcgggttgccagttcggtctgaatcatcgtaggccttgggttaaggcaggttcgtgtgggtccacagccttgattaataatattgtgtagctctaggatcgtgtttacaaaatagctttgggcaactaaatgacttttaaatgctgtttactacaaaacttaacccctatattattaccccttgtacccccttgcattaatcatgcatctgccggtgtggcttgctgagtactgtggttgtactcattcgtgctctatctttccccccttcagtaagaaaagcttgaagaagaagtcctaggtggagtcctggcttatacctcagttgagcgcctgtgaagatgaagccgtaggcccactagtccgctgctgtttatttttgattgtcaggccttaagtgcctttgtaataatgtaaatattatcgatataataaagatgtgccttttgtatcatgtttgtgtggtgtaccccggcttttcctgggacggggattaatacactagcgttcgggaaaagttaattttcccggtcgcgacagccgccagcccattttcctctccctccccgctgggccggctgaaggccacggcccagctggccgcccgagcccccctcctctctcccggggtcgccgataggtagggcccaccagtcgggtcctcccccaaccaccaaccactgccgcgcatcccgcaaccgccgccgccccctcgctcctgtgcctcccgggccacgttgcccacgtcgtcgcccgtgccagcgccgaaacggccgggattcaattttgaatcccaccggccacgcccactcaccccctccccactactccggtgaaatcaggccgctcccggccacgtccgagccccctttgccctatttaagcatccccgctctcccctctctctttttctgcatttcgccgagctctctcgtgccctctatcgccctagcgccgtcaccctcctctccgccgccgctgccaccgctccggtagccgctagccgccgctagctgccgcgccgagccgcaccgtcgccgtcgtcgggttcgcaaacccgagggccacgccgtcctcctctccgccaccgctttccgccacgggaaccccgttcgcaccacgcgccggtgagctccgccttcggccggcgtcctcaccctcttccatcttcctctctctctctctaacccctttcttcgtgttcgctaggtggttccggagctcgtcccgctgccgtcatcgccctcagtcgctcgccgtcgcctatcgccgtcggtgaaccacctcctcccctttctccctctctcccgcaccgcttggccgccacgccgccgcctagccgcttagccgccgctgtcgctgtccacgtcgccgcgtcgccaccgcccaccgccaccggccggtcgccgccttgcaccgccgctgcgtagagccgtgctgccgtgcgccatggccgccgggccggcttgagccacccgtgcgcgccggccacgcgctcccaccgccgtccgatctacccaaccccgccgcacgcgtggctgccacatggccgccacgtgtgcgccgcgtcggcgccacgtgtgcaccacgtggtgcgccgctccttccccggtccgtggacccggtccaccgcggacccccccgagtcactgccatgtggggcccgcatgttggcgctgccctctctctccccgggattttaattattgcgcaataaatcaattaaggatttttctgtttatagtaaaaacacagtgaatcttctaaaattcaattctaattcatccgagctccgtttgagcctattcaagtctcagtaaatcaagaaaaatgcattgaatccattaaaaatggttttgttctctgtttcagtagtcttatagcctgtttgtattatttgctttgtatgtcgcttagattccggctctcccgacgctccgttgtactttgaaatagtcaccgaggttcctccagcagcagagcaaggcaagtcatgcttgtcacttgaacatgttgatcctatattgcaaatgctctaccgttttcccttaaatactgcattgttttataatgatactatgggatgtttacctactgttacagccatgctacttttgtaccatgctcctttgttagcttgggatataacatgactagagattggactagggattgcttagccatgcttagttcaactagcacaccgtgggggaaatcacattaatgcatagtcttcacgttctagtgttggttttggattaaagccaccgtcctggtgttagtcaattaaaatataccatatggtgggctgtgggtgcatggttttgatggtcgcgcccatggcacttaaggaccggttcgcgggaaaccctagaagaattcctcgtacttaccacaagccagcatgggcaacggctgggcttgtagtgtagctttcctctagttgacgcatccaggcaagggtgggcgtgatggagcggggcgggccctacgacggcctctgtcgcttctggattcacctaggacgagaggggactgcccgttgcccgctggggatgggggtgaaacctgaggtgtggtgtgtttggctagagggggttatgtgaagggtcctgtcacggcctctttccggtatgttgtggtggcatgtcggcgcacggaaacgtgtcgtgggactgtgtcttgtgggtatagttgtacacctctgatcagagtaaaactattcgaatagctgtgcccgcagttatgggcggtcaaccagattcaccgtgattagtctcaccctagtctagtctaatggaattgattagttcaggtggatggttgggcctgtcgcagcgtggtgtagcgttggacagtggatggttaatattgagtaattattacaactgttttacagctttcaactaccgtctttaaaatgctcgctttatgctaatgaagcgctcgagctattctttgattataccctacatcataccctctattccggtatgccttgctgagtacggtggttgtacacagtc

SEQ ID NO: 59775 - DNA, 16772 bp, Oryza sativa
cgcgtgggcgcgtaaataggagggagggggggaagagagccatgggggagggttcggagaggcctcgctcctcccgcgccgcgcgtgcgcgaaaccctagctttgaggtggaggtggtggtggaggaggaggaggaggatgaggaggaagcggctgtggctgcggctaggcgtgtcaagagggaggtcgcggatgacctgaacggggagcccgcggaggaggaggatgacgacgaggaggaggtggtggtggaggaggacgaggaggtggttgtcgcctccgacgaggagggcggcgacggggaggcggacggcggcggcgaagtggctgtggccttcgagccgcgcacgctggaggaggccctcgttccgcgcgtgggtgcggtgttcgactctgtggacgaggccttctcgctctacaagacctacgcctaccgcacaggcttccacgcggtgcgccggacctgccacaactacgaggggctccgctaccgctctacctttacctgcactcatggtggcaaggcccgggctgacgccagcccgtctgatggctcaggcgcccgctacccactccgcagcagcaagcgtgcggccaacgcccaggagaagagggctcgtcgcggtgcggctgagaagacaggatgcaaggcgatgttgatcatccgtgacaggcgggcggatgataagtggaaggtggagttcgttgagttggagcataaccatccgtgtacacctgacatggtgaggttcttgaaggcttacagggaaatgcctgactcagctaagaagaaggccaagatttctgatgagatggatgatagggtggagaaatcgctgagcgagattgctgagaccaggaagttcccaactcggcccaagcggagtgttggtggtggagcctctgttggtgggttcaggtttagtagaagcgacagttttgtgcagcggtttggggatgatgaccttattgcactgaagaagtttattgaggcgatgcagcgcaagaagccaaactttatccactactgggatcttgatcaggaaactcatgtgaagaattttttctggactgactcgaggtcccaggcacaataccgttattttggtgacgtcattacacttgacgtgatgtatttacagcattcgcgtgctagccttccattggccacaatccttggggtgaacaaccatggtcaccttgttctgcttggttgtggtctgctttgcagtgacaagaaggaaaactatgtttggctgttgaagaggtggttgggctgtatgaatggcaagccaccagaggcgatcacaaccacctattcagatgccgttgcagaagctgtggctgaggtgttgccaaatgcgaggcaccgtttctgtttttggcatatcttgaaaaaactccaagagaatgtcggacgcacaaatgagaaagaggcaatttccttgagattcaaggaggttgtttatgacacagtcacacttacagactttgagagagagtgggggcccatggttgagcagtacaagctcaaagacaatgactggttctctgctttgtacagctgccggaaacaatgggcacctggttatgtcaaccattcattttgggctggcacttctgctattaggaaggtcgagaaaccagatccatactttgatggcgtggtgacaactaaaactaccctaccagttttccttgagcaatacgagactactctgagagggaagctggaaagggaggcatatgatgatttgcgctcctattactctaggctcacttcgctgtcgggattaccctttgaggaacaactcatggagctctacacagtacctatgttccaagcattccaagacgagatcaaacaattaatacacgtgatttgtaaagaggtagacaggagtggaaattcaattacctacatggctagtgagttgatacagggaaagaaggtcaactatacagttgtctacaacagtgctgacaaggatgtctggtgcatttgtcgctcctttccgtcacgaggcatcctttgcagccatgctctctccgttcttaagcaagagaatgtgttaatgctgccatcaaagtatatcctcaatcgttggagaaaggattttagagtacttcatgcaactgcaagttccagttctatatcatctgatagagatttgagcattttcaatgatctctatgtccgtggccacgagtatttagaagatgtcattgacattggagccagagaacctgagctcaaagagtttgtgttgacagttatgaaggaagcgaaggacaaactagttaggcctgaccatattcatcaagctgatcagcgggttgatgtaaatatgtcagtgactggccaagtgtccgcagatagaggagtagatgtgaacatttcatcaaatagcacatccctgattcagggagacagaagggttgatacaaatgtgacctcaaacaccacagccatggttcatggtcatggggattccatgacatcaaacaccacagctatgattcgtggggatagaagagttgagatgaagatcccaacgccccaccttattcatggagacggaagaattgacatgaacatggcatcccctctcttgatgcagagggacagaagagttgacatgaacatggcctccccacacatgatacagggggacagaagagttgatatgaacttggcatcaccacactttatacaaagcgacagaagggttgatatgaacctggcatcttcgcatctgatacaaggggacagaagagttgatatgaatatgacatcccctcacttgatacaaggtgacaccagagtggatatgaatatggtatctactgctcagaatggaatgcactcttttgatttggtgaatgtgaacctagaaagtggtcctttgccaatggctgcaactgatttcatgcaaatgcatcagcacccacccgtttaccatccaaaacaactcctcaatatgagagatcaggtgatggacacaaataagaggcccaatatggaaacaaacacatactttatgggaggtggaatgcatgtgggatagtttcttgtctagagacccactatgtaatcttttctgtttggaaaggagatgcctttccttattttatattgatatgtatgttcctacagcaggcagcaactaatcaattaggttgtagtaattgcagattaatcttgcagtgctggtagctttgttgttgtatccttctctgttcggcagctgtagcaattacttgctattgtcttgtacataagatagtagaatgcaacaaccttttcttgtcacccggtacatcaaaagtgtgatatctctagcttcacaggttagctgatgcatgttcatgagtgttgactgatgtttggtttacacctgtcgtacatctttgtgtcttgtcatatggtttagatgcactagtactttagtgtgaagggcgctttttttagcggctcacttattggtaggtcaaatgccgtttcatgtttaaaactcattttgatgatgacgcaacttggtcatatgtgtttgcaaggtagaagtatattataagttagcagaggcaccttgcttttgttcggtcaacaaagggtattggttgtaggactcctagctgatgctaaagggaacaagttaatttattgtttatagacaatgttagatgtatcttttttgtagatatatgcttcacatcctcacctttcagtgaacacaggtcttgttattgcttgtgcagttgtgctggctgctagcttcctattttacacatgcctaaaagctaacattgcagatcaatggtcattgaacactaacgttatccttggcttctccgtagctactattattagcaacttctgtgtccaaaccaaccagttcttagaacattgcaatctggaaagtgatgaaagatggatcattctggtcctgcagggaaccaaagaaagtcacctttacaggctgaagcaagtgtttcacaataaacaataatgctgcaaacatcacggggtacgaaagttttcgactttcagcaaagtgcattcttcagctgttcacacaaggggtcaaggggtatatctattcaatgagtaaaaacttttgcattttgttatttatgcagcaacagaacagcaatcttatggacttccttaaggtggcgctgcgtgcaagatacctctgttcagacttcaagagtttcagatgcttttcttcacacaagtgcatcagagtttcaggtgcatttctagatagcaaacttacaattcaacagatgaaggtgtgctttatatttgattgaaatacaaagtatatctcaaaagaattacaaaagattcattgccttgtacaattgtagagattcaccatgttaacaagtacaactcaatctaaacgtacgatctaacagcttgcaaggctccaaagcaatttggtattatttattccttttccacctgcatttgggaacatttattccttgttggttgttgcctgctttctacacagaaggttttcttgcttcaccccctcaaactacttttgtttcctactaacgagcactatcaaacctgtcaggagcatgcagcttccaccactagactttttgtgaccccactgcatggatctccaaagttattcgatgacactggaacactgcaattggtcattccaacacaggcctgcagagttcaacgagtaagaaaaacaccactggcattgaagcatgacaagtatggaagaggataagctcagattacctcttgaacaactgcaagagcctgagagctgctgcattcaccatggttgtagttcccacaggtgccactcggtgtcccaaagcttgcaaacttgatgttgctgatgacctgaccttctctagggcactccaggcgaagtgctggtccctgcgtctgagacgtctgttggggagagatccagctatcgatttgggctggatgcatctctgaaacatgtgcacatatactacttgtctgccttgttgtgaaggatatcatgcttggatcaccaccaaactgctcaaagaggactagatcattgctaccaggttggagaaatgacctgggcacgtggtacctgtttaacaaggtaaggcattcaatcagtcagcataatggatttcatggtgaccatagatacaattttgagagtgtgccttcatattttgtagtatattaaatacatcaatgcttagtaagtgctgaaatataagtgaattttcatgcacagctaaatgatattatcactaaaaagttttcatattggaacatgagaataaattggagctggctctgcattaggaaacagattgtagatatgaaaaaaaactgaagatcatattctcgtgccactgagctttagcagaactcttacagagtttgtgatggctgcccacatttctttaggcacttgttcgaactataagctcctctgtagttgcatgagtttacacagccactttgtggagccaaatttgttggccagtagcgaccaatgctctggccattcacccatgcctcccctttccccattcctgtgaagtctatggcaacagggtcatcacctgcaggagccgtaaacttggtctgcaattggagcatttcatttagcaactttgcacattatcccaaggtaataattgaacaaaaaggattgatcaaacaatggagtgtatagatatagcttattgagcccaaagccattttacatgtacacaaacgtcaaacacagcttaattactgggtcagaggatcatactgaccttgtaccatatcaatggttggttggtcgggtatgcgttgtctgaaacccattctggtgaggcttctgaaggattatacagatgcaagtcttctcctctgagtccaatctgaagcggtgaaaattatgatgagggaaaacaaaccatgttatgtttacggttgacctactgtaccgaaggcattctcaaaacagcattagccaatagtttccttacaaaaaaaatctgaaacagtatatgaatagatagtagaatacctggtatgtccaatctgtagaagatagattaagggcaccatttggtccactcaactttactggaccagtgactccagcgccaaccaggtcaaagaatgcaccataattctgatgttacagaatacatagttgtttattaaatagaaagaagtaaaataggatattagttttggtgcatctcttctagagtaagtgaagaataaattaccgatagcccaactgttgtgctcagaagatctattttgttcttcccaggtacaagtgtaactggtgtctgcaatgagatgagcgagctgctagcactgcccttagcacttcctggcatgtgtcaacaattacatttcagcacacaaatactacttgtgcgtgtaagaccaatgttcataattaacatcacaattcgaatgtcatttgaaaggtctttgcattgtgacctcaagctttacctgctagtttgccattgatgtagatctgaagaacatgtccaagtgagttgacaagcagattggactggctgccgtttagatatggttcatcacctttgacaacgatgctgcagaaagcacgattaattgaaactggtgagtaaccttgtgactgccagttttcttatatatatatataggagtatatggacaattacacctgaggcgtgtgagtgcgaaccctgtaccttgttgagtaccacaggaaatcactggcatcggctgtggtgtttatctgctccatcagtccaggtttcgtcaaggcgttctcctttgtaataccaacaggctctatggcataactccagccagctgtagcaagttccggtgtgattaatgaatcatcagtatcttggatacttgatcccaggcttctcatttctgaagttgttacctgagaattgatctgcaagggggcaaccacatccacatgcatcagaatcagttctcaccaatgttctttctcaaatgcagatcattgtctagcaaagtgagggcaaggaatgcacatacctgggctgtgttcaataccacatttttgcagtcaggaaggatgcttacagaccaggcagggagcttatacgtgtttccgttgaatttgacagttttatcagactgagcatccacgttggcaaggaatgctgcgcatattgaattgtcagcagtctgatatacggttgcctgaagccagaagagtacaaacacccatcatcatgtgtaccggaacagatcatcaaggtaaacaaatattttatctctgaacaagattagctatacatctctagctgctccagcaattttgattgactcatctttctttttcgttaattaatacacgggttagtcacttttcgaaagagaggatcacatacctcagtattttgacccaaagaactatatgatggctcagctgctatgagtgctggttcgcacagctttattgccttgtgcacatcccttaagtggccccactttggctgcctgaccatccctgaaccacaatattgcaaaagatagtgattcggttagtgagatgtgtggttgtaccggtacacccccaacacataggggagccgtttgggctcaatttttttggttcatatctttcttataaaagacacacggttcctcatggatattcatgttctttttttaactgtgactagtcaatactagtattcccagacggcaaacatacttcaatttaacatagctgccattgacaggcatacatgtggcagtaaataagtacagctagctgctgacagtacactcaccatactcatcaataggagcatcgtagtcgtagctcgtggcgatgaatggccctcccgtgcttcgtccgaagttggtccccccgtggtactgcaagccaacaaaaaaccagtgttagaatcgcagagcgcctctgtttacccaagcgaattggcaaaacggcggtaaaaaaggaaaacaaaaaagaaaacgtctcgtcttcgcgcgcgagctgcttaccatgtaatagttctggaacgtgccgccgcgctggtagaatcgcgcgacggcgaaggcgaggtcctcggccggccggtacggcacggcgccgccgaaggagaggaaccacccgctccagttctccgtccacatcttgggcttgctcttggagttcggcgtgaactggtcgcagtagaacccgttgcacgtgttgatctgcatgcgcaagcacggagaaacggtgccacgtcacttcagtgtcgccgtgtcggtggttcgttcacggcaccggtgatcgatggcgattggcgaagcagggggaagaaagacttacgagggggtcgggggcgtcggactgctggcacatgacccacggcacgccggtgtcgagggagacggccatcccggcggcccaccgcatgtaggccttcccggcggcgccgtacgccgagtcgatgttgccgtactcgttctcgatctgcgacaggatgatcggcccgccctgcgacgcgtacagccccgcgcccttcatcgtgtccaccaccttctccgtgaaccgctgcatctccgccttgaacgcctcgttgtccgtccggaacttgatccccggcacgaagtgcagccataccggaaaccctctgcagtaatacttgcgtttcttaccaatctatcgatcaattcgcccagcgatagccagtgcgagagcatgagagagatgtgaatgcgaacccgtagttccactcggcgcagacgtacggcccgatcctgaggtgcacgtagaggccggcgtcggcgacggccttcacgaacctgacgaggtccttcctgccctcgaagtcgtactgttctttttttttcgttgcaaattcatttgagtcagtcagttagttgatcgttaaacgtccgtgtagcagaagcggagtagtgtgataatgccgctttagaatttccagataatgatattactaatactagtagcagtagcagttcacggggagaaaatggggagaaaattgtaatattgggattgcaaacatagaggcttcgctgttttgacactctgagtgaatgacaaatgggtccatctgtatctataaaatgtggatccaatgtcattatagtaaaggttaatgtttacaccgttgtaattgtaaatcaccagttcacgggaggcagaaagcctagaagtgagtgagagaataaagcatagggtgcagaggaagcaaacaccgccctttgacacatgacggccaggagggagaggagatgatgacggaaaaaaaaaggagagaaaagatatacacaggtcattaatttgataatttcattgtggtacactattaatggagaatactactactactagtagtggtactaagtagcagttgagagaggagtacgtgcctgtccccggacggcctcgtgaatgtcccagaagacgtacgtctcgatgacgtccaggccgccgtccttggacttctggatcagccccggccacatctgcaaccggcgaccgccaccgccgccgccgccatggcaacataatgtcagcttttgtaactagcaatctgtctgctcatcaagaacagaggaggccgaacgagcggtgcatggggcaaaagagagaaaggcaagagacggcgacgtacgtcgggggtgctccgcgggtagtggatggacccggagacgagcacgcgtcgcacgccgtcgatgaccaccgcgcggtggtcgtacgtcacgttcgccgcccgcgacgcgccgacgaggaggcttaccaccaccaccacggggaggagcagcagccgcagcagcacacccaccgtggctgccgccattactgccgccgccgccccgttcggtgtcgttctattatcaccggcgctagtgcggacgatgacgaggagcagcaggaggaaggaagaacagagttgctcggtgggagaggcaaaagaaaagaagaagaagaagaagaagaagaagaagaagaagaagaggagttgctggttggagtggcgcggcgggacggaaataaatggcacgcactcagcggcagcgacgaggctcgctagcggagcagcgggagcgaaagcggctgtgtctctttcccgcggatgcgggtggtggtgcatctgctgtgctgtgctgcctccctccgcggctaataaaaaagcgctgatcgttcgcccgcgcggcgagcgatggggtgggtgggtgtggagttgagttcgcggctgcttgcaagcaacggcaaaagccccggcgccgtgcgtctagcggtaggatcgaattgatggatggatcgagcaaaacataattactgctcggcttggctagttaatggaggcgtactacgtgatggttcggtggcgcacacggcgtgggtggggggggggggggggtgagcaaacgccacggccacgccatgccgcatctgatctctctcccgtccacccttttgcttccgctgctgcatgtgcccttggcattggccgcacgggctcacagctaggacggaccagtaaacaaaaggtgccggtgtgaccgaccgacagacacggcatggcaggggtcgtgcccgacccgacccgccgttcattgccgctcgatttctttatcagtgatgctagtactactagcactgcgtctgctcgggccaagagctaagcggcccttgtcgcttccggtctcgctcgcctatagtacctccgtcccaaaataagtgcagctgtggatatctgtgttcaatgtttgaccgtccgtcttatttgaaaattttatgaaaaaaataaaaatatttagtcacacataaagtactattcatattttatcatctaatagcaatagaaatgctaatcataagaaaatttcaaataagaagaacggtcaaacgttaaacgtgaatagtgtaaaactacacttattttagtacggagggaatagctacttcgaccgtgatggcgtatgatatgctgcactagcacacggttgccactaccaatctagcagtagatagtggtagtgtcatggactgtactccctccatcctataaaaaagtaaaacctgagttttcgtttccaattttgactgtacgttttatatgaaatttttttataattcgtattttcattgttgttaattgataaaacatgattaatattttatgtgtgacttgtctttttaatttttttcataatttttttaaataagacggacggtcaaacgttggacacggaaaccaaggtttatctttttttttttgaacggagggagtacgtctgtactgctcgtcttctttttgtttgggggaggtttgaaaaaaacggtggcggtggtcagaccgtgaaaaaaaggctaagcatttctccctctttctttcatcctttggggcggtggaaaatgatggtgcgcggcgacgacaaaaatcgtgcgaaagcgggagagcgagttgtctctgcagtctgcactgacctgtggcgtcggttcatggggaggggaaaggggctcgggtcggactcgtccacaggggagcaagtgaaaggacatggaaaattgtatgcaaagctttactgctgatgcaagagagtgacttttatatattgtgtttgtttgccatttttcgtgttacaagcttacaaggcttgtactacgaaagcttacaagctttcgtgtttgccattttatcttatcaagattcaataaggtaggggtaacaaactaaacggcctccgtatccaaccaaaatttagcatggttaaatttgatatcaaaccaaactgctctacatatggaatttgtaccaaagcattacgctcaactctacaaaatctaccaaagatacacgcgccctttttgtttgaagaaaaagctaatagagctaaccaagtttttgtggcatgagaaccacgtgaggcaactgctacactcaagtacttggatttctaagaggtagatatttcttttttggctactgaagaaactgactgcataatctttctctggatgctcgaatataatgtagttcaatgtgaaatcgacatggcacacgccattgttaacctagttgggtgacccacctgattgcattcacagcatatttgcccgggctatgcaattagtactcttcacaagtcacaagcatatataaagacctatggtagtgcagaagcctattgtttggactgtcataagctgggatgtttggaacgctgtaaaattcccgtacgaagaacggttttctagtaaaaacttttgctgaagataagccaaattaactgaagataagcaagcagtcactagcttgatattgtagagtcaaacctcaccatttatcgatcagtggcgcgtctaattgccgtctatcacattgactagcgtctgaaattagaacacatagtaaccacaaaaccgagaatggcgatgccgaatcctgaacctaacccactacagaggctcctgaatcgaattgaacatctggttcttctccagagcaggtgctcggcttaggtgtggctcagctcaagtcaatcgtatttggtgctgatttgctacttacagtgggcaaaccacacatcttgcacgtcaatgtagaaggcgaccatttctcgattcacttttagtagtaacgaaattacctacgccaccttgacaatctttaaaccctttttttttgacacagatgtaccatagtgtcctgtcatctgttaacacaaggaaaatccagaagtgtcatccgaatgctgtgcaagaaaggaggcacatggattcaaaagaacaaatccatattttctgaaaattgttgactaccaaaaacaaaatcttgtgctgctccattcgccacctcaaccattccaatacataaaaaaccggataagaggggagcgaaaatgagaagtgaaacgggtgaagcagagcgtccagggcttcttcatcatcatcatcatcagagcgtccaggcctttaattgaactcgcagtcgggaggctgcaggtgcggcgtcactgttgccgcggttcgttgcggcatccttgtagcaatagcagcacatcggcgcgagatcgctctacgtctcgacgtgcgaatctgatgtaactctcctcgtcctttgcggcggattcgtccgggctctccgtgcgtaggtgtgctaccggcgcgcgcgtgcggcaccaccggcactgccactgccaccaatgcgcgagaacgtaacaaaacgggcaaacggcgccttccttctccactcgattccttgtcgtcatctcgcgtcggggtttttggagcagcgtgcgggagagccggccgggccggtcacgccgatgtggatgtgggcgatgtgcacgctgcgtttgtgtgccgaaacgagagaatttttcgccgatcgatgtgtccaagacttcccagtgtaatgggaactcatcggattattctttttgattcttggttaccttaactttccttttctttgctcggtggtgttcctctctcgttaataagatatatacttttcaaactataaaacggcgtgtttcttaaaaaacaatttatataaaagttgcattaaaatattaaataaacctatttttcaaatttatattaattaaaaaaataattaatcacatgttaataactttttcgttttgcgtaccctaccttcgtcttcatcttcactatattctaagatgtttttttttaaatctatctggtatggggtttggggcgtacaaggtgagccaagtgatgccattgatgaggagagttttgcttggaagagtcagcaaagaactgggagagttcaccggcttgaagcctccattttctgcacggatgcgattgcagcgtagatgatgccgcggcaagcaaggagaaagatgagctcggcgagggggagagtgacacgctgacagggatactacggagcagataagatgcacggagcaccgctgccgtgcaacacggcagcgtcgtcgaagagcggcacggcacggcacgtctcaggatactactagtaataacttcgaggcagcgcgacaggagcagactacgtgaaacgatcgccagcgcagcttctggcacgagagagtttctcagcgagatcgacaaggacaatgatgaattaatcgatgaaatctaccgtacaacacaaggcaaaaaaatgggagaggcaggcagccaggcagggcctgatccaaggtgcactggcactaaaaatctgaaacatgttctggaaatggaatgccgaaaggcgaaagggccaaaggctattatcgctggatgtcgtaacattatcttgtcaagatccatctgataggagaatggtcatagcagcaaaggacggggccaaatcattgaacgcgacagctttgatgaccatgtaatgtagcagaagggatcagtacggtatctgaagccaaaagaaacggagagaaataaaggagaaaaaaggattagatctgacgtcctgcgttttgcacgttcacgtactagctccccttgcgcaattatgcaagttacctgcagttatggagtgcacacaaccgcgcttcagatgtacagctagtataataacatcaagcatcaccagagaatcaatcaacctgatacaggtgaacaataataatatcacgcggttgcaggataagatttgtgtaagatgctaatctgtcatcgacgaagtgatggagatttgagaggacaatggcggcaacccacctagcggcgagtcaacccagaacaaaggactaaaacagaaaggaaaaaggaaccaacaattttgctaatttcatggaaaataaattagccaatggtttaaaacaaggcagacgagagttgagagttgtccatactctttgtacttttctaattacataaagagttgttcatacaccctttttttttaagatagtgaatagaaatcccgtctctatatctatcaacggatagatatataaccaaatatgtatcacgtacttttgtgtccgttttaacacacgcttaaggttacacccaccaagatttaaacaccattaattacactgccacaccaaatatcctttccaatcctcttctcttcttttcttttggataccttagtttgaccataattagtgggtaggtgagaaaagttgctgataactgataagcgtagccactatgcattagctactctatcctctagggtgctctcaaaagatatgtgaaggtttgaggccatccttccgtgtcagttgacgccttgccaaatccaccacaaaaggctagtgcatcaacatcatcaccattcatcacatgaggacatactacacatgcaacaagcctgcccgacacaggaaccctttagattattagcaattgtgaagcaatgtggagatcggatcaagtgatttactaatctactagcaaggcccccccaccaacaggaatgtcactaacctatcaatgtgatgactgttcctctgaattcttcctgccaatgcattgctggcttttgggtcacggattcacagctctggagtctggagctgcaacagctgacgacgaaacgacaaagcaggcacaacaactcagagctgccaagatctgatcagagcaggcataacaacctaagatactccttcagttccggtcttgcaagctcaatcattactgttgagaagccgcactccaggaaaatgattgaaataaaatccaaaaagacgattactggattgaacttagtctcacattttaatccacataaatgttacttcctccgtttcatattataagattttctagcattgcccacattcatatatatgtaaatgaatctagacagcatttatatgaatgtgggtaatgctagaaagtcttataacatgaaacggaggtagtatctcatattatctatctcaaaaccaactgtatttaatacagcattgagaatatctagaggaggtatcaaactctctcaagggccagggcaaaaaaatgttctacacctcacactacaaccttatattaactattagcaacccagcaaaggactacatttccacttctgaaaaaaactctgaaaaaaggaagatgccgatggattgtacaagctattataagtgggaatcattttgattgttgaaagactagtggctaacaagaaaatgacaacatggagatttcctacttcaggaaggccgatgatacaaaaaggagtgcataagtaacacatgcagtgctcacttccaagtttcttggaccaggcagtataggcggaattacagaaaccatcaagaatgtggcaaggaaccaggaagcaaagaaggatccgaacctgaaaaatcagacaaacttagcatcaggaattgaccacacctatgcatagccagagactatatccttttgcctattacacaaattatacatgaaaggttgacaacacattaaagtcacctaaatgataaacttcaaatcatccaatccttaataaatgaatcctatgaaagcaagtttaaagtgttactagtattgacatgtctattacacacaactgcagtatgccatcacaaaacaactactctctgatccatcacgaattcatgatagttgcctcaaaatatagaacttttgtagaataaacaagattcacacattttgcaccattcccattgaagaaaagttctaaaaaagcaatgagattgacatgccataataggtggcgcctaggttgcacttgcacataataagaacaatgagattgatagaagaatgaataggcatagagtgaaatacgtg

SEQ ID NO: 59776 - DNA, 57485 bp, Oryza sativa
agcggcaaacgagcggaaaaagggtttttggttgcgagagcgagacgcacccgccgccgctgccgccgcacatctccctcgcatcgcaagctcaccggagaagcgcaagaagagagagagagagagagagagagagagggagggtaagaggaggaggaggaggggtaggcgagggagatgggcgccggggaaggggatgccgccgcgggcaacaaggagaagggcggcggcggcggcgtggaccggacgtcgctggacggcgtgcgggacaagaacgtgatgcagctcaagaagctcaacacggcgctcttccccgtccgctacaacgagaagtactaccacgacaccatcgcctccaaggagttctccaagctcggtgcgcgccctccctcccttcccaaccttttccttgttcctccatccaccctccctctagcgcgccgcatccgacacacgccgggacgagctcgttgcctcttgccggttgtttcttgtattgggatgtattttatgcgttttcagccctcggatctgcggacagggtcgaggaaagcgagttcttgaggcggcatcgataagcattaggatttgtttggttaataaaggagatgcttcatgtaaatgtgatactaattagccatgatgataaactaggggtaggattgaatggtgttcgttagtgtgcccttgggttgaataaagatgcattttactgctgtcttggatagattgtatttctgctgctgccgttgattactgattgtttctctttttttttttcttcgtctgtatatgtagcttattacagcgatatatgcgtcggggcgattgcgtgtcgcctggagaagaaggaaggaggagcagtctgtgtttatatcatgacgctgggggtactggcaccgtatcgtagtcttgggatcggtgagaatttcccctttctgactttgttttgagttatatgaatagactattctgtttgctgttagatttctgatcagcattattatgtataagctcgttactatataaacactgctttttttttctatattagtgattaaacaacgatttacatgtaacagcacacatgaaaacaagtttaaaaaataaattgcttacagtaagaccccaattctgacaagccttatggttagctccaatggtcagtcgatgccttagatattgcaaaattatctttcgttattaggtagaataccttgtgacattacctgaacatgctcaatgtataatgcctacttgggtaataaggtgggatccgatattagttatggtgtttgctacaatttatatggtaagagaaggcattagcttggggagaagagaaagtattgttattttattcttatgggtaggcattatgcatattcaacgattaaacatcctattgctacattgtaagagtaagtctaaagaatcattgtgtgatagaactcttaccatccaatcattatgtagcattataagtttataactaactttgtgaaatattttccggtaattgatattttgtaagtagacagctttaggcgctgaatttgaacatacaagattagccttggttagctagtttcagcactaaaataattatctgttttgttcatgagtttcagagcctatgtcaattatataatgcagtcgcttggctgtcaaattccttttatgacagaagacagtttcagaatcaaacaaagtgtagcattgcgccaactatggacctcatgctacaaaatcttctgtcaacacttgagttcatcttaagaaaaaaaaatggattagcattatctatctgataataaagtctgtcacttttaaaaggttcctatttgcctgggttttaatcgttgtcaagtggatatgaatgatgggaggttgagcagagactgataaatcagtattgatgctagcatactagataagggtgcacctgcagcgtggcactgatatagaaggggctttttggttatttcttgatgtcaattgtgcagggataccttgtatgtaacaggtaggccacacaacgatatcttgacattgattctttccaccttgagccacacatgaagacccggcctgttggtggtgttgaatgccgtcgataaccgaattattttgagagaccattttaggaatgaaaacactctatgggccacttgtacttgccacttggaaatcgtcaaaatgctgaagtcaataactcaatattttgttttaaactcaattttaaaaaggacaaaactagaacatttcagctttgaacagcttgaaaatttagaatggggatgccagaatttaagcgaacaaatcagcaaaactagttgcacagcaactatgttctatgttttgtttgctactagcctactagtaccacacaacaatttgaaacctcactttttgtgaactacccatattgaaataacaattcaaaaacttttatagttttgaagttttcactctatgcatagtaatggatagtttgcatttggaaatatcattagcttttttagggccatagcatagaagatatgtgtcttataattgcttcgtttaattttcacaggatcgaagctgctgaaccatgtgatagatctgtgtgagaagcagaacatccctgagatatacttgcatgttcagacgaacaacgatgatgccattgctttctacaagaagtttgggtttgaaattacgaagacgatagaaaaatactataaaaacatcacgccgccagattgctatgttcttaccaaatttattggtcaggctgctacaaagaaatgagcaaccgccaacactctccttttgtgacaataccaccaccaccaccaagtcgtggggagatagttgtgatcttgtcgcggtttctgctgtgttttcacttcatgggtgctaacattattacaaaacactcgagaactatagtagcctttgctacaagcactgaggtatcattcacattgactgtttcctttaccccccatgagcatgagtgtttttctatttgtttgcagattttaccccttgttcttgtgaaatcatctgtttgttgtgacttgtgagtgtatgtcaccacaggtaattcctgtgaacttatgtccatgctcacgcacgcatattcgactcgaataatccagtatatgtactctctttgcttcatggaatagctgggcagattatctcttgctactgttttaaacagtaagttaactctctgcatcagcattgtttaggctcaagctcttaagctaactttttggtttataggctctataagccgataaatttgaaaccttaagtttaatggtagagttgtatctacttggtataaaaaaagctactccaacctaacttttgatttaacagtgtaaaaacagcttatggctttaaaaaagccaaacaaaaaatctacttgtttgtttagtaaactttttggctcataagttggtttaggaactcaagttttttatcttctactttctcgtttcatgtgagcacgctttctgaatagctaacggtgtgcctttttttaaaaaaaaaatattggataagttcttaaaaacagtaatccatctgcgaagaaaaaagttactaaccaccactatagaatacagctttataattctaaacaaggagagcttggatactctatactctatagagtgtggcagggaagccaaaccattcgtgtataagaccatggtgtggtggaggcatggataaaatgaaatgtggtatggacttggtagtacaactacgggggagcacggacacagctgatgggattaccatcgatgactcgcactttgttcctaggaccttgttttggcaagtccttcgctgaagatgcagtagatcaacattcacatgactgtctgttcctctttgatttttcctgaatgtttagaccttttcataaataatatttattaacaaatatgttaaaaagatatatccctacttctaaaaccgaaccatttggctcctcctttaagtaatgttgtcaatacatactccttcttgaacaaatataagtatttttaggattcaaattctattactcctatatagggcagctctagctccacctcttctggagttagaggtccgccagataatttcagctccatttaaaatgggagcggagttaggtggagctttctcactccagatccaactcatgtagctaaatttaggagtataaaatataaacatttttaggacgctgattctaatgtataggaatccaagcattttcagcccatcagatgtttacaggagaggaaccaaagcaattcaaactttgaccatgagataagtgaagagaatctttcagtttatctttaatctttacttaaataacttaaaaatattatattagtaagaaatgcatgctttaccgctgcatgctgccgtatcttatccttttattcattttatttttcaacgagtttttttagggatatgttttcaacgagttgatagcatatatacgtgaaaaatgctaatgggtcaatttagtggaagaacaaggtactcctgtttagtgagaggaactcatgataagaggtatttcatccatttcatattataaatcatttttttaaaaaaatataagtttgattaaatttatagaaaaatatagtaacatctcaacacaaaaacaaacttataaaaaatatatttaatgttacatataataaaactaatttggtgttgttaattttttataaacttgagcaaataaaaaaaatgtttcactaaataaatcaaagcgagtacaaactcaaagcaacttataatatactccgtaaaacataaaacagagtactcccaagttatttttcgatgaggaagtaaccatcagttcatctaatttaacagttaattaaacatccaaaggcatctaaatactcgtcaaccaatcatcaattgattaagtggttaatcgttcttgccagctagtatttttcaccgtattagattattgaaacaagagccttgtatatggcattaaaccatcattgccaagccaccaaaaaaaaaagaagaggaaatgcacgaaaacgaaaatgatagcagagtacatcgcagttgcaagacgaacgatgagctgcagtcggtactgggtacgaatcggggaaaaaacatgttagtaattcatcaaggaagccagcgcagcgacatctccatttgtaattaattattaatctcaagtatggaacacaaaatggactacaaaaggggattctttaagccttaatctcgtaataatccatggacaagtcttgccattgtaatacgtctcgtacgctaacgaagcggcctttccttgtcacaatgtcacatgtaagatggatgtatacttggaaaattacatcaacgaatccgggagtaattcggcctgaaaaaccgtgtatccaatcctgactaatacaagcaagtatggcagttccctatacagttatcgtgaagaaatagagtttcagcaaaacagccaatcccaactgcaacaagaatatccctgcaacgatcaagaaccatcgctctccagaatttacaatgtgagcgcgcagattcatagcaacgaaggtagcagacataaaccccgcgacaccagcaatcacccacctgaatatttctattggcacaatagacaggagctgtcacatggaaagagtgttaaattcatgcagaagttactcaactttctcaacaaccaatagataatcactaaacaagagactatgggtttgcatgttaatagggcatggagacaacaacacataacagacaacttccttgatagagattcggtaaataacggatatttttacaacacaaactatggtccttggtaatgaattagttttttgaatctaaagtagtgcaacttcttagaaacggcaaactggaactgattgctttgtaacgctatatatccagcacacttacatcaaacccaaatggaagccttctaaacaagataattaaccataacaaaatcgacaacactataagaagaattaatttctattgtctaagttttaggattttccttaccgatgctggaatgaagatgaataaagagtatccatagaggcaccatagttgcactagtccagcaggtgctgagaagtacttaaggatgacatatagaccaaggggaacaaatgtcacgtagccatagaataagccagcagaccatgtaaccaggttaatatcatagttccactccttcttatgccatttgtgggataggtaggtgacaaatgtggcaatggatgcagcaacgaaaatcagggtggtgcatgtccagaatggcccatatctacaaaatttaattgaaatgaaaattagcaggcatataaccagtgcttcaattccttgaaagtgcaataacttgataaaacacttaaattgcagagctatttatttacaaggaatttatcattatctgaaaaaagaaataatacttccaaaagcagagtttccactgaattaataggttagctgatatcgaaacacaaagttctatttgcaaatgatcaaacagcacccattgcttcagatttcagacattgagaaattcaggaaaatgctgtttaggtaatataatttattgctatcatctcaatatattcagtcctgcatatttgccaagtttttcacaatggtatcccactgccacttacaaatgcctcttcacctaataatagtaacccatggtatagacttgtactgctaatctgctattttcatgacacatgaattggtacaaacattcaagtttacttagtgttgacaccatacggtgatgttgaacaaggcacaaggtacattcaaaaggcaatcttagaactgttaccataaacactctcaagataagttcaacagaaagataatggtgcacacagcaagacaaagtagatgaaacaaagctttgaaatgaaaaataacaatggaatgatccaagcatgggtaggacatgtcattgtaaaaataaaaataagtttaggcagtgaaggctaaaggaaaatcctagactcccttttagtatgttgttacaacaagtcctcggaattattcattctttgtcatagaactctcagcaagaagaacgggaaaacaacatacaaaaagagatatagaagtattctaccgacctaagacatgctaacaactaattacatgtcgctatgagctgaaattattgcgctactcactcttaaccaaatgcaagacatgtcatcgagaagactaggctattttgctggagcaatcaaattcctcctatcagttcattatcttaaaatccccatttcttacacctatgtgaccaactcctctgaaatacccagacaaaattatcacattgtgcacgcaaataagtatcatggactttccagcaaaacaacagaagacgttcatagtctgtcaatgctattaaccatatccgctacctgagcatatgatctctaggaacattcgaatgcaaactatagtactactactaaggtaaggaggagttaggcgatggagaggcatacaggtcggggttctcggaggtcttctcggtgaaggtgccgcggaaggggaagacggactcccagatcctctccaccacgtcggaggtgtccacgtcgaagtagggcttgtacgccgcgacggagaacatccggaaccacccgccctgcccggcgtcgtccgacccagcgccgccgccgccgccgcctcggccgccgcccccggacttggaggaagagaacgtgtctgcgcaggcagcaaaagcaccaaccacaagcaaggtcagatccagacgaagaaatcaatgggaggaggaggaggtgggggatctgatctgaccatccgcgtcggtgggcgggcggtaggcgccggagatcttgcccttggcctcggacggcgggaagatctggaggttggagtcggcgaacttgatggtcggcggatctggccccgtcgccgcctgcgaaaccccgacgaggagcgcggaggtgaggagggtgaggagaaaacccatcggcgtgggaggggacggggacggggaagcttaccgggacggatccggaggccttggggtcgtcgagggcggagtagccaccgccagacatcatcttcgccggcgacggcgacggcggcggcggcggcggcggcggacgaagcgtggaggaggagcaaagcggtggtgggttaggcaggaggggcgcgtgaatgcggctgcttcattcggatctctcgttgctttgcgtcagttataacctggcgcgaactgtgtcggtgttagtcactggctcactgctaatgtttgctcttgtaacactgtactccgatatttgttagtgtcaattttggtcatgccaaaatatatttgttacttcttctgtttcataatgtaatcattctaccatattccacatttataatgatgtatatatgtctagattcattaatattaatatgaatgtgaaaaatattagaatgacttatattgttaaacggagggagtagtactgaagttttaatactatcaaatttaataaagtaaagttggtactagtgtggataaacataggtatcaaaccaaacgtatgtttgttacttctaaagttgctaaaagaattggcagaataattgtttttctttgatatatagtacctccgttttttaacatgtgacattgttgacattttacaaacatttatctattcgtcttatttaaacttttatgcaaatataaaaatactttaattcatgcttaaagaatatttgaagataaattaagtcacaataaaataaataataattacataaattttcaataaaacaaatgattaaacgtatctttaaaaagtcaattgtgttatatattaaaaacatgaggtagtatatgtaatggttaattttaggcttttagaatgttagatatggagaatcaatgattgtttttctttgagtatatatgagtagccaatccagcctcgtttgtaaagactgatttaacttgaaggctgctttccgattgaatttataagtatttatgtgttaatatctcttgttattgtgttctaagggaacgttcacaagagaaaatcgaattagcaaggacttgttcgaggagccaatccagcctcttttgtaaggcccgatttaatctctcgactgctttttaattgaatttccaagtatttacaggcttccgccacgatggtgtaccgggcattttggtgagagagaacattttcatatttgtagaagtataattatcattttggtgagagaatacctttttatatttagccctgccccaaagccccaccataccataccatttgctccatgctcattctccgattcttcacacaacggataaaattacttacccccgcaaacatccacactcggaaatacctaaatactatgaaaattctctgttgacagcaatctatgcttcacagtagtatatattttgtatatccaagtcgtagataagaaagtagggtctgacaaggttccaacttctctatgtaacttcgagaccagcgagattgatcggtgaaggtttttgcgcaaataagatgatgttcgaaaccagcagccttgttgtgcaatcaggttcaagtaggtaaagattcaccaaacctccattattcaagtttcatgatttcctgtaggataggacatgacactcgacgaccaagaggcaagagcacagcaatagagtatttgccatctgatgtttgcttgggtgtccaaaagcccccatcgcaggcttacgcttagcttaaggtaagttagggtctccgattggagcatttaatcaaatagaattaaaaacatatttagttgtcgcctcatgtacaaattggaaagcatgccgataaaataaagatatgatgcgttcttctattggattagaagaaacaatgtactgctctatattgttaatgtagaaatggtcgttgatataggccccaagattctttttccctggggtttgtgctagggtagttgctgtttatgtaggcaggcacctatcgctggctccgaaggcaaaacccctctttgcctgtatgacgagcattattttgtgaatgctaattcacaaaccaaagcgatatgatcacttccccatttctgtcaagcaacaaaaacagcatggattagagttctgtcatgaagatataacaattattcgatgaaatttgtgaagggttcaatgataaaatatacgatgcacttggtgataccttggtagggaacccaattgtttgtttcagaatttcttttgggaaggtatctagcacttgaacagtctgcagatcttcggaagcccttcattacacaaagtacaagattgtatagaggtaattagatagttgaatgtcagtggcaatagcaaaggaattccaataatgcttatttaccatatgtagtccactgttcccataaattttctgttgtaacttgttactagaggctccttgttggcatcttttgtcccttcaaaatcctggttgaacaatagttaccacaatcacaattgtttcacatgattgcctggaatttattggttctagaaaattattctatataaaaagagtaaatttgcacttttgcactagctatttgtcctttatttcactctgcactggtgtttcaaacaatattttcactttgcgctgcccaaagtcaccaacagtattgcagtttgcaccagccaaatctcatgttggtcttatccaattgtctgtcgtcgttatgaatcaagcacctttggtgatttccaacaccaggctagactgctacagcccagtattgtgttgtgttagtggttatacagttaactggaaatgaactcggctactgaaaaactacaaccttcgttagcttagggtggtgcaaagtgaaaacattgcttaaatgaaactactgcaaggtggaacaaagaaaaaaatggtgtgaagtgcaatttattttgtttatagagttaagaactacacatattgcaacccgccaaaaattaggcatctcagaacgagctaacagttgatatctgatatatctaaataaagatgagtggtgaaacatgttgatttctcacatcaaagattgatggagaaattgtagctagccatgtgaagttagcggttacctccacatctgtgtagacacttcggactttcaaattatgttccacgaaggtgcaatcttcattcccagtagcagctttaatttcatctggtgtccacctgtatggatcataatcgtaatatcttttatcagaagtaatcacttgctgggcagatggtgaaccatctgaggttgtttgcagctggtcttcatcttcaagtaaaaattcattaacaccagaaaactctttaaagatggaaggatctgcattcacatctgagcacaaaacttcattggatgccccatcatcctcaaaagcacaagaacaatttccaagctcatttgaacatgaatgcgattttgaaagcctgtttatcacttcaggtgtacattgaacatcacaagtgtcagaaaaggcacaatctgtgtgttgcaaaggctctagtggtgatgttaactgagttggctcagtattgttttcttcttctagcctcagattactcatttgatgaagtgtatcagcaaacttcaggggatcactgaaacaatttgattttgattcactacgcatgcaattattttgagtagacaaaggttcactgtcttgttccttttcatcgggtctgacctttgatatatcaaacagtgtatctgactggacattgtttcgctcaaaatcacaagtagcttttccagaaatcacatgaccaggaaagtttgccagggtatttgaactgttattgctaccaccagctaattcttcccaagaatctttagattcagatgattcataagatggaagaagctgacttctatcaactatttcactcgaatctgactgaagggtctcatcatttactgtcgttgaagcagacgaaaagtttgtaacgttagtttcttctacagagctcttttttattactccatatccttcactggagttgttaaccactgaagtttcttcaccattagtggtgttggtatgtgcttcagcatcagatgtataggcttcctttgtaggacctttcacacagcccattaattcttgctcgtgaggatttgtagagctctctgggtttaagaaagagtctgaagcagtatcagtcaaagttggttctctgccagaaagacgagaattttccgttacatttcttgcttcaggttgaggcttatgatcatttgggtaacttatgctaccctccttactattcgtcgtgtgaaaaggcggatagaatctgttaaataccaaaaagcatcaaacaaaggtcagttaggttaaaatatgcagaaaaaattgtcaaaagagggtgtctctgataaagcagaaggttcaccgagctgtgttaggaccagtatatagtccctgtgcagtactagtttgctgccctgatatattactcttcacaagaccggacagattcaactgcatgattattatgttgtgtgagtttcagtttctcaaaaacagccattttcaagttaatacagaacactctttaccttttgctccagcataaaattgtacagagggctctgaatgaggaagaaatgggtcagacattttgaccttgttacatgtaagcatgtaataaaatgtccaagaaatacagtgaaccagatatgaatctttaatataaaatggtaaggtactgaatattgccttgggtgtagagttgaaatctccacaaattattactggagcatcattccatgtctttgatagagcatacactcgatcaagaagcgtccttacctgtaagtatgacaagaaaattagtattcaaataatacgtatgaaggtgcataatgtactgactattgatggtcaagaaagatgatagaaatactaggtaatgcagctatactttgtttcagtgatgaaagtataaaacaagataatagcaaaagaccacaacccacctagtcatctacaacgagagggtggaaaacaatgcacgatctcaaatgatgccatgaaagcatcagaaagcaacacgatggaagataaggtgtacattgttgctcagtacttaaggtctaacaaggtgttatttctttaccatgttatactaaaaacaaaagtgcttaggccaagaggctaattctggtgaaaaaaaaatcatactataaaagtctgaactaatgtaggaaattaagactcacgagtgaccacaacataatacctgaccaagtttgatgtcccctctctttggattgtaaagaacatgagtattgcatacaataatttgcttagcttgttgaggatggttagggctgtgaaacgaaagaatggttataaaaacatggatagataataccaatgtggacatgtgggttatgaaattttctcttcaataataaaggaacgtggaataggaactacacaagccagaaacaactaataaaaaggagacagcataacaccattgtcacaactcacaactgtgatgcatagtttagaaatcttgaagtttcaattacctagactcagtttgcacatttcctggaatcaccgactgaaaaatataatgaggaaacgattagcagatataggccatgcaagattggcagcataaagaaagcttcaattcaaagtgatcagtagtttgcccaacgatttcaagcccacctctaaaacacaaatctgtgcaacattatcacggagatcaatcttattgaactcgatatcctcttgatagcgcaactgaaacctacaagatgaaaaattttggatgactatgagaagtcaaagtagaagttttttaatgtaggtataacatcaggagaaataattttgtatcatacaaaaggtttctttctttaaaaaaaagaagaagaagggaaagacaggattgacacacctagctgttcgccaaaagatcgcacatccatcagtggcatttccagtccgcatctgtaccaaaggtccagcataatgcgtaaatcatacggtcaagcagattcaagaaaattgtgtttcctcaatggcaatcactaatgaaagtttcagttctgcgcatgctatgtaatcaagtaactgtaaatgagtagttagaagcactggccatttttgcacaactatattttgtccacttcatcaacagagtaattcctgtgatatatacccactctgtcgatttttatagggaatattttcatttaaaaaaacaaattgtagattttgaccaagaattagtcaaatgaccagtaaatttagtgtgtataaattataacgatagatataaattcatacttcaaaatgctttcgaacatcggtttaaaactattggatattaccttccatatgccattatatcctcgagttgccatttcttgctcaaggtctgtaaatttgtcaacctcctacaggcataaccaaggaatataagtctaacgtgtgtcaatatagatcccatttaatcattaatatcaaagaaatgtgtttatagcatacaggttatattcatcaagaagtgtcaaaaaactaacaaactttatcctttgtatgatttctagttgacaatgttatatgcagctattgaactagcagggagtgaccatgtagactagtggccttgcaattccttgcaattttccaaatttcaacttttcgagataacataactagctccacgaaggtattaccacttttttaactattgacttagcagcacaacccttctgaattactgcagtacagcagttataaattacctgaagacataaaatatctggagaccacaaaccaaactcgaacactaacttttccttccgccagttccaatccatgatgaaagatggtatgcgctcataaagaaactggtgctcctgggccagataatcagctagtatattgtatgatagaaccttaaacctctctgcatgataaaaaaagatctactcaatataccaaaggaaaacacgtggtaattttaaaacaagaacatcaattccacacacataatgattactcgactttaatactcttggtctaaaacacaccatgtccatgggtaattatctgactgaattattcatatacggaaagtgtctacttttacatcttcaatacttctgaaagtttagttttcacccctcaactgtaaaactgaatagattacaatcataagcttgaaataaggtgtttgctcatggataagatgcccatggacccttttctgtttccctctcccattctctttgcccattatcctgtcacagaacaagatagttagctgtgatattgatttagctgaggagagaggggaaaggtaataggagggaaagagaaactgtatcacttttccaatgccttgctgtggcatcagtgctagcatggcagtggatgtggcgctgaagtctgtttcaggcttgatcggttaggggtgtaatttatctggtatagaaggttcagtggtggttttcatccaccttgagaattgaggtgtgaacacgtaaacttttggaggagttgaggggcataaactaaatcattttccttcatatatcatatatcacataccacatggcacatctgttgtctaaaatcaagtgaaactataatccattactagtttagtacacaaaccaaattgaaaagctttcaccattttgacttcagagaagtgctaagccatcaaatattaagaaactccgatcattaataacctaaaagtttttccacacaaaaagtaaaaagcaattacactattttttacttcagagaagtgctccctggatggtttgctatgcgattctactactactgcagtgctaagcattgagacagaatatatcacagactctggaagatgttaccggcttggcgtggtggccgatgctgcgtgaatcgccaccgtcggcggtactccgctagccttggtgattgctgcggcgcaccaggcctgaagccggcgtacggcggccggaaccctgcatttgttggcccacgccagtacggctgcggatgcccctggacatacggattcggggtcgcgtatccgtactgaggatcctgtggctgcggcggcgggggcccgtagttgtacggcacggccccgtagggcgggcccggctgctgcgggtggccgtagttgtacggcacggccccgtatagcgccggcggcggctgaggcggcgcgtatccgtacagcgacggaggaggcccgcggccgccgccgcggcggagcgaatcgttggaggcacgcaccgcgctgtggtgggagtcgccgctgacgagctcggcgccggcgtcgtggtggtggtggggaggcggcgtgggtcgcccggagtagtagcctcgtcgcgggcgagcggatcctcgggcctgcaagagagagagattgaggagatggggagggtttagactctagaggcgaggaaggatgggggattcgggggagcaatccacgaggggagatgggcgggcgggcgtacgttgtagtaagcggacatggcggcggcgcggcgtaagaggcgcgggaggcaaggcgcatcgctttggcggcgctcacgacggcgacggcgggcggcggcggcggtggcggcgcggccgcgttcgacggtcgagtcgctgtgggggtttgaggcccgcgtgctgatgacgtaaatagtccttcagtacgggagggtcactttacgccttcggaaagcgatagcgcacatttgctctccgtgttcagatatcgaaggtgaaccatcgtatcggaattaagggctggtttggtttgatgtctaaattaggcttatcaatatttagcaatttcaatagtgtttagtgtctatttggtttgaagctaaattttggcatgcctaagaaaataggccatttcaatagtgaacttaggttattttggcttcaatctaaatataactttgccttaccaaaattagtcatgccaaaacttaccaaaatttagcattgacaaaatttgataaggtctatttaggccacaaaccaaaccaaccctaaacttttttggggttaatttcttgtgtttcaagggagccttgcaaatctctgggcctccctttctggcacacattgaacatggtttgaattctgatggatcctttcaattttccaacatgggatttcatataatatatagaaattcatataaacttttcaggattgttttacacgaatcagctcaattttccgttatagtcgaagaaattaaggtaggtaagaaggaattaaggaagaaactaggggaggttagccgaatagacgataggggaggagtttgtataaatcctccgttctacacgaggcctttcactaggagaggagtttgtagtaggctatcgtagagccggtgaatttaatttgaattgaaatgcagagggattagggaacaactgcacaatccatgtctatagagaattagaatgccaccattctgtgggcaaaatcacttaatactttaacacatcaacacaagcaaaaatatcactcagcatacatgtacgatgcaactaataagtacagtccagctgtagattgctgcaaccgcacaagtacacgcataaacttttgccaagcatggcttgctcgcatctataaacatatcccatggtaacgtatggtttgcttgtatgcctattgatactgcagcgagggtcgcctccttcgaggattgatgtgcctaaacatatcttcgaccatgcagcaattgtatatactaatctggggttctcgagtctcgactatgattactggaaaatgtttgtatcaacagatcctatgtagcatggcaatcctcggcacgcatcaagaggtttgttgcatcctattcgcagaaagtggaagctacatgagctgcaaagtcctcagacgctgctcttgctctggatccatctttggtggtgtataacacccgcgaaggtcctccaccacatattcctgcacatcatcaaacagtggaagtacagagtattaaacgagctgattaacaaatactactatttcactggttcagaggaaatgacaagtgatgacttcaagcagtgtttacctttgtgagctcccttttggtaagtatgtgatagtgtctctgcaagatcctctggacggctacggttgcagcgaagaagccatatgcaactccaagtatagcaaaaacaatgacaaatatcacagccagagcaaggcaagcttctattgaagcgggaaaatccagtatgccccacccatagcaacaattgcggcatccagccaggcatggatcattggtgttgaaagacgaacactgtactatcagtccaatgaatcctaccattacaaagaacaccactactcctgaaaaaaaaatgatttgacacagatatcagtaactagctttctagaagagggtgctaacgccttttacttgaggaagcttgtcagataggagtaataacttcaaaaattgtttatcaaataaaaataagttccaacgacctaaaattttgtgataattgaaatgttgccagaggtagagagtgttactctgggtgacatgtttgacctactatatagaatttctattttcagtgcacaagaaaaacatgagattatggttacagcagggaagcaagattgattttcattaattgtatgcttgtatgacacaatagacaagttgagtcatgagtcatgactacattataaatggtagtaatgagcatttaactgcagcagatcatgtcaaattatcaatcattatacgaactgcaatcagaactgaaggaaaagaattgcataccgacacagtagtaaaagggcacaggatgatttgataggatgtgttcccaaccatcagaaaaactgtttctaaattgtccatctttatccaacagataagccataccaccgatagcagcaatgacctgaaaagcaaggcagataaaaagtatgtcagagcaccataccaaaaacagaacggtgcaaaattgtagtaactcaggttcacagaggtttcaacaaaagaaataatatatgcagtcttttctgtgtttaatagagccagcatacatgtgaatgagaaacaacaacgagcaattagaaagaaaggtgttcttacagtctgtacagccaggaatacaaggaaaacatccctagcaacaaacaatcgaaacatcatcttgcgacacaggttgtcctccagacattcgacacggagatggaattgtgccttacatgttgtgcagtgagaaaaggcagttccttcctgcagaaacaagcgcaataaagcagtattgtaaaacaaggtctacaaggccacataacttgtaagattaagccacataaggggaaaaactatgccatataagctttatatggtggggtgaaagcacaataccttgccataaagtaagttaagtgtaataaagctaaacaatacactagtacattttaagaagccaactctatcaccatcaaaaacatctcactaacaagcatttgaaacagacgaagctttgtacactggacatataataagaataattcatcaaagactatgccttccaccaaggttacatatcatcggttcatcgcgttacaacagcagaggcgacactaggacagactagcagagctttttccggaaattcgtaaatccaatgttgggaatgtaggtactagcaactggcactttaccttaacagacctccaatgatcaaggcagtagcgatgcacgaactgctgcgtccctttgcacatacaaggagaaatcagctcatcacctgaagcagcacacgagcaacaccgatcagttaaacaggccccgcaccgcaccgtatcaaaccctaggagatttctcctcgtatgcattctcaggatcaaaaactcctccgcgtgccggcagtaaatataatctcaaacacctatgcgtcctggagaggtggggtggtgcggcgtacaagccgcgaggcgagggggtttaccgggctcggtctcggactcgaggcagatgcggcagcaggcggcggaggcggcctcgatctcctcgtcctctatctcctcgtcctctatctccgccggcgagcgcggcggcggcgggtgcgcgaggagggggtcggtctcggcggcggcagcgggatagccgccggcgtcgcggtgaatccgctgcggctcctgcatcgccggagcggagaagagaggggaaggattggggattggaaggaaggaattgccgaatgccggagcgcgcggtctgaggaggaaagcggagtagcggacgcaattattttctctttcctcggtcgtttgtgtttttttccccttttctttttcccggccggatactttggctgagctcgaggttcggggcaatttaactatttgccacttttaggtttatcaattattcaaatgtcttttttatatatatatgtttaataatttaccactgaagagaggtgatttcttaactatttgctacttttgcctatgtggggagccgtgcccgcatggaaagcgacgtgatcccacccgtcagcccctcccctctccttcttccccaccttcggccgtcgtatctcctccatcccggctcgcctcgccatgtacagctgctcgtgcgccgacgtcctcctgcggcggcagctggcgacccgcgacgacggtgtgggcggaggtggccacggcggcggggtgcgcggaggcggctgcgggttcttgccgccgtcagagctgacaatggcgcaggacgccggggcagcggcggcgcaggacgtaggaccacggcagcggcagcgctcacagctgagctgggctagctcaggggaaagatgtaggggttgcgacggccagaggtggagaagaagtagaggggaggggttgacgggtggggaccacgtcgctttccatgcgggcacgccacgttggttcgccacgtaggcaaaggtggcaaatagttaagaaatcacctctttctagtggcaaattattaagcacaaacctaagaagggcatttggataattgataaacctaaaagtggcaaatagttaaatttcccgagttcgggagacaggttctcaacttgcctcttgacacgaaaactaagcaaacaattagaacgagattagtttagtattagcctaaaaaacttgaaaataaattaatataattttttaaaataacttttctataaaaaaatacttttagaaaaatacacaccgtttaaccgtttgaaaaggcacacggaaaacgagagaggtgacttggagaaaaaaaaggggaaaaacacaacatttactctgtatccgattgtctcacttatatttatactccctctgtatatccatccactcaaaaaaaatatattatgttttgggacagagagagtatgtttttaagtcaaaatttaatttaaaaaatattttactgcgttttgttgtagtttattttatagtatttgttttcaccgttaaagatacaaatataaatttttcactcatattggaagcattagctttggctttggcttattagggcaaccaatgaggctcttaagccactaatttgctaatcaatatatctgaacggtctgatccaactattcttagctttggctttggttttttagggcaaccgatgagactgttaagccactaattgccaatcagtatgtctaaacggtctgatttgtgtctagaaatttgttccaataatggattgacagtcccaaccgtgaaatattaaaaacgtcaggtggcgtctagtcatcagggtttataaaactgtgggattatcgtggttatcacgtgcgataacctataaccttctcagtttttaaaaccacgatatacctcgagataactgtgcggttaccacgataatcgctaaaccgtagggtgacggtaaccccacccaaaacaatttgacgaacccttctagtcgtacgacttgataacagtgggactagataatatgttccgatccgagtcgtagctgtgttacaagcaaattgtcaatttgatggttgtaaccccgttcgtttctccaactaagagttggatgtcaaactgctaacagtgtgtttcatgtgaaaactcaattaatatgaaagttgttctaaaatataagattaatctatttttcaagtttgtaataattaaaactcaattaatcacatgttattaccacctcattttgcgtgaaacacttaaacttttatcttcatctgaagatcatcttcaggagatttagagagatgtgaggcggtcaacgcaaacgacgaactaagacacgcatgaattgaccagatgagataaaaaaacaaccatttccagcaagtcagcaactaatacaggcctaaaaataatgaacaaacttgctcctcggatttggaatgttaactttagcattcatttattgcaagtaaatggtcctctcaagaatacgcttccatcatgacatacacaaaaccatttcgtccagaggttctcctgtaattaacagacaaatttgttcttacatcagaggttgatatgcttatataaccattgattttcaacaaatagagaatgactgaataaccagcataaatggacgttgttgatcttgaagtaactggtttaccatttaattatgattggaaactaacaaaaaaaataaaattgttggaagctcctgtttcaaatttatgaatcgtgtactgactatatatggagtgcatgcaaatcatcactaacccctagggtgtgttcggagcttctagttccctaagaactcttgaaggcataaacactgagcaaaatccacaaacagggaggaatgcagaaacaatgtaatccaaagaccatagtaacatttaggcatacctcaagtagtaagtgtagcttgtaaatacaatgcccccaatagcaccaagccctagaagaagaataagtgctaccaaccaaccagacattccattcttcctagaatttgtttgctctgccatgtcgacaccacagctctgctcattgcaagcttcctgtcttgcaggctgccaaacaagaaatttaacaagtgagagggaaaaaaattaccagcacaataaagaagaatatatggcatatcgagaataaaggtactctatacttaaatatgatatgaccctgttttcaggagcttagctttgaaacagttattttttttaaaaaaagaaaaaaaatagtacatcaaacagccaattaaccgacaaggtacagcgcaggacaatgatttttttttcttgcaggttcattgcttatgcttcccagttgcctaccaaacaggcagtgcctgtattacagtagaactgtagaaaggtttggtcaatcttcattagatccaatgataaaacattaatttcaaagccacatgtattaatcaacatcagattcatctattctaaaacatcaaatatctgatcccataattgtggagttacaatgatttggttcaacttttgtgattgataacaagcttcaacagttcaacagtaattatcttgacgaaatgcaaggttaagagtaaatcagaaaagagatgataaatcatgcatgaagccaaacattaagagctattccagagaaagtacaaaaggcgatcggaaacattaagttaagaaataaatgtaccatatgtgaaaaagaatgaaagcaaaaaggcaatatgcactactatagaaacattatgaatttgaacagccctcactgaagtaccatttcatctgctgaacagctagcatcatctacaggataatgtttgattgtggcatcagataaatttccataacaagcaacatcacgataccgcacaccaccatcgcatggcgaggagcacttcatccatggtccagcaacccaatgatagatttctgcatatattagtatactaccaatcacttattctccaagtaatgtatcaacaattgacaactgaatcgcctgtgaacaatttcagcacaaattatgaacggtaaagaaaaactgcaaaatggtctccttgggtagtactaaatttgagtgcgactctagtgcaaagaataaaaaggtagaggaaacattttaatggtaaattgagcaagaacaattgaaggacctaagaacatgaaaagaactaggaacagccaaatatctgaaagataaatcacagaatattttgtaaacatcaaattattccatgcaaactgcaggattcacatgttcatgaacagttaaatataccgtgtggttttaactgcattgatagctcagcaccactcttacagtaacccatttttctatgcttgatcagaatggttgggtcagagcaatcagagcagcatacaaattctttgccaaaatccagcttgttcttgcaatgcccacatttgtttgttagctttggggtgcctgtccttcagaatataaacaatgtattagaacaccagagtaattcattacaatgtttctgtaatgtttgaaaaggatggtctagattctgcgcctacttatgctaaggatggatgcagaagactaatgtagaatatagtagatgattgagcaactttccaacaatacatatacccatgcacacacctgttatgcagcaatggaaatgtttgtggaatggaagacatggcgggctttttgactccgtgcaaagaccatcacaatcatctgattgagaatctaagaagtggccagcagaacacactctagaccatttgctttggcacccagtccagtagcaccctgcatgttgaatgttacacttctatcataatgcggtattgctgactttaccatgagtccatgaacatgcatgacacatatatttagcataacttaaaattttccatgccatgaccaagcaacttaaaaattcccaagaaatgccctgaaaggatattttaatagcataactgtcactaaataaagtgaccgttttttgttcaatttaccaatcaagtgagtcatgcagggtttataagtattccaatcatttcgatttcgttagctggacataatctccagtctttggaattctgagttttaggactacgcatcctggtttgcgaactgtgcagttattattagctcatcagtgtcacgtaacaaagtagatcgaagaacaccgctagtccactactcttcaagcaactggacactctaagcaatttggcaaatttaagcagtcgactcgaaacctgggccaattcgtccaggaaccaaattattcatttcctgaaaaataatactactaacgtaaagtcgaatctcgaaaagccccaaatccaaatccaagtgcccaactagagtcctccagtccccctagtcctcctaacaccacatttcgacttctcgagctctccggagcaagccagttcctggctgggcttccgaggcagatgcattcggttaccgtgggacgggacgtcgaggcaggcggcgacggcgaggaaggggagcgccagcgcgcacagccgcggcagcgccgccgccatctccggcggccgccccgccgtcgaggaggatggccaagccacggcctcgtttcgttccggggtggcgcgagaggtggccggtgggggttggtgactcggtgcggtggcgcgtgccggcccgcgccgcggtggggaggggaagggttagcgagtcgctcgttcgctcgctcgccgtgcgccccccgtgtcggtgtcggtgtcggcgccgggcaggcagctgttttcggggggggctacgggtgggttgggcggtcgccgcgtcgcgcggtgatcctcctgcttcgggccttcaacgcgaagccggcgagcttgggcgagtacttcttttgcctgggccagaacagcactgcgacggaaattcggcccatgcttgatgggctgggactggactgagacatacgtgcggcccatgtatattcgggccggaacggtattaccgcgtacgtgaggccgaacaggtttcggaaaagctaattcgtgtgtacgtgttggcggcgcgcacgccggcccactaaggcccatgcacgcacgagctgcgcttctctctttttttttctttcttttttagccgccgtttctttttttttttgctgttttttttcctgccgtacggataggagaaaaaaatcgtaattagtttagattagtttcatatttttactagggattagtttactagtaattttaaatattaactttaaaattttcaaatttagatatgaaaattttcaaatatcgagttgaaagtttttaaatatcaagttaaaagtttcaaaattttcaaatctagacttgaaagtttttgaatcgagttaaaacttttcaaatcttgagttgaaaagtttcaaatctcaagttgaaagttttcaaaattttcaaatatagacctgaaagttttcgaatctgagttgaatctcaaattgaaagttttcaaatctcaagttaaaagttttcaaaactttcaaatctggacttgaaagttttcgaatctgagttgaaagttttcaaatatgagttgaatgtcttcaaaatttgaatttaaaatttaaatctttaatcaaaagtttctaaatctaacttaaaaaatcgaaaagaacacgtaaatgaattaaaacatgccgaggagaagggacgtgaaaataggagaaaaatcaaggaaaaaaagagagaaacgtataagggggaagggcgtgggccgtgcgcacacgcgcaagtcaagaagccccaacaggtttggtccggaacgggaggccgacacgcgtgcggccatgtactatggcctgtgggcgtgtagctggctgtagccggttgcgacaactagctgttaacgaccaaatttggtaatcgtcatcggagatgaagattagactgaagcagaatccaaaacagagatcgtcctggaaacagagcgggaatcagctagatcagaatcggctgcggctttaattggcagagttcgagtcggacaaggttagcgattgagccgaatccgacaatgtgacacggtatacgttgtcaggttgagttaatgtgcttcatgaagattgccgtgcacggattgagtcctgagaaggcaactgtatctattaattaggatattttatgtaatttccttagagatatgtttgggcaaaagtctgccgcaaagacttgtggtatcttagagtttgttagagataagagtcgtgtccgacatggacgtattttgtaatctcgggtataaatagaccccgagccccatttaatcaatcgaacacacgttcaatacaatctcgacgcatcgccaccctttattttcgttttgtttcgacgagttcttactttcgggttgagctacatcggtttcgatcttcaactagaggtaaaacttattatggcggcttgcgttctcgggattagtgcttccatctttatgacactctaatattgtttatgtaattcgtcgaattatcatatatccaatataatctccggcaatattgctatctaacctccaatcggctaacgtctgttactagaaggcaaccgatcaggttaaatactgacgttgacttagattatataggatatctaccactctatgaaacatccaacggcttgattgtctagatattgtccttcttttcatacttatagctgcatcagttgagtttgaccttataagtcgtgattagaatctcaatctctagtctgcttttggttgctgattagggtagcatcggggtttcagccgatcttatctgatttaactacttttatcttatatacttgattgatatattaaatctgccctttatgttaaaatctcgttgcatttaaatatattaggcttttgtttggtatattccacttgctttgatatcttaatatggagtggtatcggagtattagccgatacatgctatatctatctgatcggctatgctatgaacatatataatcttgttgttaatatatatttcgatctaagtgatttatactatctcggcatggcgaccgatctaactcaatcacttgatttaagtatatatcgacataagaattatatattgctaatatctacagccgatcgagtagatttagttctttcttacttattcatgactgccgatcgatctacatatgacatcggctcaaagataaatgatacgtcatcggcaactagccaatcggctatcgtttatgaatttaaccgcggtttctttgtctttgtttattgttgattgcaggatcaaatcaactagcatgctcacacacctaaaggcaagcttttggacctgcattggagttaagcagatctcctaggcctcgtgtttttacatcaacactagcgcacagccaatcaacttcgagcatgtgcaatgggtatccctgatccgtgcccctactcatgccgtcggggttttactccggagctgtctcccagcagaggggcacaacccagctgcgaggcgccacgcgcctccctcctctcttggccccttttcgtcgagccacggaaccgggctccgcgttgggcgcaccgtggctaggggagtagctcgtgggcactgctcccaccctggatttttctcttccacccctcgccctagtagatccggcggtgaagaggagcatcatcggcgacggtgaagagagagaaagaggcagcgacgggcggagggagagaggcaactttgtttgtttagagggtgtttagattcaggggtgtaaagttttggcgtgtcacatcgggtattatatagggtgtcgcagggggtgttcagacactaataaaaaaataattacagtttccgtcagtaaaccgcgagacaaatttattaagcctaattaatccatcattagcataggtttactgtagcacccgtattgtcaaatcatagagcaattatgcttaaaagattcgtctcgcaaagtagtcgcaatctgtgcaattagttaatttttagtctatatttaatacttcatatatgtattcaaacgttcgatatgacagggtgtaaaattttaggttagggtctaaacaggcccttagactgtttgaggtaacttctctttaaacggtgtacttttttaacagaaaattttcaatatcatttggatcgaactaaacctaacgtcgtgtttggcagatcaggttgtgaacttctcttccacgtacgtaaaacggagtgattcattagcgtatgattaattaaatattagcttaaaatttttttaaatagattaatatatttttaaagcaactttgtagaaacttttctaaaaacacgttatttaaataattcaagaaccgtgtgtgtgcggaaaacaagacattaaaagttaggaagttacacttaaaacacagctttttaaactgctaaacggtacgttttttacaaaaagtttatatacgaaagttgcttaaaaaaccatattgatccatttttaaaaataaattagcaaataattaattaatcacgcactaatggattgcttcgttttccgtgccggaaggatgtattcccaacccaaacaaaagaaccgagccttagccatgatcaagacagcagatagggtgttactggttttctccccattcttcccaactgcaaactttcagccgaagaccatataatttgggaattgcaaagtcggttttaggagccagtcctcttccacacaagtctataatttgcatactcgagacacattactttgcatctgggccgcgatacgcgccccttcaacaatcaacatggcgaagctgatcatatctcagcgtcattgtttgactggctcttcgagactctctgtccacgccatgcgagtatgcgacgaggggcgacccggtgagatcgaagcttgagtctgttaccctgtaatgcccgaggcgccaagtgcccgattgagacgaatggtgatatatgggttcttgttctcacatctggtcgccgtaacacgacaccaaccatgcatccactctgccatcggtcgagccgagcatgagttctccctaatagtacattattgcttgtgaccggctccttaattcccaaatcatggctttgttcccgggtaaaaagcaccattccagtaggtaaaaaatattctaaactcttaagggacattcactccttgtttcactccttgtttgtacgtcatctaaatgattataatgaaactttaaaaaaatcaacaaaagatattaatatgtgataaatcactctagaaacatacaatgtcagatttaacttatacaagtaaaaaaccaattttgattgtgaatatgtgttaactagccatagtttaatttttttttcacagcgtgtagaatgaattttatcttgcatgtttgtggagtgatctatcacatattaatttatcttgttgaataattttttataactatttaaattacatataaataacgagtaaatgtttacttgaggtattagaattccctcctcgttcaagtatcgatattcgtttttagcgttattgtacatccgtgttagcttcttttatctcaggccttatttagttcgtgaaaagagaatttttaagtgtcaagtctgacgtttgaccggatgtcggaatgggttttcggacacaaatgaaaaaactaatttcataactcgcgctggaaaccgtgagacaaatttattaagcctaattaatccatcattagcacatgtagattactgtagcacttatggctaatcatgaaataattagactaaaaagattcatctcacgattttcatataaactgtgcaattagtatttttattttatctatatttaatgtttcatggatatgttcaaagattcgatataacgtttttgggaaaaaaaaattaaaaactaaacaaggcatcagtaggtcccccaattggctctattcgtcagatgagaaaaaggctaatcttgagctggcacggccatccatatcggaatcgccctgacctttcaagggcaatcagtagtactacctccatcccaaaataggtgtagccatgagtttctgcgtccaactttaatcatctgtcttatttaaaattttttataattagtatttttgttgttataatatgataaaatatgaatagtactttattcgtgatttatgtttttatttttttttaaaaaaataaataagacgaatgattaaagttaagtaaaaaaactatggctgcacttattttagggcagagggagtacttccagtagactactactcgtagcacaattacatgtaacatggtggatcgatctcggagaggggtccctactttggggtgatgatgacggactctttccatgcatcttcccttctagatctgacagtgacaccggtacactacaggtgcggggagagtgagacaaagacagcgaccggtgacaccgatcaatatctaacacacgcccgtccatcctccagtgccaatgccaacatttgcacacaagaaaaatgcaagtgtccacgcaccgcgtcaccgcgcgatggggcgcgcagagcggacatcagagcaaggataatggtgaactataagcaagctaaatacttacgtggaagagagagataaataaaagtggagagtgttggctctcatgtaagagctagctccacacaagttctaagaaatatatattaaattcatagagagataaagagagaggatgaaaaaataaagctaacctattatatatgttagctttaacattggcttataataagtagtgggctatactactaaacttgctctcagcgcactggcgcgatgatagcccgaccatttcgatccccgcgagtcacgccgcccctcgccaccgccggggctcgctcgctgcttggctcccgtcggtggtgcattggcgcgtgcgtgcgtgttcgtgcttcaaaaacgcaaggcgaagagaggtaggcaccgcgcgacggctttgcactgccttgtgtgtcggttgctgcacgtctcgctcacgctgcatgcgccacgccggatcagatcgcgcgcggggcgggacacggaccgggggggggggggggtgggtttggcgcgcgcggcgcccatcggggtcaggcacacatgcccggtgtcgatcaggcgcctagctaggcccccacctggcagagcaaccgacattgagctggccggcctagcttctcctctctctctctctctctcgccgggggccctcggccaccgcatcacgcacgcggccacacatcgatccgcagccggccggcagggcccgccaggaacgttcctgcactgcaggcgatcgatcatggccctgtacaattcctccctcccatcaccatttttttgaattatgagatgcagcaacaacttgtccatctgcactgcagcagcaacttgtaaaaacaattcgattgcacgcgcgtacagccaaattaagacagcgagtgcgaggtgtgcagcgtttctgttcttccatgccgtaaatccgaagcgagacgtgccgatcgacaaagatacgacgcgctatacacgtaccagcgctatctcttgtcttatgaccggcatacaggcacttcgatggacggacgcatccatccaaaactgacgaaggattcaatcaagtgagcaagtccaaagcacacacagaagacggacagaacagaccacagcatgaaagccggacgacgcgcgcggccttggattttttttttttgttttgcacacgcgtcgatcgacgcatcgaggaacggaaagctttaatccccagacagttctgcatgtgcttcggtttggtcgatgaaacaagcagggctactgcggaattttgcctgtcggtacgttagagcaagtttaataatatagctaactactagcttaaattcatttatagccaatctaactactatcacacttcgtcttagagtccgtgttataactggctacaaatctatagttcgctgtccttctcttttctcatttatctgcttaaaatatatttacagctggcttatagtctgtgctattgtacctgctcttatgcggcgcgcgctcgccaatactcctacatgcgtgatcgcgtggtttttcctggcgcgcgcgcccttcccggtgccgtttttactcgcggcgccgcgggtgatcgatccgccagctccgggcggtcactttcacatcaagaaacggagggggaaatagccagataggagtgcacggacggcagctagcttagcttctcgatcgatcgtcttctcgagcaatgccttatctcgggtgccataccatgtcgacacactcgcatcgcattatcttcgccactgaccgtcactgacatgtgggccaacgcattaagttagaccgccgacagcacatgcaggcgacgacgaccgttttcctgacggttgattgaaacggatcgtccgtttccgttcgttaattggtactactacctacgcgtagcgtgttgctccctaaacaactcccagatcaggcaaaggaagcatcgtctcgtctgcacgtactctaccaagaaaatgatcagcgccatggaggccagaacatgcacacatgcggtgcgacccctcacatggggcaacagggcatgctgcaaactgaagagtcgaagaccacggttccctccccatggataaaagatctggtcttttcagttatcagtgtccggcatatgtatggggatcaagtggtgggggcaaaaaaaaaaaaaaaccagtggcatgatcgggcacagctcgcgtcggaacaaggcatcgtgtcacatggaagaaacccatcgcttgttttatggaccgcgcggcgcgcgcgcgcatgcggaccgcgcggtgactcctgtccctgtgcaggttgacggcgagcacatgcctagctacgtcgtggtagccccctgcaacgtcccacgtacgcgcatgcaaattgcagcatcacgattggtctggaattgtacatttgtactctctgcaccagggaaaaattttgtccagattgcaggggagagatacggttggtgctgtgcgccgtgctgcgaatactgcgtccagtcaggcagactcgagctcggtcggtcacacgaacaggcgtgcatgcatgaggcacgcaggccggtcaatcgccttgcacgcacacacacatcctcgggtcgatctggccatctgggtcgcgtgctggtttgggtggaatcgagtttctagttttgtcttgcgttacgatttcccctgttcgggtgtgttgtaatcttgttgcggactcgcggagtcgcggtatatactcggtacatgtatattgcaatttgcgaggggggtttgggtttcctcgcgcaatcaagtgcgtatatacttaagacgcgcgcacacatgggcgccatgtgtcggttgagtatccttgtcagggtttgatccagatacatgatgctgtccggccttccagcctacaacatgatcctggaaatgatgtgatgacatgatgacacgatctgaacctacgatttccatgattaaactgagcttcacaacctcgggccacaagaattttcacgtgaagccgttcgaattgcatgcgagtatgcaacttactcctacatcacgaaaaatggtccataccgcaaagggaaaaaagaaagttccaagtgccatggtaaccagctcactcagtgacaaaagtggtgaaagattcctaaacaccggcacgccacagcgtccagccggtgcccggttgtgcgactacgatgcttgtcccctcgcaaaatcccatgatgaacgctaaccattaaccaacttgattacatacggcggcatctgtgttatcacgggaaccgcagaggcatacgtaaccgacgaaaaaaacgcggacgagatggcgaaactgcccctcgtcgtgcaccgcctcaccgggccgaaagccagtcgcgtgcgcgtgcagagagacggcgcgccgcacgtactgtacacgagccggtgcgcgcggtaggaaacggaagcggatcagggggccatgtgaccgcacgcagggcgtgtctcctacgaggccacgagggcagagggagcccatcatccgctcagccgaatcgccgatcggggacacgcgtacggcggaagatcccgtggcatttcgtggtagtaatcgaccaaccctaggcccgtttcgccggcagcttggtctataagttgctgctctgccctgctcggcctcatcatcccaagcggcacagcagcctcgagctgaactgaagcaggggaggggaggagaggagaggagagagcaacgcgttcaccgttgagagaagagaaggaagtaagacgagcgcaatgcgtcgcgtcacggtgctcgttctgctcctcgcctgcgcggcggcgcgcgccgccgccgccgtcgtcaccgacggtgagtgcctagcttgctcgctaactctgctcgataatcactgcgcaggctcagctctaatttcacttcaagcatccatttatgtagcatactgttaggaagttactgcggtttctgtataagctgttttgctgttctgatcgatcctatctatcagcggcaatgcggcatgtgccattagtgtctaaaagctcgtaatcaagctaagctgcctgccccgtgatgatttacgatcttggagtcatggagtgaatagtaggatagatcacccgggtccctccattatccatatactgacgaaatgtttcccccggtcgctgtcatagcatgaagccacgaactcgatcatgcgttgatcattggagtaccatatacagggtatactgtagtttggttaaccccacacggccaaatcgcattggggcatgcatgcataatcacaatctacatgttgcatggctggcaaagtaaactgaagtacacgtatagttaatctcctattaaggtgtcgtggtgtgcagcaccagatgccgaccgagcaaaagtagtagtagtacaactatacaagcattaaagcatatgcagctgcagcccatttgcaagaaactattcttgctttttagtactagtcgtgaacgtgttagatgcataatcagatatgttctctggtccagtgttctggactagtagtatgcaataatcagatctggagtatcatcgtctgccagcattaggcaacgtttgatgcgagagtgcttttgtgcgctctcttgatttggtttctcgtttgttttgccggccgcggccctggttgcgttgcatgtggtagatgggatggtagtgaatgcacctgggccctggccgagccagaggaactgacacggtcatacagccctactagctgccggagcccagaacatgcatgttacactaacatggaccctgtcagcttagcagtataccggtcgcagttccattaattaacagaacacgagatcagacagacagcctgcgtgcctgatctgatgctctgaatcgatctctgctaaccgcagcatcacctccaacaactttcttcagttgcaggctcgcagtgcagcggccgatttgaatatctgatttagtggattaatctgattaaattaatggtgactaaaaaaattaacgacgtgtgttgtgcagggctgttgccgaacggcaacttcgaggagggcccacccaagtcggacctggtgaacggcacggtggtgcgcggcgcgaacgccatcccgcggtgggagacgtccgggttcgtggagtacatcgagtccgggcacaagcagggggacatgctgctggtggtgccgcagggcgcgcacgccgtgcgcctcggcaacgaggcgtccatccggcagcggctcgccgtgaccaggggcgcctactacgccgtcacgtttagcgcggcgcgcacctgcgcccaggcggagcagctcaacgtgtcggtgagccccgagtggggggtgctccccatgcagaccatctacggcagcaacgggtgggactcgtacgcgtgggcgttcaaggcgaagatggacgaggtggcgctcgtcatccacaacccgggcgtggaggaggacccggcgtgcggcccgctcatcgacggcgtcgccatcagggcgctgtacccgccgacgctggccaaggggaacatgctcaagaacggcgggttcgaggagggcccctacttcctccccaacgcgtcgtggggggtgctcgtcccgcccaacatcgaggacgaccactcgccgctcccggcgtggatgatcatgtcgtccaaggccgtcaagtacgtcgacgccgcgcacttcgccgtgccgcagggcgcccgcgccgtggagctggtggggggcaaggagtcggcgctggtgcaggaggtgcgcaccgtgcccgggtggacgtaccgcctgtcgttcgccgtgggcgacgcgcgcgacgggtgcgcgggctccatggtcgccgaggcgtacgcggcgagggcctccatcaaggtgccgtacgagtccaagggcaccggcgggtacaagcgcgccgtcctcgagttcgccgccatcgccaaccgcacccgcgtcgtgttccagagcacgttctaccacaccatgaccgacggctcgctctgcgggccggtcatcgacgacgcctccctcgtcggcctccgcaagaagacggccggccggcggctgctcctgtaagacgaacggccgcgtggcatcgaacgccgtcgcattccctccattctatgaatatatgaatacaaggcgcggttaaacttgggggcagttggcacgaccaaagttgggtgctaaaatgggtagtattgctaggctcgtttttttggttttggtgtgtactctggtatatgtacgcgtgtgcgcgcgttgcatggttatactttggagctgcgctcgtttggtgttttgttgtgaagaggagaggtgatacgtggtgcaaggtctgtcacaaggggtttggttgatcaacttaaccggaggtgccaacctaaacgcaccatcagacattatgaatgggaagcattactagtgctcacttttttataagtcaattgtgtatttttaattctgttctaaaaagccagatcctttttgaaagttgagtcatacatttgagctatgctcgaaaatcaatcggaaacgaacttaaacatgtgtaaatgatgtatgaaagtaagagtaagttttatatttagccacattttcttattagaaaagttttaatttggatcgcttgtttagctatacttttacttcggaccagataacattttctttgtttgcatcttggaccaccttcactatacatctatttcatccccacccaaaacccgggtaactggaaacaagaggggacacacgccactggcgccgagtggcttgagttcagactttgcgcaagctccatccatgttgcactgtggtcaagcttggcttgctcggtttggttcggctctgcttggctccatcataagtggtgtcgatttttctatctcttcttatatgtaccggtttatcgtaaaagcaggtacaaatatttactacaccgttttgtcatagattttttttaataaaccggcacctataaagagctacatgtattggtttttaattttaaacccacatgtggtgttaggagttcggggaaggcttataggtgttgggtctagagttcccgacacctatagggccgtcccctatttgttgtttgtagtaatagatacatgaataacagaagtaggctaagtccctgtttgattcagcttaggattattataatctagtttattaggagtaagctgagacaaacaagtagattattataatctataagtcagattattataatctgataagctactctagaggagcttttttcagattattaagtggctaaagacccactacccctacatacttgagaaaaattacccacctatgccatcaaccgaacagatagctgagggcattatagactttagccattcaaacccaataatccatgccttcaataatccagacaaataaacaactcacagcttattctatgccagcttattataatccagcttatagtaatctggcttaataatctagattataataatcataagttgaaacaaacagggcctaagaaactttggattgtattatggagtaccagtttgctaaatttatcacaattgatttggtcctaagattttttttttttacttttgagacaattggtttccttttccgtaaaaaagagaaagaactatgattttctttagagagaatccactcattaccactgagttcggcatagttcaacaatatgccactgactttgtcgacatccataatataccatcgcctttcacttaacctctacactttaccatcaccgtcacacactgttagtttgcaacgaggaaaagacaagtatgcccttaggaacgtgaaaaccattagcactgagactatgccatgtagggcactgagagtgataataactatacaaagaataatctacaacatgaataaacatgtaaaaaatagggatagctcaacatattttaagtatgaattatgtacagcacgtgtgcaatataaaaattgtgcaactaaatcatatgagatctcacatcataggacaaagtagtgtatcagtgaggggtttggaaggaaaatcatccatggaaggtgcatagcacaatttgacagaacagtgcataaaatccaatgtccaagtttggcataaccaagttcgaccacaacatgttccaggacagaaaccaacacatggctaaataaacaagttaagtggcacagcaatcggcacgacctctttcgatgacgacgacggcaacaccagctcttcagaagggaagccgtcccttagttgcgagttgcgacggcggcgctgatgacgacggcagcaccaacggctgctctccacaaggggcgtcttctcccatctgcgacgacggctcttcagcagggggcggcactgctgggaacggtgctgggggcgtcgctggggacagtgggttgtggcgacgctggggatgatggtgggggcgacgctgaggacggaagtcgaggcgctgctgggaatggtgctgggggcgccgctggggacagtggtcggggcgatgctggggatgacagtgggggcggcgctgaggacggcaggggcggcgctgaggaaggctgtcaaggcgacactggcgacgacgaccgcgccgacgatggggacggcggtcggggtgacgctggggacggtggccgcgccgacgatgcggacggtggtcggggcgacgctggggacggcggccgcgccgacgatggggagggaggcggctgtcccgtaggattagggctggccatagcggcgaggggtcggtgggggcagccagcggatggggcgtcgcggtgggcgctgatgcggcatggcggcgggcggagaaaagccgcggcgtcgctgggaagatggcggcgctcgagaatggttgattggggcggcctggtcagtgctagggttagatggctcaaagggtatttcggtcattacgggaaaaaaataacagtacaaacggcgtataactgacagactgtggacggcgatgataaagtgtagaggttaagtgaaaggcaatggtatattatgaatgttgataaaatcagtggcatattgttgaactatgctgaactcagtggtagtgagtggattctctcttttctttatcctactatctctgtttaccttttctcatagatttttattcgcgcatacttagatcattcatagtgcaacaacatgacgagatcctcacaccccatctatgttgtcgctccacataggctaggcccatgtcccttagaggatcctcgcatcttgcagaggacacacgtgcctcatcaggggattaatgagcaacatgatattcacccacatcaaaccatcatccatggaaatttccttagttaccttattattagtggatgtacattagtttgtttatcttttttaagaacttatgtactttatttgatagcaagaagtttaaaataacatattatataagtgatggtaacttctcccatagaaagattagaaagatcgcctaaagtcaggcgactagggaaataacaagcatgcatattagtttagcccgatataatctcttaggtatttcgtatcaccaaaaaaaactatactctctttgtctcattttaagtgcagtcataattaaaaggcaacaaaagtaatgtactcagattattaaaaggcaacaaaaggaaaaacggaattaaaaaaaaggagaaaaaggcctccaaagaaaaaaagggaaaaaaaagaaaaaaaaaagccctttgacgttggaacagtccaaacgtcgagaagctactagccccgctagggttcgccgccgccttcccctcccccataaatcccaccaaccccccctctcctcgtctctcgccttcgccaccttcgaatcgaaactaatcccccacacctccgcgtgcctccccccaatctcgagcgcacggaagccgccgccaatggtgatcgccccgctcccctccatggcctctctcgccctatcaatccttcgatctccccccaatctcaccctcaccgtcgttgcgtttgttttttttttacttttttttaggcgctcccgaatcagcagacggtggactaccccagcttcaagctcgtcatcgtcggcgacggcggcacgggttagcctcgcgatcgccctcccctctcttacgatttttttcgatctgtttggttctaggttgcggtataggtgtggtgatgcttggttgatgcgaccttgataatggttcgctgaaccctagatagattgaacggagagatacagccacggttgttttgatttgtaaattaagatcgttgtagtggttgttttgatttgtaaataaattaagatcgttattatagttagagatagagaaataaggctgtgttattatagttttgatctggcaccgattaatctggcagactcgctcctcttcgagtacatagcattgggactcgggaaggggatggtggggaagggaggactgtgttagatttgatttgtcacggatgaatgtgaactctctggtttttattttcgaaaatttataggattaaaaatttcttgtttcctgtgctcgaaattgccaggctcgaaaatttctgtctgttctgaaaccaggcaatctttttgatttgcaggcaaaaccacctttgtgaagaggcatttgactggcgagttcgagaagaagtatgagcgtgagtatctgctcctattttgcattatcatgtattcttatggtggatcattgtgtttttcgtgttaatttgactgtggttgctgcagctactatcggtgtggaggtccaccccttggatttcttcactaactgcggcaagatccgcttctactgctgggatacagctggtcaggagaaatttggtggactcagggatggttactagtaagtattattacatcgattgaatttgaagtttgtctcattagttatttaggatcttcagccattttgtcattctttgctatgcctagcctagtacattgtaatttgtatgaggaatataagcactgttagaattttactattgtgtgagactatttctgtgattttagttgatcctttccaatcctgtatttaactattgtattctcatgacactttatgtgaatcctggattttgttgatagtgccttagtgggtgaattagaaagatatatatagttctttgtttagttcttgtgttctataacaatttgtgatgcacacgatgctgatatatgcttatggagagaattcagtttagctttgactcataatatgcatgaatgctggatttgagcatcatatgccatgcattttatacaactttagtactactaaatttgtgagaagacttcttatcttgtggcattctgctgtttgattgcactcatgggtaaagttactgtatgctgtgtgtaacaaagctctgaaattctatttattttgtactaactgtaatcatgtattccgcattgtagtatccatgggcagtgtgctatcataatgttcgatgttacttctcggctgacgtacaagaatgtcccaacttggcaccgtgatttatgcaggtatatcagtggaactgagcaaatacatttaccacaaactgatggttgaaactaataggtcttgattaattacagggtctgtgaaaacatcccaattgtgctctgtggtaacaaggttgatgtgaagaacaggcaggttaaagcaaagcaggttaccttccataggaagaagaacttgcagtactatgaggtgtcagctaagagcaactacaactttgagaagccattcctgtaccttgccaggaaacttgctgggtaacgacctcagttatcatcaatctttaattattcagcaacccaattactggattaaaccaactctgttctctgtctttgtcagcgatggtaacctccactttgtggaaacacctgctcttgctcctccagatgtcacaattgatctagcagcccagcaacagtgagtgttcttacgaaattgctctaccaggggtgtttaatttatgccttcaaattgttgaacgatttctgattgctctgtaatgtgcaggcacgaggctgaactggcagcggctgcagcccaaccactgccagatgatgacgatgacctgatcgagtagatttgcaatgtgctactttacatcgtcttgcgaggagccctgtttttaagcacagttatatcctaagagatcttttttgcctcggagaaattttcgtggtgtccaaggttaaatatgggagttttgtcggatatttgaccagttcagacaagttttggttatcgttgattgatgctataaggttacttcgggttaacatatttgcgcttatagctgtcgtatgatcaatgtgtatgatccgctctcgatatttggaggaaggtctgcgtgatgcgttagttttgagcaaatatttatcttcctttgccttcgaagcaaatattttatcctgtaaattcgggcgtcgcttatttatgctgtatggatcgcgcttaatctctgaagtataatcaaattctacgtggatagacggcacgattactgctagtctgctactactaattctgttcgaaggagttaacctgatgagaaactaatttgggatttctttacaaccgcacgtgtttgatgagtttgggggattcccttgcaatataggcgggagatgatcgatatcgagtgagaggtgtgtggactctggacgggagcccaacttggcaaaaccttttgggctttcaaagctgctcgacgggccactgccatcctctacaagtgatgaagtgaacacgataagagagaaaaaaaacatgataaccccccttaattaagtctcaaaacgtttatgcaatgaagtgcgatacgggcttcagcgagcttctcctccaaacccaataaccttgatatcttcgataatgctatcccaataagttaagtgttcggggtggggatggggggagtaagagggtaagatagtgttcggggatgaggagcttagaggtgagcacctgagcaaaggtattgtggggatagtagacagagaaggatggtggggtgagaggcacctcgtctgacgagtggttaggtggcaacaggtggtggtgacgaatccaggtataggaatcgttggagaatggaaaagagcctagaggtgagcacctgagcgaaggtgttgtggggatagtagacagagaaggatggcggggtgagaggcacctcgtctaacgagtggttaggtggcaacatgtggtggtgacgaatccaggtatgggaatcgttggagaatggaaaagagcgtagaggtgagcacctgagcgaaggtgttgtggggatagtagacagagaaggatggcagggtgagagggacctcgtctgacgagtggttaggtggcaacaggtggtggtgacgaatccgggtatgggaatcgttggagaatggaaagatggtagtgaatgggcatgagaagtgatagtggcacgcggaaaagctgctgctggaaggataatacggaatgggctggcggtagagatcgttgaaggaaggataataggaaaagggatggcggtggatgtgcccatcagcagggcggtggctagggttggctctttacatagcaaggtggagatgaaatctgggcggtggctagggttggctctttacatagcaaggtggagatgaaatctaggtttagatggttgatccaacggtcaagaatttgcaagatttgattgggcattttcatgtaaatgtactaaagcgtaaaacactatcgtaccccctttgtttttttaaatgtacgacgctattgatttttggtgcgacgtttaaccattcgtcttattaaaaaattatataaatgttatcggttttgttgcggtttgttttatcaataaaagaactataactttaacttatatttctacatatttaacttatatttctacatatttgtactatatttttaataagacgaacaatcaaacgttacgtgaaaaaccttcgagtcttatattaaaaatcggatctagtatatattatcatcactattctcaaaacttttcagagttaatcacaaatgaacccaacactatttacatgatgttcggggacatccccactccctgtcagcatgtagaaaatagatgggagagaattcatatagacatctatacacagaatctgcaatgcgaaactgctgataatggcagcttcaaacaagcaagcagcagcgttaattctcaggctttggaagccgcctcctgccaccgttgagggcccgtatcagctgcaggtgctcatcgctggacacgtggagctgcagccggagctgcgtcagcagctcctccttctcccacgtcagcgcgccggtggcgtggaacaccctcatcagcgcgccgtacgcgtccacctccaggcggtggatttgctcgcctaccgccgccgccgccgccgccagcggcggcggaggttgctcgttggccaggcgccgctgcattattggcgcaacggccggtcgcggcttcattgcggtggcggcgcgcgacttcgtcctgacgtcgtcgtcgtcggcgcgctcttctttgatgtgtggttggcattgcggctgcaatggcggcggcggcggctggttcgccgccacttgggcgtcccccggtgggctcctcggcgcggcgcggtcgccgttgtcgctctcgctgctgctgccgtcgctgctgctctcgctgttgctgctgctgccgctgccggccgacgagacggacttggcgtcgtcgtcggtctcctcgtcgctcatctcctgctgcttgttgacgaacacggcggtgggtggtggttcgttcgcgcgcaccacctccacgttgcgtatcctacgagcagctccccctcctcttcttccatggcgcggatccgcttcgagttggcctcgaccctccggacctcgccggcggcgtcgtggtccgtcgcgtggcggctcctcttgatcttggcccattggtgggagggggccggcggcggggcgaactgatcggcggcggggcggtgcttcgcggcggcggcgggggcgcggcggtttgcggcggcgttggggcgcgccgtcggctccctggcgcccgggatctcctcgccctgcagggaagaaggcgcggcgaggtgtcaggctacggaagcaagattccaagaagagaagaagagggttgggtggcggcggcggccatggataccttgtaggtggcgacccagatgtcgccgtcagtcagcacctggcggacgcggaccatgctcgggggcaccgtgatggcgctgggcgagccgacgatcttgacggtgaactcgccctcgccgtcgccgtcgccggcgcgcacgagctcggccagcttccacatgcggtcgtcgagcgcctccaccaggtcgccggcctcgaggtcggtggggatctcgaggtgcggcggcggcgggcgcaccgagacccgccgtatgcggccggagacgacgtcgccgccgtcccaccggatgttgtactggtggccgttcccccacaccaccacgccgaggcgccacccgcccatcgacgggtccccgcaccacgcctccaccttgttccccaggttgatcctcatggccgccgcctccgcctcctccgccgccgccgctccaccaccggcttggttgggatcaagaagaagaagaagaagcccttgtcccttaccaacgcaagaacacgagaagaatcgatctcacgacgagtcgacgacgtccgactagtatataacgacgaatcggcgaggagacgggcgcggctcgatccgtcgagttcatcggcgagtcggattcgcgcccgcgtcgagtgcgtagatggaaacagattcgtgttcgagttcacggactagaactcgatcagggcacgacgaccgatcggtcgaggcggattcggcggcatcagcacagcatgaatccgagccgaggccaccccccgtctctcacatgttttttctttttttttccttcttttctttctgggccctaagcccaactagcagcgtgttgggccggtccaaaatttgttatgcacacaaaaaaaacttagggatacgtatgtacaaattttatagtgcaaactagcaaaattcccgtgcattgtaatggttattgtaatgggtgaagaaaattgtttcaatgagcatggtggctacgatagcgcaaatttcttgggagtatacattgtatattttgtaatattcatagtgtaggtggaattagagctaaaaatggttaagagcatgtccattcgataatcctctccagtctataataaaaatgtcatccgtatggtcaatatgataagcgtaacgttggggagagcagccaaccagccacgcctcgctctcgactcttgtggctcatgtagtaacggagctcgaagatcgggtcgcgggtcgatttacatggatgattataagaaaactattaataccactttaaaataaaattatttatcatagactaaagtttgaaaccatatatagtatttaattttatcatgtattattatgagtcggttgtaatgcatggttatttttttaattgatattaataaacagttttttcatatcgtaaagagtagccatagtagaagaaatgtttttcgctagctatcacagcaagctcactgcactcaaatagcagaatcgctttcactaaaaaaaatcagaagtaaattgtatgatgaatagaaaaaaaaggtgatcaggttaggtgtcctacgacaaatgagaaattgacgaggaaaacaatcttgatgcaaacacaattcgttttgttgatgattgtatttttctttaaaaaagaaaagcatgcttgttttattttttgaaaaagtaattcattttgtcggtgaatagcgtctacttttatctgatccctgtatgtgacctcctatttaagctttagtctataataaaaatgtcatctatgttgagtaaaccatttcgcatgcatgtataagaaccaacacgtgtatacagtatacgtgtagagtttgactggtcgtgtgatgtgtggacaatatatagcgtgcggactctaatataacatgtctcgtgaaaaaaatctattttttttcacaattattattctttatttcaaataaatattaaagtagaagtttaggctattttgatgccaacaataaaaagtcttaataaaagaaaatatttttgagcggaactgaatcccattgattagcacattctagatcacagtggcacttgacagtaattaattccagtctgaagctcctatttttttttttcaaaaaagaaacaaaaaagattgtactgttgtacattacgggacctatgtggtggttgagatccttatcctctcgctctcacggtctctctcccattttatccgtttacggggaatttaactatttgccactattagatttgttaattatttaaataacttcttatattttcgtagagagaacttctccactttttaccacttttgtatacgtggtgcactaactaggctgccccgtcatcttcttcctcccgacgatgatgaaccggatggtgctctgcgttggcggtgggctctgtgtgcgggttcctgatgatgacgctcgtcggtgttgtgtaggtcaagctcgtctacatcggctgcggcgccggcaacgccaccgcgtggggcgccgtcgtgcctctctttacgctcgtgcccaccgccatgttgatctacatcagcattgtcttatacgccttcacccactagctcaaccaccggatcttcaacaagcacaccaatgctagtagtctatactaatataaaaaacatcagttgtttcttttctacatccacccagaaaagtgtacccagaagtttcctaaccattggatccctcgatctaacgtctcacattgtaagttggattagcacttggattaatagatagattggattagcgcacgccgtcccccacacccatgtcccaatctcccacggtccaggcaagttcgatattttttggggccactccttttccatcgcgctaactcccgtcggctccccatcgccgccgcggaacaatcgcatcgctaccgccgtctccaccgcaccctcgccctcaccgccggctcaaacctccgcctcgtcgcccgcttcgcccatcgccatcgcgccgccgcctctcccctccaccccctaaccctaaccgcacctcaaattgcgtgaatattgcccgtctcgctgcagaatgatcctcttgaacgttgtcgcccgccgtttcccgccgctgtctcccgccggagccgcccctgcttccctgctcgcgccgcgatgaacaggaaggagagctggggtcggctcacaccgccaccacctctccctacggtgagcatactgtcacttttagtttttcattcattcatcagattcatttttcatccatctcatttagtttctccatctatatcagtccatgttcagctggtcacattcaacattgacacaaacaccttaactgatcgacatagtaatatagtatggatcaagacagtgttattttcaggaaattggtatgtcgagaggtggttctctcacctgaccatgcagacatgcagtacacattgaatccttcctctaaattatacgctgtgtgattctgatctgttaactttatacaggtcaattattcctgacagcagttgcttgaatgcttcaaagacttctggatccaacctgaagcccttattgtttgaggtcaacaagttcagggaacaatgaagaatcgttaaatacttcttttcaaaaagaatagttaaatactaaaagcaggaaggtttcatgaaaggtttcaacgagaggggaaccatgaatgagctttggttgcttatatcagattgctccttctgacgtaaattttgttacagcctttccacaacgtattatgcagctatcaaatttgtagctataaattcgatgttgtattatatacaagtattgaaatgaggtatgccctcatcttgtttcttggggaggaatagaggcaaatggcaaagggcgaaaaattggccatcagtacgtcaaatatcattaatttgattcttttcataaggaaagttgttgcttcagttgaaagtttatgattggccgttatggcctccacactagactgcttgttggatcttttctataggtttttcatattctggtttactgcacatgctacgagaaaacccaataagtatagctatccatatgtttcttgacgaattcagccaatagtaataactcagtcttaactggataaaactatgttctcactcttgcatgataactatagggctaactgaataacctgaaattttcagggcataatagtatgttgcatgccggtaaccctaaagtagcaatgaagaaactcatatgttacatactacaaatcccaaattcacgaatacgacaactttgggtaactttgagaatttaatcaagaataagtaccgttaatgctatcctgtgtttgtcaacgacaattatatttctgaatattttttaacctctgagtatatatacaggttatgtaaaaccctctgctactctgcttttttaggatttatttgtggcttgttttccccattgcccacaaagatcctgatttcactgttgaaaaaccatggccctgtttagattctaactgttttcttcaaacttctaacttttccgtcacatcgaactttcttacacacacaaacctccaacttttccgtcacatcgtttcaattttgacgtggaactaaggctgtgtttagatccaaagtttggatccaaacttcagtccttttccatcacatcaacctgtcatacacacacaacttttcaatcacatcatcttcaatttcaaccaaaatccaaactttggatctaactaaacatagcctaaacacagcccatgttttccagccttacacctgcatgatctggctagaatggaaaaaaacgaaaaagggttaattggaatgataaattaacatggatctatgggcctcgttgacatcgggcctggtcacgcataacctcgctctccctgaccgttaaactgaccgttactctcgctcgcacccgcccttgcttctcgggcggatccggcggcctccagtctagtccagaccacgcctccctcctcgagttggaacgccgccgccgactcccctctctccaagccagcacgtggcagccggcgaggagggccacgggcggagcgaagcggcggcgacctcctcccctcccgcacgcatatccttcaccaaaacttttgcaaaatcaatgtaatttgaaaactatcacttggaaaatgtttcaaaaggtttcctatatgttttccaagcctcacattgcaagaaaaatgatatttttgaatgaaaatgcccttttggctctcttttgaagaaactagattcttagttttggccaaaatgagattgagaaggaatttgagaaatgtttcaaaacaaagttggtagagaagaaagtttgtaatgtttttggtattcaaacctatttcaaaaatcaaatatttcaaaagttgtttgaaaatcaaattcgaccaaaaacccctatagaccataaaaggtcacctcctagcacttgagtgagttttgttgcaaatcatcataatcttcaaatattatgggtggttagcaatatttaaaaactcacacatttcaaaaattgctccaaaaatcaagtttttattgaattttattgtgtgggttgccggcttgtgcaaggactgtgcacagccagcagggggcctggcggtctgaccggcgctatatgcgcggtctgaccgaccaggtacggcggtctgaccggccacatagggccggtctgaccggccgaggtgggcctaggcagcttttgtcctttttcttgtcctttttcttctcccttcttcccctacccgactccatctcctcccattcagttttttccttccccaactcgaaaactctctctctcacctcccctcaaaccctaactccttcctccaccaaatcccctcggtttgaccgtggatttctcttcggttacaccgtaagtgattctcctccgcttcctctctctattccatggattggtttgtgtttttgttgagtttttgatccatggcttggaaccctaggtgaagcacgaggtgttcttccatttgcaccaatagatggtagtttcttggtgtgattcatctcctccaaccggtaaatcactctccctcttgtgcattcactcaaatcgatctatttcaccctagggctatgggtagttgttccaatcttgatgaaataggttcaaccctttgatgttcatgttccaatcctgtgctatattgttctagcaaattttagactcaaatgtgtagatgtgaaaatttttggatgcttgaacttatgggaggaggtttgcccggagccacaggccttctgaccgtgggtcagccgccggtctgaccggccggcaaccgtcggtctgaccggccaccagtgggcggtctaacttggctgatgccgtcggtctgtccggccaccatgggtggtctgaccggcctgatgccgtcggtctgaccggccaccatgggtggtctgacttactggctgcggtctaaccacccctccactggatataggcaaattttcacctctccaaattgtttctagaattattgctaatatcctatcatcctttgctctttttacaatgatgcctccccgcacttgccatggtcgtcgtgcgcccactccggatcccgtgagtgagcctaaggaatcgagcggagaggattacgctcacaatgatgaagaggttgaggcaaatgttgagggggctagtgaggtggcaagtggagatgatgtcagtcgtagtggggaggatgaggatgaagaaagtgatgatatgcactttgatcccttcatccagtttgtggtgaacatgaggaatccagtacagtataccatcttgaggcatcatgatcagttcttgaggcttcgggacactccggatccccgttttcacaccgctttccagaagactgtgtatgagcaggtttatgcagggaaagcatttgcagagcataagtggatttcttggagagacatcaatgagactccagagtttgagagcttgcattatctcttcaagactgttggcattgaccggattgtgacccttaagcaagactacaatgaagaattgattcgacagttttatgctacagtgtgggtggctggagactatagtgagatgaagtggatgtctgacaccctctagtgttctatctctcggaggtagttccggcggctcctcaatattcgcttggattttggagatgatttgcatgaggagcacactcacaattcattctccatagactatctctctcagttctatgaagatggagcacggtacacacatgggaaggttgccggcttgaggactatccccagtgtggttaacatgattgtgagagccattatcctccctcgcattggcaacaatgatgacattaggggggtggcttggcacgtcatcgatgcaatcattcagggtcgtcagttcgacattgtgtctctcatgatgcgagagattgctatctccaaagggacattcactcagggaatgtattatgccccttacatcatgaggttgattcaagacaagcttggggctacttggcaaaatttgaagaagcacaagcagtacaagccctatcttcatcttggagctccccgtgctcctagggagctagctcaagctcagcacctcctcctcctcatgggtatgatccaaatgctttcttccatccatagtatgcttactttggaatgcaacccaatgaatacttctacccggtacttggggctattaataccctaagtgaaagcattcaacgcttgtctaccgggcatgaagcattgcatgaggatgttcgtggcttgcgcaccgatgttagagacttgaatgctttcgtgggaagattgcacactagagtgggtgcattggattctcgactacaaatgttggagagcacccaagcttttgtatatcatcgtcttcagctcgtcctccttctcctccataagaatgaagacctttttggtacttgatgccaaaaggggaagaaaaatgtccttaggtgtgctttatgtcttgtcggttgggactagtagtagtgaggttagtgtcctcatatctaataggttaaggtggtttgggctatattttgtatgggtatgggctattactctatattgtgtgttctttatcgttttgttggactctgtgtcatttggacccttcgtggtcttgtaatagcctatgtttattagtgagcccttttaggatgatttgtgacttatgtgatttgaatggttaagtgatgtgaacttgtgcgatgatggatggtgtatgtgatattgatatatgtgaccatcttatgcttatggatgaatatttcttgaagttcacattgaaatattgcttatgtgtttgtgcttgttgaaatgtgaaattgaaatttgcattggctccatatttgttgtctatgattgatatgcacatgtttaggggagcttttgatttcctttgcaatatatgtccatatgttccttctttgtttatatatatttgttgtgtttgtcatcaattaccaaaaagggggagattgaagcatctaggcccccgttgttaattttggtaattaatgacaaacgctaattgtggactaactgttgctattgagatatattttaagttaggaccatgtcatgtatgcgcatggatgactatcaatggattaaaatttgatggcgcgaagcgaaaaaaagaaaacggtaaaactagtgctttagttttaaaattgatcgaggtgaagggcgatcaaatttgctagtttattttttagtttcgccgtactatcaagggggtaatgacctagcaatgagatgattttaattgccacattaggtcattatgcatttagacttgtgctcacattttatctcacacacacaatcactttgtatttcactgggttcggcctgaccaggggcggtcagaccggccgctgtctaaccacatagtggcggtctgaccggcgtgccccggccggtctgactggccacaaaacggtggtctgaccggcgcataaggccggtctgaccggcggcacatgcgcgatcagaccggccccttggaggccgggatggtgctgctcggggtggccgatacagagccgacggagccgtattcggtcagaccgagctgatggcggtctgaccgagccgaggccggtctgacccgccactcaacgtcggtctgaccggtcaggcctatggggccctctgacagagttacaatggctagttttctagccgttgcagagtagcacggtctgactgcccacatacctccggtcagaccggcagagcacagaggtgggggatttcgccctccatcagcaagggggctctcttggcacccaattcaattgcatacaccccttgcacctctctcacacccacttgagctttgtgttcatccatctagtgtgttagagggttaattagccaagagtcaagtgcattgcttccatttgtagagctagtgtggcacttgattgatcatctccacgccgggtcattgcttgttactcttggaggttgccgcctcctagatggcttgtggagaagttgcccagtgacctctccgagaagattgtggaggagggccggcgctggttgtgagtggtttggagttcaccaccttcggagtgaaggaagaactaccctagtgatcgaggcttgggtagtcctctccgtgggccggctcccgccttgcccaccccttgacgaagggggcgtgcggtggcttcgtggttgagcggtggagttgggctcgcctcaacggggagtaggaaaccggcgagtttccgaacctcggtgaaaaatctcttgtctccttgtctcatttacttgttgcatctacatttgtgcaatttacatttctagagacatactagagatcatttcaccctaggattgctaaacattgacataggagtgtgatttactttcttagagatataattgagccactatcaccctaggtttgcaaaacataacttagttgcttagttagagttgaccctcaccaagcctagcaacttaggttagttttgattaggtgtcatttagttttaaatcgtctattcatcccccctctagtcgacatctcgattctacagagttgctcggtgacctctccgagaagattgtggaggaggcctggtaccggttgtgagtggtttggagttcaccacgttcggagtgaaggaagaactaccccgagtgatcgaggcttgggtagtcctctccgtgggcggcttctgccttgcccaccccttgacgaagggtgcgtgcggtggcttcgtggttgagcggtggagttgggctcgcctcaacggggagtagaaaactggcgagttttccgaacctcggtgaaaaatcttttgtctccttgtcttatttatttgtcgcatttacatttgtgcaatttacattcctagagacatacttgagaccctttcaccataggattgcaaaatataactgagttgcttagttagacttgtccctcaccgagcctagcaacttagattagttttgattttgtgttatttaattttaaatcgcctattcaccccctctagtcgacatttcgatcctacaagtagtaccatagcttggtctctcttgattgggcttcaccgcctagagagaagatat

SEQ ID NO: 59777 - DNA, 6897 bp, Oryza sativa
tcgtgttctcgcgcgccgacgccctggagagcgagagctactgacttccgcctctgcgaggtcggcgcgcgcggcgtggatcggaggccggccgattcgagcccgccgaggtcgcgtcggtcgacggcgccacgtactgcgccgccgtggacggcgggccgatcatgggcagccccgccgccgccgcaatcacgcacgtgcttcacaacaagcacgagttcccgttcgtgcgcggcgtcgaggacctcctcgtgctctccatcgggggatgctccgccggtggcacgggggccgcggccgacgccgacctccgacgcttgcgccgctggggtcccaaggattgggcgcgccccatcgcgcgcatcgccgccgacggcgccgccgacctcgtcgaccacgccgtggcgcgcgccttcgggcagtgccgctcgtccaactacctgcgcattcaggtgagcaaattctcccactgcattgcgcatttcgaacgaacgttccctcggattaaccctggtacaaattctccgccatgatcaggcgaaacgggagagcatgccgccgtgcgggccggacggggagtacgacccaaccccggcgaacgtgcacgcgctgctcgcggcggcggacgagatgctgaagcaccggaacgtggagtcggtgctgttcgaagggaggcgtgtcggcgagcagacgaacgcggagaggctggactgcttcgccgccgagctcgtcgccgagcatcgcagcaggggctcccgtattggccccaccgtggcgttcaagcaggcgccgcggaagcagccgccggcggcggcggtggcggcgatgggctgagccggtggccgcgtgcactgtggagtaaggacatgtaggccctctctttcttcttgctttcgctggaatcctgctgcattttttacgtggcagagtggcattgctccaagaagcattttgccaatgggaaattcgacttggagaaaatatgaaagaacatctgtgatatataatttcagcttcatttcaatttagcatagaattgtactagtatcatctttcttcagaatcatatgcttctttgttttctcttcacatactttgatgttggtgttcagtattaatcttctttggtaagtggatgcaacggcgatatctgatggtgatcttcagaagatcaattttcatgggtctacctaccaagtggtcagtggtgtggtgtactgaatatctgaatgcatttccagttcaaagtacttctcatttccagtactgaatatctgaatatctttgtcatttccactacctttgcttgatgactagatgacccatcaaccatgtcaactcttgcttctgctacttgcatatacttccatttgagcattcatcagttcctacagacatctggatgaacctacctaatacctgcaattatgtctgggaacctcttcttcttgttcatgaaaaaactaaacacggtcatgaacattaacgttcagcatttcagccatgttgctgcactgtattttcttcagaagcaaccctatgcaaacaaaaaagggaagacatatttcagatctttgtctgcgataagaaaaaggagagaactgtacatgcatgtcccatcgccatcctgatcctgatcacaacgtacaccgtgttgtttaaagcgtctaaagattcctccaagtacactaaatcaagtaacctttgtttttacagcaacaaacacacacaactcttcactcttcagctcttctcaaaccgtcggcagccacatagaaacaattaagcaaacctttcatgacaataatgagctttgtcactttgagctgtttcttcggcttagctcagttgcatagtcgcgctactgtttgtgcaacgccccattagctgacacgcgtggtcgctgtcactaagctctcgcagcacttgttgattgcaacgcccatgatctgattggaggccacatctcggctgttcttggatgttgtaatcatctttcttgtcgaagcaggtttggttctggttttggttttggttttgggtttggtttggtttggttttggtttggagatgaacacgtcgtgtttggagaccgtgatgggaatcgggcggtggctgccccatgattgctggttgttgggtttgggagtttgcagcatatttcgctgtccgaagagaggatcacatcaaacgccaagatgccggaatagggcgcccgtccgtaactttgtcaaccgacagagatcattagtgccactcggttgttagttgttacagcaccctgctactaaccctgaacctttgcccctccttttttttcagtcttcttatctcctcgttctgaattcatgtcaaaaacagataaaagaagagtgattcatcacagccgttaatacttaataggtatatatactcctactagaatttgcgttcgacgtactgtctggaatgcaaggattggtcgtcaaaaactgcaacccggaaacgtcgtaccggtgcagatttgaggttgtggagacggaacagtggaggtttagtggtacaccgatcagtggcagtagtaattgaggttttgcacggtgtttggtgcaccgcctttgttggatcaggtcgtattttttggtgttatcgcccggaggcggcagcgggaggagcacggcatgcaacgcacggagctactaccgctcgcgaccgagcggggcatggcatcgctgttgctgtcgctgaacaccacgtcgcgatcacatctcctccctccgttgctcgtcccgaggggcggatctaacatgaagacgaaaaggctcaaaccctcattaccgcggaattatgaaaacagactctcctttaaaattctttttgccaaactaaaaggggttaaagttctactatttctttctgtatgcgtcagtgctcaccatcactttcgcgtcggcgtcaaggtgttacagcttgggtgaaatgcccgacacaacacaaccaacaaccacttcatgatccttcactatatagcgtctctgttattagctggatctgaaaaaatgctgaacttttttcggtttcgataacttttatttttaagaactagggctgggaagcaggtttcgataacttttgtcatattatatcattcttgttatgaaatgagggtttttattaggtgcgtttagttagtagcagccacatttttatcacggttgattcggacatcattcaccttttgagcttgtttagttccaaattttgattcggacatcattcaccttttgagcttgtttagttccaaatttttttttcaaacttttaactttttcatcacatcaaaactttactatacacataaattttcaacttttccatcacatcgttttaatttcaatcaaattttcaattttggcgtgaactaagggtgtgtttagttggggaaaatgaaattttttgtgtcacatcggacgtttgaccggatgtcggaaggggttttcagacacgaatgaaaaaactaatttcagaactcgcctgaaaaccgcgagactaatcttttgagactaattaagccgtcattagcacatgtgggttactgtagcacttatggctaatcacggactaattaggcttaaaagattcgtctcgcgatttcccccataactatgcaattagtttttctttttatctatatttaatgcttcatgcatgtgtctaaagatttgatgtgatgtttttgggaaaaaaatttggggaactaaacgggccctaaacacacccttcggctgtgtttagttcctgaaaaaagttagaagtttgaaaaaagttgaaagtttatatgtgtagaaaagttttagatgtgatgtaatgtgatgaaaagttggaagttgggggtagttagggtgaattaaacacggtctttgtagacttgtttgactgtacctctgtggctaaactttgaaatgatctgcagagttgtaccgatacggatatagtactagttttttttttcctactaaatataggcctgattctactccatatccaaatgccatagagtagcagtttagcacgttgtgccgcgtgggttccatttcgctatgctccatatatccataatatggttgtgtttggatccaaacttcagttcttttctatcacattaatctgttatacacacaactttgcagtcacatcatatccaatttcaaccaaaatttaaactttacgctgaactaaacgcagcctatatccacagaggcattctctccctcacggttaaacatgaactccaccgggtaaattcacctttgcttgagatttgacaggtcaaagtgcacgtttcagaaccgaccgtttggtcgttagtactggcacggataggttatctggttccccttaatctgcgccctgcttttcccaaatttttgtgctctctttgcatcgaaagacgagaaatgctgtcccagcaaacaatgacaattctttcccgcgacgtgcagagcacataacaaggggttctgtgggtttgtagccagtaggttagaaaaaggctcgtggcaatatattgtctagcttgatgcataatgtcgtcttaacggactaatgtttgggctccgtaaaacacagtataaattttacagaattttcatagaattttgtttaattcctccaagagcccttcaaaattgcacctagtatgttgtatgctgaaactttttttttcatggctcctggggcaattcaatttcaatccaatcaaattgctacaaaacttttaccacgtttatggggtcaatcaatccaaacttcaacatcttcatatatatgtaaaccatggggcctgaaaaaaaatgcaaaatgctcgtctggcttgtcatgcagaacagagaccaaaatttgcacaaggagctttccggtatttcactgggagcaaaagaagagcccataacttttttttttagataatagatttccattaatctagcctctatatccacgaaggatatatacagccaaaatgatacaaaagtacttaggctcacacctcaacaagaagaagaacacaaccaaaaaagaaaacaaaaccaaatgacctcggcacatcctgcttctctgcatcctgccatagtctcttgaaacggccagatttgactagtggaagtctaccagtcgccttcgcccctagtgcaccgtcgatgcaaacctccattggtgcaatcttcatcaatttcaggtgagctgacgtcacacgcagcttgttagcccactctcaatcgtcgtcatttgtcgtatagtcggaactagccaaccagacacaaaccgacgggatcgactttgacctcaccgaattcctagacatccactattcaaagtgctgccgctatgctccgccgcagcccctagggccgctggtgccgataggaaccgccgctgtcctggacgaccgcagcccctagggccaccggcgccgacgatagccgccgcagcccctagggctgctagcgccaatgggagacgccgctgtcctccgccgcaacctctaaggttgttggtgccgatgggagccaccagcacagcccctagggccgccaacgccatcgggagccacccccgtcctccatcgcaacctctagtccgccgccaccacctggaaccgccgtcgccacaacccctagggccgctagtgtcgacgagagccatcaccgtcctccgcagcagcccctaaggccgcctccgccgacgggagcagtcgggccgccgccaacctccgcagtcctctgccgcccccaccgccactactacaaaagtgtattttctgtacgaggccccttgatttttgcaaacggaccataactagtggcgtctgcaaaaatcgagggtcatttttgcatgcggcccctttagtggcccgtatggaacaatcgattttcccatacgggcctcttaagacggccgcatgcaaaaatgagctcatttttgcatgcggctcacttaagcgcccgtatgggaaaatcgatttttccatacgggccacttaaggaggcatatacaaaaataaaatttaaaaaatttgaaactagtgtatctcactcatatgcactccaaattagatgattcttttttctaaatgtttctaaaatcatcctctatcatgttattgtgttcttactgctattattttggccattttttcttgtgactttattttatcaattaaaactttgaatttcaaaacttcaaataatattttgaagcagtaattgatttcagctgaaaaagtcatcaacaacaaagttgtataacacatcaagatatataacttttattttggtcatttttttcatccgacaaagatttttgtaagattgatcacaaaatgtacatctctcttatagttttataaactatatagtattttaaaatgttgtttgaagttgttataattttaaattcaaattcaaattgttcaaacaaagtcatatagaaaaatgaccaaaacaaaagttatagatcttgataagttatacaactttgttgatcacaacttttcaatttgaaatcatttattgattcaaaatattatttgaatttcttatattttaaaattcaaattttatatagctcaatcaaacttggatggagaaatgaccaaaagaaaattggtagatctcaatgatctctacaactttgtttttgacaaccttttcacattagttcatttaataccacaaaattagatttaatgttcatttttatctagaagtctgatttgcctcctctccctctccaccacttcaaaatttcagcaaccttatctccaaccttatcttctcttatctcctctccaccattacttctcctcaactccctctccccctctctttctctccccctcacacacagcaagacgggcgg

SEQ ID NO: 59778 - DNA, 2377 bp, Oryza sativa
tggttaaaattatttctagagctctgaaaatttcactaaaaatcctgttaatgaatttcgacatgtagaactcaagaaaaattccacatgtcaattccgattattatttgcattaatttattagggttttctctcttgcttttacaccgatattttctctaggtgatttataaatctaatttaggcttggggaaagaacttcaaggtgtgacaggcacccccttgtcgaaacctcccaagcaattggtgcaagctcgctctagattcatatcctctcgtggtggcgctctagcttctgcaagttagccacgtcggagggcctagggggagagcggttccattcttctctctcaccctctttccctcaatcccaaagatttggatagagtgggtattgtattggttgtaagggtcgggttttgggcgatctcggttgcattccgttgttggcctagtggcggtcggtcacgcttagcggcggctgacccggtgctagccttcccctaggtggtggtatacttttttcattttcctggttacgaccaatagggttgtaatcttgtaattttttcctgctttataaacaaaacttcgcactatcgggtgtgattcgttcaaaaaaaataattataaattttgaaatcatttaatcaaaaaaaacatataattgagaaaccaaaccgaggacaactctatattcattaattgtaaattttagaactattaaaccatgaaaactataattcaaaatttgaactgagtacaacttaatatttattaattacaaatttaggatatattatatcatgaaacatataatccagactacaaaacagtaaaaatcaatatttattaattacgattcaggaattattgtatcattaaaggatataattcagactacaaaaccgagtacaactcgacacttataatttccaaatttctaaactaaactatgtagtataacatactaaattgagagtacaacatgcagcatgagtccaaagtagtaatatttagtaattttgattttgaaaaaaaaaataatttaatgcgatagaaagtaatggaagaaatattaggacagattatataaattaattactaattattttttaagtataaataaaataaaatcgttcggctattaaacctttaatagagttacgtattgaacaaatatttgaaatttttaatatttataatatcagtaataataactactcgtatgaaaggatccctttaggcacacacgtacctcctctcaattactttttctccttttttcttcctatggaaatatttgcaacaatagcttttaaataaccataacttctaaattatatattatttgtaacaatatattttaaatcatcattttttttaccttttaaatcatgcaaatggacatcaaaacttttgaaaaaagtgataactagattgtatcgattattatgtatcactttacaaacattcgtagctaaactagatataagatgtcaagaatgtaaagcttgcactagtattctttatgattaattagcagtttgacaccagtttacttcctttaaatttaaaaaagaaactgtcttggttcatattttaactcttcaagtcatttaaagccagctccagtgatcttttgactctcaaagaaatcatttgagatataaatcaaaagataaacttttttttaaaaaataaaccaaaccaacacctagaaaatgcactaagtgaagcacaaagaagcaaccaataccctgacagtgataaatttgccatgtaaagctcgatgatgatttatggcttagccacatcatggtgaagcactgcgtggcagcaggagcacaaccatggatgtacattgtggccaaagctaagggtgctcatcactagcaacttgtcgaacaaggaaaagagcaatatgatcgactaaaattagctttaatattagaagctataagatgatataagaggatacgggagatgacatatatatatatatatgtatatatatatatgtatatctatgtatatatatgtatatctatgtatatatatatgtatatatctatgtatatatatatatatatatatatgtatatatatatatatatatagtgccagggtactatatataggggtttgtttttcggtggttgacaacggagtccgtcagaggattgtatttggcagaggcagcagcatagtttaattgtgtgagagagaaagtgttttattgactttggttatgagagatgagtcctcctccactgaggaagatgtatggtgatttggattatatcactggtgcgagaaaccatctttgatcggtcgacccaaatctacaatagtcccggttccatttaaaaccggg

SEQ ID NO: 59779 - DNA, 12688 bp, Oryza sativa
gaccatttttactgctgtattccctctttagtcccggttggtaactccaaccgggactaaagatagcgatctttaatcccggattcgtagtcccggttggacaaccgagactaaagggggttatgaaccgggactaaaaagcacttctccaccagtgtatatcaaacaacaaaactatgaaaactcaaatatttatattgactacacgtgatacttgattctatgtttggtgaatgaaggaatacaattcgtactaaaccaatatattatataatagttcataagatagaatatactctcctagaattcacgcaacaaaagaagactaattcaaatgacggaaatcaacttttgtttatggcactctagcatttataagtgctctgcacatagttattatattatacagttgcaatattattacatattaaattcatcttcaaataaaataagaaagatgatgaaaaaaagaaatttaaatccaagatatgctaactagctagccacacagttatgtggatctttatttacttacgtactttatatgtaaaaggaagtccatacaacgactttgaattagatggggaaaaaaacaaattgtgggaatattttagagagagaaaaaaaggcaattttgattttgtatatgtggcgtgggcgtgaaaaagacagtgcaaactaatatgaatggttttagagaatagtgattaaaagtgagaacatctaaacattcatgtagaacattcatgtagaaaataacagcattaattacatctgtacttcaatgtaaatttgttagaccaactttttaagtcttaacagtaagaagaacgtccaaccacgtaattgtgcgggctatctttctagtttgtcatgttgtcatgtaatggaacatattttttttattagtccataaggatacttcaatagtatgtgtttacgtattcttttttataaatactaatttataattaagtaacgtgtgaatttgggaaggagtatagtgacagcgtgagtcaaacttactgtatatttattagtccttgaatcgatataatgtcaacgatcaaatatggagtacacggtgagagcgtataggccgggctgctaacataccttttagggtacggcataggcggtacataggccgtgttcagttcctccttcaatttttttttttacatatataaatgtacatttgaagtattaaacatatactaataacaaaacaaattatatatttcgtctgtaaaccacgagataaatttattaagcctaattaattcgtcattagcaaatgtttatcgtagcaccacgttgttaaatcatggcataattaggctcaaaagatccgtctcgcaatttacatgcaaactgtgcaattaatttttttatccatatttaatgccccatgcatttgatgtgacggaatttttggaagtttgaaggtaactaaacacaaccatattcgtccaagtgattgggatagctgattgacatgtttctagaaatacattgtcacataccaggggtgtgtttagatcccaaaattttttagccaaaaatgtcacatcaaatgttttgacacatgcatagagcattaaatgtgaacgaaaaaaacaattgcacagtttgcatgtaaattgagagacgaaacttttgagcctaattgcgccatgatttgacaatgtgatgctatagtaaacatttgctaatggcggattaagtaggcttaatgaattcgtctcgtagtttacaggcggaatctataatttgttttgttattagtctacgtttaatacttcaaatgtgtatccgtatacttaaaaataattttggccaaagaacaaaacacggccttggagtagaaccatgttcaaacatcctaatgagagatgaaattatcatgatatggataccacatacttaataatagtaggttactaagctcggcagggcccaccacataccatgtcttacacggaaacaaacctcgtatatagaaggagttccgaataaggaaggacaagaagagttctacatggaaacgacaaggattacttggattatatccatattgatctccctaattctacttggacaagggggcatctatgggtataaatacaagcctccctaggaagagagggaacaagccacaagacgcaacatatacacaagccaacacacatcgcccgatctcgacatcagagattagactaaacatactccatccggtacctacggaggccggcaagagggatctagctctatctctgatctcgacaagttcacgctagaggaggaagactaccctgtcgtcgactactagttggttatccatgccgccaagtccacgacaactagataggttatcccaattattgtacttgtgtgatcaagatgaataaagagcaacaccggcttcggccaacaggatgtagggctattacctgtcagataaggggcccgaacctatataaaaatctctgtctccatctcttttacctcaatctcgcatataccctggtaccaacgatccccataccatccaaataccgtagtcgtgatctcaaacgtcgacaatggcaccagtggcggacgcaggattaaaataaagatgggacgaagatgctcgtctcaataagaacaactaaacgcaaaaaataccatatttatgttgtaatcatataaacatatagtataatcaataaattaaggcaaacaaaaaacaaaaatgatattaaaataaagtaataatttttgcgccatacataattcatcatacataaaaagatactagtaaacatatcaatttgcaaatatgagtcaattcataagccatggttgatagatatcttttaaaaaataaatatatgagaagatatcgcatgcccagaataagatgattattattttgcttagaagggagagagagagagaaaaacattaggcacctaactatagtaggggacgggggtaagcagtgtcaaggaattgactcaggaaagcatcacatacgcatgattaaaattacacttgggcagcttatttatgggacagttgtgaatcggatgtggtggtagctggcccaagaaggatatggagggttggggcagagcgggccatatgatgaggatataactacctcggatataaccatgactaccttatgtattagtcaaccaaatgtgcatatgttctacattagatttacttgttatatatttgaacaaatgttactacacaatgatcaacttcaaacggacctaggcgctgatctagaaggaattttggggcccatgagtacttgttggaaagcttatggagtctactttcggatggttttggtcccatgtcaaaactcctaacgagctgccgggaatctgcaaaacaagccacgtacctcatccagtccgaatctaattttgagttttgggctctgtaattgtgtcgtgcgttagcccaatggggtgtgtgccctacgaaaaccctaggacgtccctaatcacatttattcagtagccgtcatcgtttaaagtcgggtttatcttagattattctgttgagaacagtttcgccgctagatcggtttgtggaaccccaaattcgagtgctaaatcaatctatcttgttcttgcttgtgttcttcgattcgcatgcagggattagccttctcggcgaggtcaactagatttcggcacggttgataaccagaggagacgtggtgctgcgattgcggggctcagtagcgtgttcattcagaagccggatcgagttgtgtcgcgactctgcccaaatcgactgtttatcagtacctattggaagatcgggacctaacatccctcatcagttggtatcagagcgtggatgcccgttaggtaatttatctttccataaccagaaaattgccacacaaaaatatttatactttacctagataatttgagccgttgcattgttctattagattttgctttgttgaattctagattgcatcgttatgtcaagtgttagtttagttttacatttcatttttagttttgagtattgcatctgttcatcacttaggtctagggttcatcactcaagtctgtgagttgtacgtcagttttgggtctagtttttcatctcgtcagttgttgccaggaccttgaaaaattgaatcgtctcgtcgtcgggtttccgtttttgtgatttggagaaatttttatcaaacggttttgaagatgcttgcgtgtactgtgcgcgtgaggagagactccggagttgccgtactgtgcgcatgaggggagtactgtgtgcgcgtgaggagagactccggattagatcagatctatccatgactgtctgtattttcctctttatagaattgttaagtagtggatttgagatatttttataaaaacggaacctacatgatatgagcaatctatttttgaggtgatccaattttagttttgcactttgcatttgagtccctgtaatattcatatttatatttgagtccatgttcgaggtcagtggttagttcttgttaaaaaaatatagtacaaaaactaaagaaagaaagaaaaggcacaaaggtgcaaagaaaaaaaaagaaaaagccgcacctaaaaaaaaggcagaaaggtgcttgaaaaaaggcgcaccaaaaaagaaaaaaaagatgagaaaatttagtgattcttttgagttgtatccagagtgcagagttgtggtttgagctgcttctagtccttagtattgtcgggtgcttgcttgagctattgttgagtttaggttaggccagcacattgactagaactttgaactattattcaactttgcattttcggattagcacaattgcgttcctttgctactatatattacacctcccaagctacacatatatacttctggttagcaccgctttgatccttgcaatcgccatatcacgtccttcaaggtgtcacgaaccagccaccggttgtaccgtccttagcattactggtaagacacttatacgagcttgatatggtgctccatttggctgagttgttgtgaggcaccactacaccgcgtagcagattattagggataaccttcactctttgctgttgtttttgtgtttgcaataacaggtatgagtggcgctcaaaatcagcgataccaacaaggtgcacgtgatgaaagtactttggtgcaacaagtgctaagttctcaaatggagaaagcggagcaatggtagtaccacgaattatttgaaacaaagtttgtggttaaggatagagcctgtcgtactataatcgataatgagagttgcaataactttgtgagctcagatttggttgagaaacttgagttgcctacacaaccgcatcctcatccatattacatcaaatggttaaactcttggggtaagttcaaggtaaatagaattgtgagactgaacttttcgattggaaattaccatgatactgccaattttgatcttgtccctatgaaagcatgttctttgttgtttggtcaaccatgggtatatgataataatggttcgcataattttgttgctaatacatacacatttagacataatgggcggaaaatgaaattggtacccatgagttttactgaaattttcgaagataatcttgaaaggatgaagaatggaatcgaggaaattttcaaaaatagtgctgaaaggacgaaaaatagaatcgatgagattttcagagataccaggaaagatactaatattgtgatgccttcaactaagtctgagttattacaaaatgaatgtattgttctgcctattgctttggatactaatattttgcacgcatctgagaacaaccaaggtaatgtggaagagaagaaagatgaagaggaagatgaggatgaagagtttaattttctatcttctttaaatacttggggctatattcaatttgatgatctttgttcactcaactgtttagagaaaaattatttgctagatttgaattgccatgcccttctaatgtgatttttcatgttattggcaattatgatagtaaaggagaatataatgtgcatcgagtatatatttgttcaaatttgaccatacctccttttcatgatgaaatgtattgtctagaggaccacatgcgtataagtcattctctatctagttcctctagttgtttaaatgagttacatgttggcttgcaagaaggggagtgttgtgattttgcgactacaaagatttcaggatccaaccataaagccatcaagaaatgttcctgatcggatgttgtgatagataaagataagttcgatacgctccatgacaaggtgaaacagaggacggtttctaatcaagaaggggaggatgatgaggacacaattagctcggatataaccatgactaccttatgtattagtcaaccaaatgtgcatatgttctatattagatttacttgttatatatttgaataaacgttactacacaatgagttttgtgtgttttcatttgcacaattacttgcttgggcaaaagaaaagaaaccgaacgtaaggaatgtatgtatgattaaaggggttgattggggaccaaacaaagaccttctccaagtctacttccatctcaccacgtcacttttgatccatagaagataagagataatgttctacatgttttggattcggattcgggcctcctgacagcatcaatttcaaacggacctagccgttgatctagaaggaatttcgaggcctatgagtacttgttggaaaccttactcctaccgagctaccgggaatctgcaaaacaagccacgcactgtcacgtcccaaaacgaccctaaaatatatcctctaaattatgcctagaataattaaaatccgtgtgaaagcctccaacaattaaaatgtgcaaagttaaaagtcaaataaggcttggaggatttttgtatatttcctaaaagtctaaaatgcgtaaataaattttagtggaattttcagagcacaaataataattattaagaaataaacaaagttaaaatggtgtaccttgcctcctgggacaaggaataatacacgcacgtaaggaacgcccgttgggtcaattccggtcgtgacacgcacctcatccagtccgaatctgattttgagttttgggccttgtaattgtgtcgtgggcttagcccaagggggtgtgcgccctacgacaaccctaggatgtccctaatcacatttattcagtagtcgtcatcgtttagagttgggttttgcttagattattctgttgagaacagtttcaccgctagatcggtttgtggaaccccaaattcgagtgcttaatcatacctatgcaatttggttgcaatctatcttgttcttgcttgtgttcttcaattcgcatgtagggattagccttctcggcgaggtcaaccgggtttcggcacggttgataaccaaaggagacgtggtgctgcgattgcggggctcagtagtgtgttcgttcagtagccggatcgagttgtgtcgcgactccgtccaaatcaactgtttatcagttcctatcggaagatcgggacctaacatccctcatcagttggtatcagagcgcggttgcccgttaggtaatttatctttccataaccagaaaattgccatacaaaaatattgcatcatttacctagccaatttgagccattgcattgttctatttgattttgctttgttgaattttagattgcatcgtcgtgtcgagtgctggtttagttttagatttaatttttagttttgagtttggcatctgttcatcacttaggtctaagtccgtgtgagttgtccgtcagtttgggtcctgttttgcatctcgtcggttgttgccgggacctttaaaaaattgaatcgtcacgtagtcgggttttcgtttttatacttttgagaagttctgtccaccaattttgggagtgctttgactagggtttgggagctaccatcagagtcgtgtttctgtgcgcagaggaagaagatacatggtgggtctctgttggaagttgtgtaaatagcttggtttcggctaggagtcaggagtttggtagtttttttccatcatacttggactccctcttctagtctgcctgtgggtcgagtccaccgtggtggtttaggccgagcgcccagccaccaagctagtccgactcctctcctgcctgccgtgtgcacctccagaatcagtccattggatattttggcaaaaaaagaggaaaatttcctttagcagatttgaaatatttttgcaaaaacggaatctacgtgacatgagcattccattttttaggtgatctaattttagtttttcactttacgtttgagtccctgtaatattcatatttatatttgagtccctgttcgaggtcagtggttagtttctgttgaaaaaacacataataaaaaaagaaaaggcagaaaggtgcaaagaaaaagaaagaaaaagctgcacccaaaaaaaagaaaaaaaaggcagaaaggtgcttaaaaataagccgcacaaagaaaaaagaaagagaaaaaaagaaaaatcattcatcctttgagtatgttttgagagtgccgagttgtgcattgattcgtatctagtccttagtgtggtcgggtacttgcttgagctagagttgagtataggctaggccagcacattgactagtacgttgaactattattcaactttgcattttctaattagcacaattgcgttcatttgctactatatattgtgcctcccaaactccacatatatacttctggtcagcaccactttgatcattgcaatcgccacatcacgtccttaaaggtgtcacgaaccagccaccggttgtatcgtccggttgtatcatccttagcattgctggtaagacacttgtaagagcttggtaaagtgctccatttggctgagttgttgaggggcaccactacactgcgtagcagattattagggataaccttgattgtttgttgttgtttttgtgtttgcaatgaccggtatgagcggcgctcaaaatcaatgataccaacaaggtgcacgtgatgacaatactttggtgaaacaagtgctaagttctcaaatggagaaagcggagcaatggcagtaccatgaattatttgaaacaaagtttgtggttaaggatagagcctgtcgtactataatcgatagtgagagttgcaataactttgtgagttcagatttcgttgagaaacttgagttgcctacacaaccgcatcctcatccatattatatcaaatggttaaactcttgtggtaagttcaaggtaaatagaattgtgagagtgaacttttcgattggaaattaccatgatactgccaattttgatcttgtccctatgcaagcatgttctttgttgtttggtcaaccatgggtatatgataataatggttcgcataattttgttgctaatacgtacacatttagacataatggtcggaaaatgaaatggtacccatgagttttactgaaattttcgaagataatcttgaaaggataaagaatggaatcgaggaaattttcaaaaatagtgttgaaaggacgaaaaatataatcgatgagattttcagagataccaggaaagatactattgtgatgcctattgttattacaaaacgaacgtaatgttgtgcctattgctttggatactaatatttttcaggcatctgagaataaccaaggtaatgaggaagagaagaaagacgaagaggaaaaaaacctatctatagctccatgcattcttgaggaatgttcaattgaccaagcgcctacaatttcttaagctaagaaaaaagataaagataatggtgctacaactgctcaaggtatgcatagttataatgtgccaactatgtccactacttgtgctatattagagcaacccatagaggaaacaattgttgaaataccttttttacaaaacaatttttttgatgtttcttgtgataaagaagtgttgtgcaatgtttcacttttatccatgccacaactagtgaatgaacatgttagttctacagtagagccaccatgtgttgagtttaaacatgttattcacattgctagcgagaatgaagagcttaaattgctatcttctttgaatacttggggttatattcaatttgatgatctttgtccactcaactgtttagagaagaaactatttgctagattggaattgccatgcccttctgatgtgatttttcatattattggcaattatgatagtaaaggagaatataatgtgcatcgagtatatatttgttcgaatttgactatacctccttttcatgatgaaatgtattgtctagaggaccgcattcatataagtaattatcaatctatttcctctagttgtttaaatgagatataggttggtttgtaagaagaggagcgttatggtttttcgactacaaagattctaggatccaatcatatggtcaacaagaaatgttcagcataggatgttgtgatagacaaagataagtacaatacgctccatgacaaggtgaaactgaggacggtttccaattaagaaggggaggatgatgaggacacaactaggtcggatataaccatgactaccttatgtattaatcaactaaaggtgcatatgttctatgttaggtttatgttaggtttacttgttatatatttgaacaaacgttgctacacaatgagtttcgtgtgtttttatttgcagaggtagttgcttcggcgaaagaaaagagaccgagcataaggaatacatggatgattgaagaagttgattggggaccaaaccaagaccttctccaagtcttcttttatctcaccacttcacttttggtccatagaagacaagagataaagttctacacgttttggatttggattcgggcctcttgacagtatcaaattcaaatggatctagccgctgttctagaaggaatttcggggcccatgagtacttgttggaaagattatggagtctactttcagatggatttggtcccatgtcaaaattcctaccgagctgccgggaaactgcaaaacaagccatgtatctcatccagtccgaatcagatttgcgttttgggccttgtaattgtgtcgtgggcttagcccaagggggtgtgcgccctagggcaaccctaggacgtccttaatcatatttattcagaagccgtcatcatttagagtcgggttttgcttagattattctgtcgaaaacagtttcgccactagatcggtttgtagaccccaacacgtgagcttaatcattcatatgcaattttggttgttttctatctcattcttgtttgtgttcttcaattggcaaacagggattagccttcccggcgaggtcatccacgtttcgacatgggtgataaccagaggagatgtggtgctgcgattgcggggctcaagagcgtgcgcgttcaagaagccggatcgatttgtgtcgcaactccgcccaaatcgttgtttatcagaaccttttggaagatcggaaccctagtgcacatcaataacaatcaaggaaaaatcaatctgaactctagttattatcaagttaaataataatccaaaatagaatcaattgcctagttgctgatcttaaaatctaagtgaagaaccaagcaactcacacgcaacgatgatggcacttaatgcaaccaaaggagtataagccacgaagtaagcaagctcgtgttgcacaagtgatagagagacgctagctatgctcaaatgtaaattgggctacaatatttgcaccgaaataaccaaaggagcagcaagtaaaaaattttgattttttttaaccaaccgtagcacctttttttcttttttttctttctttctttctttcttcctttctttctttctttttttttcaattttctttttaaccacggttagccaaaaataaggtgtttatatactgctcaaaatatttagtaacaagtgcaaagcccaagagcaaacctatagctagtctcaaataggatcaatgtattaagttgtatgcactagccagttgtacataaaagcctaagctgatagggaaaggcgggccattcactttatacactccaacactccccctcacgcgagaacccctcaagtctcaagcgtggaatattggagtgggcaattcacttttatttaattgcacgccagccaggattcaaactcgagacctctgaccctgataccatattaagttgcatgaactagccagttgtgaaagtgcattaatccccctagtgggttttggtgattaactacaaatgtggttaagggactaatgagttcattgagttactttcaggtgtattagtccaaggtgtggaagatggatgccttgagaccccccaaaagtacaaaataaaagcggaacggaactcgggaagtgcatagaattgtttatttatcgcaatcgagttttcaggaaaaatcgtactattaagaggggttccaggtgatgctctgagatatgtcatgtgctcttagtgtgaaccaagtatcaagtttccctatgagtcattcttgccaatactccatctgtccaaaattgcaagtctggaacttcctgtcttccaggtccggaagttccggtcttgtgaaaaagattttcctaagtgtagtctggaaattcctgtcttctag

SEQ ID NO: 59780 - DNA, 730 bp, Oryza sativa
gacgatcctgagcgttggatttacacagagatgatctataccgttccacgaggaatgaaagaatgagtgaaacaacttatttaagtatagggtaggtagatagaagatagatggagaggcagcgtgcgaaatcttacctccattaatcttcttgttagtggagtgggcgcacgtgctggctgagcagggcccaggtggcttccgcggcccagaagccgcgtggcccgtcagtggagccggcccgatgcggagagaatccgagtcgtccgaatgatggacggctcagattgttcctgttctggtaaaagtcgccgacggggaaggggtaaacctaatcctcctcttctccggcgagccagaggggcgagagcggcggcggggtcgtaggcggcggtgtgtggcgatccggcgaagggaatctcgcacggcggcgcggctgctgagggggaacaccctaatccccttctctccccgacccctctcccggcgacgcgagtgagtggctggcggcaagcgccgagcggctccagcttcactggctggggggcgcacccgaagacggcgccaagccatcggcggtccggcaaagcaccgagccgacgggggagggggggaggtgccaaaagtggcagcccaagccgatgcttcccgtctccggtgaggcggcgacggtggggaagctccaagacggcgcgagcggtggtgaaccggcgcgaccccgaggacgccg

SEQ ID NO: 59781 - DNA, 29465 bp, Oryza sativa
gagagagagagagagagagagagagagtacagcgtgggtattctaaaaatgatggaaggactccaaaatggctacaacagggagacttttacgagagaaaaatgagtggaaatgagagcaatagactcagaacaaagggtggatgtaatatcatcaaaggacaggaccaccacccatctcacactagctaattaatgggcaccttaaacatatgcaatagcaaacgagcctatgagacaagatgtcacaaagtaccaattttgttgacctttggtccattctcatcatccacaccactaaggccccctttgattcaaagaaaattggccataggaatttatttaggggaaaaaccttgcgggttagctcatcttccgttaacacgatgctaccgcatagtgccatgccttcggaaattggaatgatcaaagttttcattttttttccccgattacattgaaaacgtgcgcgcgcatcaccacacacaccatactcacacttatgcgagtgtgctcaataacacacgctcaaaaacaaaaacaaaaaccaattacatattgttggcccccactatatctttttttttgttgaccggaacccactatatcttttaaaagcacaattttacgtgaacaatattcgtaggcggcatgatttaaatcttagtggatggtcatgcatctacgagaccacgaccccaccatcacaacagtacacgtgctttctccgaagttttaaagtttgctaggtgaaatgccacattactgatctggatgttgatatttgagttgaattttatgaaattcttaactgaaaagtggaaaattcttaaggaccaagtcaagttggcaactgaagtatcaatattttctatatacacttgtcctcacaaaagattaaaaactatgcgcacttcttttctagaaggttctcctagtagttcctagcttggtgtgacgtaatttctccttcaaccaatctaaccaattgaaagaaaaaacactttctccaacaccatgttttttcctctttatttatttatcacatgcccaaacaaatcatcataagaaacacactaccttaatgagaccctccctaacgacggtcctcccaccctgttgataaactaagctgtacccatctcaacccatgtacttttaaattctcctaggttaaactattctcaaggcctcaaggggtggtaggaactaggaaccggcctaactctgagttgacgcccctccaaagtccaatcaagtttccttgatcttcgccgtagccctttccatttacccttccttcatccccaagctcatctcgaaaaggaacgtacacgacggcacgggaacggatgatcatttgccgccggcacatccatcgatcgacggcgacatacaccggccccgcacactgcacacacgcgcgggggtcacacgcacaccatacacgagagctaatcttagcttagctcgctttcttctcctgtgtgtgtatctcgccgtcctcgcctttaaaagctctttagttccccgtcgcgtcagaaaggcgaggagctaagcataggtgacacgaaaaggcttttgtggttagatgtgtcatcgggacggacggacgggcgggcgggcggcttctcttgatctgatgagtgatgggctgatggcctcgtggttgggttcaccaaccgggagccaaagcggcttggggacagccggacaggcagctttcatcggacccccttgagctacagcgtactacagtgctaactgccttttggcccaggccgtggttatctgctttctgtggctgagtcacagacacccagaatttgttgtagacttgcagttccagccatgagaaatctgtcgaccagagtagtatagtacctgactggccatcgatgatagactccgaatttgtcgcagttccatcccaaaaggaacttgtgggtagtagtgtaataactgactgagtgactggtcacaaactctctgaatttccttcatttccagccaaaaaaactgttgagggctactggtaactgtctgtctgattggtcacgaccactccttttcttttgcagtttcctggcatagtgtgccatgctaaatctgttgggagagtgaaaaggattaggcaactctcactaagataagaggaggatgaggcacaaaagaagcaacgacaaaagaagcaattaaagcctacgctatggtcgactagcttcgtcgctgggcgggcaaaagaaaaaaatcctgatttgagtgtgtcgacctcgaccttccacttgcggcaattaacaattttggaaaatcattggcgccattgatgttgtccacgggagtcaccaaccctgcctgcccggcttgtcgcccgacgacgacgagaaccatctccctactcaactactctaccctatatgcctcccactgctcggcacttcggctagcccgtatcaaaatctccaaagaacatggagccaagcggcatgttaggttgtctttgccggctgtggagccgcattccccggcgagcgatacggattgagatcctctgacgtaacttcatactgacttggtgactgatatgtgggttcgagagtggtggggaactatatgccagtcacggtgaacagtaacgtcagatgatcctcttccatacggtagacatgggccatcagtggccagagtgtagactagagactgtgcaggtcggtgacctgaatatagttcactttaggtctctgtatttgtcgtgaagtctgatttttgtccctgaaccgcaaaaccaggtacgacccatcccccaacttacgaaaaccgggcaaacgagtccctacgtggctaatttgactcggtcttcatctgacgtggtgcttacgtggcaatttgatcaaagaaaaataataaaccctgtgggacccacatgtcagtttcacacataaattaataaagaaaatggtgggacccacgtgggccccacatgtcatcctcacaccttcccttcttcctcctctctcccctttcttcatctctctcccctttcctctctcaggcgcgatggagagaggcggcacgcggcggcgccgacaggagagggagaggcgcacgcccttcgccgcaaccagcctccaccaccgtcgcctccttacgctcgtcgacactgccggcagcagcggagcggtgcgcggatctggagaaagagggaggggagagaggagaatatacctcgctgtcgcccctctcttcttcactgtcaccaagctcgtcagcggccgcccgccggagcgaggagcttccccttcttccacccggacggcaccatcacgcgcccctttgtccccgacgcgtcgccgtgctctggctccccgatgcgctgccgtgctctggctccccgacacaccgccgtgctctggctccccgacgcgccgccgtgctctggctccgtcgtgctctggctctgcgacgcggcggcgggggacccatggatcgccgtgccggcgaggaaggtcgcgggtgcgggggccgtcgccgccgggtgcccggcccgctcctccccgccccactctggcggcctccgctccttgcccgccacaattaggccgccgccgctccttccccgccccactccggtcgccgccactcctccccgtcgctccgctggagagaagagggagagagatgggataaagagaagggatagtgaggatgataggtggggtccacgtgggccccaccattttttctattattgtgtgtgtgaactgatatgtgggccccatatgttttaatatttttcggatcgaatttccacgtcaatgccacgtcagatgaagaccgagtcaaattagccacgtaagcgccacctcagccaaaaacggggtcaaatactgccgatggaccttatttaaacggtttcgtaagttgggggacctgttgtacccggttttgctatcaagggacgaaaatcaaactgggcgacaaatagagagacccaaagtgaacttattcccctgaatattacacggttgctcctttgcttgctcggggcatagggctatgtgggccttccaataggccgttatatgccttaacatctcgaattgcattcgacccaggtaagatctggcctggcctggcctggtcaacaaagaactggagtaacaagggtcttgttcgtgtgcaacggcagtagttccaatcaaaaaacaacaacggcagaaacggtttcttgcgaattctgattcttggaggcttttatctgcacttctcattccgcataataaatttgacaggatatactttcctattagctcgttgggtcactccaacgtctatgttctgatcaagcagggtggtatatcatctttactataaaaacccaactcctgacattgaagtataaaaacccaacttctgacattgaagtactgaagtactccctccgttccataataaatgcaattgtgggttttagtgtctaactttaaccatccgttttatttgaaatatttttatgattggtatttttattgttattagatgataaaatatgaataatactttatacgtgacttaacttttcaaatattttcataaattttttaaataagacaaacggtcaaacgttatacatggaattatagctgcagctataatgggatggatggagtatacctatgtcccaatataaatgcagttgtgggtttccgtgtctaacgtttaaccgtccgtcttatttgaaaagaatattattagcatttttattgtaattacatgacaaaatataaatagtactttatgtgtggcttttttaaaaaaaatataattttttcaaataagatggacgatcaaatattggacacggaataccataactgcatggacgtagtatatgtctaaaggaaataattggtgcaatatctgcggctgatcaatgatagtcctcttgatcttactgaagccgataaattcaatctctcacgtcgcgtaaaaatacagtgtactcccaccatagaaaattataggacgtattttatttttaaaaaatgaagtctttaagacaagactttgattactgactgtgcataaaatttattcataatatctacaaaaccaatgtttcatgaaagctctttgaaggatgaatctattggtgtaacttttttatgcactaaatatacttataatctggctaattcttggtcaaaatttacaaagtgtaactatttcgaaatagtactagtgtgtgtccagcaacagattggaaatctacaacaaccgattggaaatgatgaccttctagccaaggaatgttactatccgtcgcttgaagggaatcatccaaatcaccatccctgggcacgaagactagacgagttggtggaagctgcagaagtaatacgccagtgcagatgtgtcgctcctgtgcctggtctggtgaagactgaagagtaggagactgcacaagtagagcggcgagcaatatattcaccatcaatctgaactctctgaaatctcccatccatttctgaacatcaatctcaagccatgcgtctgaattctgcaagctcacttctgctgcttctcaaactcagtcacctagccatcgtggccgccttggccgacggcgcggggttcaccttcaatggcttctccgccgcgaacctctccctcgacggcatggccgcggtcgcgccgggcggcctgctcatgctgaccaacggctccatggtgatgaaagggcacgcgtcctacccgactcctctgcgcttccacggctcgcgtgacgggaggagcgccgccgtgatgtccttctccacggcgttcgtcttcgccatcgttggccagtacgccgacgtgagcagccagggcatggcgttcttcatctccccgagcaagaacttatccacggccctgcctggtcacttcctgggcctcgtcaacgccggagacaatggcaacgcgagcaaccacctcttcgccgtcgagctcgacaccgtactgaacggggagttccaggacatcgacgacaaccatgtcggtgtcgacatcaacagccttacctccatcgaagccgcaaccgccggttactacgacgacgaggacatgggattgttccgcaacctgagcttgattagtcgcaaggcgatgcaagtgtggatagactacgatggcctgaccatggagctcaacgtgaccatggctcccgttgagataaccaagcccaagaaacctctgatctccaccattgtcaatctctcagcagtggtcactgaaccggcatatgttggtttctcgtcgtcgacagggataatcttctcacaccattatgtgcttggatggagcttcaagatgaatggcacagccccacctctcaacatttccattctgccggctttgccacttatgatcagcgagcgccgatcacaggtcctagtgattgttctgcccattgtatctctggtgcttgttctagcatcagccgcaatggctattgccgtagcaaaacagcgggctaagtttgctgagttgcgtgaggattgggatgttcccttcgggacacatcgcttttcatacaaggatttgttctatgctaccgagggttttaaagagagccagttgcttgggatgggaggatttgggaaggtgtacatgggcatgcttccaaagtctaagatgatggttgcggtgaagcggatttcacatgagtcaaggcaagggatgaaagagtttgttgctgaggttgtgagccttggtcgcctaaggcatcgcaatgtcgtgcaattgctcgattattgtcgaagaaagggagagctccttctggtttatgattacatgccgatgggtagtctcgacaagtatttatatgatcaagacaaacctactctagaatgggctcgaaggcttcagataatcaaaggcgtcgcatcaggtttgttgtacctccacgaagattgggagaaagtagtcatccaccgagacatcaaagccagcaacgtactgctcgatgctgagatgaacggtcggttgggcgattttggacttgcaagattatatgaccatggtactgaaccaaacaccactcatgtagttggcacaatgggttacctagctcctgagcttggacaccgcgccaaagctacaccatatacagatgtattcgcatttggcgcattccttctcgaggttacatgtgggcgtaggcctgttgagcaggaagctcctatggtgcttgtcgattgggtgctcgactattggcgcagcggttcaatcatggaaacagttgatccaaggctcagaaatggctatgccgaggaggaggttgagcttgtgctcaagcttggcctgctttgctcgcatccactggctagtgcaaggccgagcatgcgtcaggttgtgcagtacctcaacggcgacagcgatttcccggaactgagggcagcgcaaatgggcttcagcatggcgactctgctgaagaacaaggggcttaacccagatgctatgtcatacgcaatgacatcgtcatcaagcatcggtactatgtctagtactctctcgggaggaaggtgataatatggttttgtgttgacagatgatatttactacaaatgatgtaggagtatgattgtagtagtactagtggcgctaatggaaaattgtactgtaaatctgtaatggacagcaaaattcctggtagactggattcgtggtagacatggaagttttataggagtacaaatcaagactttgctttcgcatgggaaacatccggagtctgattcttagtgtacagtgtatatctctatgaatgacaagcataatatacaatgtgttttgagttgaaaccaaggaacttgagtgaccacagatgcacagactagtaaacaaacacctccttctcaccacgcaaggttgtcgaacgagtcaaatgttgacggatcgtggccggccggcaaagcaattagaccactactccactagtaaacctatcccctagaaatttggtacccagtagtctgactatctcactactacggcatccttgtttctccctctgtcctttctagcagggtactgtttctgatgatgatgcattagtattgaattgacttggatgaagaccaagccacaaagctgcttgttcagaaacttcacccaaccactgaagacggaagtgacaaaatttgagagctctgccctggctcatgcgtcacggtagccatggtgatcatcaggcccatctccagcttccttgtactcactgtcttccactgcatcaagctggtggcgccatctgctagcgaaaaccagttcgccttcgaaggcttcgccggagcaaacctcagcctcgatggcgccgccgccgtgacgccgagtggcctgctcaagctcaccaacgacaagcacatcaaaggccacgccttctatcctactcctgtcagtttccacttgacgccgaacagcagcgctactgcatccttctctgccaccttcgtgttcgccatcgtctccgagcatgcggagctaagcgaccacggcctcgcgttcctggtcgcgcccagcaagaacctctcggccaccacaggggcgcagcacttgggtctcatgaacatcagcgacaatggcaaggcgagcaaccacgtctttgccgtcgagctcgacaccgtcctcagcccggagctccacgacatagacagcaaccatgtcggcattgacgtgaacagcctgcaattcatacagtcccacaccgccggctactatgatgacagcaccggcgcgttcatgaacttgacactgataagccgcaaggccatgcaggtgtgggtggactacaatgggcaggccatggttctgaatgtgacgctagctccattgggtgtgtccaagcccaagaaacctctgctcccaaccggcctcgacctatcgagggtagtggaggatattgcctacatcggattctcgtcggcgacaggcctctccattgcctaccattatgttcttggctggagtttcagcttgaatggagctgcccctgctctcaacccatctaagctgcctgtgttgccaaaactagagcagaggcaccatcgatctgaaattttggtggttgtgctgccgatagccacggctgctcttgtcattggattgcttcttgtggggttcatgattgtcaagagatggtttaggcatgccgagctgagagaagattggaaggttgagtttggaccacaaaggttttcttacaaagatctgttcgatgccacacaagggtttgggagcaagcgtttgcttggaattggaggattcgggagagtgtacagaggagttctctctgtatccaactctaactcagagattgcggtgaagagagtgtcacatgactctaggcaaggggtgaaggaattcattgcagaggttgtcagcatggggcgccttcggcacaagaatctagttcagctacttggctattgccgacgcaagggtgaacttctcttggtctatgaatacatgtcaaatggtagcctcgacaagcacttacatgacaagaacaatcctgttctagactggaacctaaggtttcacatcatcaaagggattgcatctggcttattgtacctccatgaggaatgggaacaagtcgttgtacatcgagacatcaaggcaaataacgtgcttctcaacaatgagatgaatggatgcttgggcgacttcggccttgcaaggttgtacgaccatggcaccaacccaaggactacacatattgtaggcacaatgggttacctatccccttagcttctccgcacagggaaggcatcaccagctactgatgtttttgcctttgggatgtttcttttggaggtggcctgtggccgaaggcctctggaacatgacctccaggacaaccaggtcgtgctactggattgggtgcttgagaactggaacagaggacaaattcttgacgtggtggatcccaggctcagcagtgagtatgttgccgaggaggcgaacttggtgctgaagctggggctcctctgcttgcagccgttgcctagtgcacggccgagcatgcggcaagtcctgcagtaccctaatggcactgtgctggcaccagagatgttgccgacagacttggactatgatacactaatgtttctgcagaatgaaagggttgagtcatacgccatgctggaagcatcctcattggcaacaacagttggccctgggtctgatctttcaggaggaagatgatgaggacttgtggtttaccattgcttgttagttttctgtatgtttatctaacaagtttgtacttataagtcttaatgcctttaatataataacaagctgaccactctatgggctatggcatgataatatactatcatggcaaacatgactaaccctaaagaacatgatataggaaggcttaccacattctctgcattcatatgctatctatttgggcgaatattacaacatatggtagctagaacgggaacacaaggttattcgcatagggaccttgatgttataccagattatgcatgtggaacaaaatcaatgttttcaagtctccaggaactcggcatcaaatcaattaagatgactaataagcaactaacaaattccaaaaggagcaatgtacgtacaagcatggagaaacccattggccattggccattgcataatgcttattggttcttttccttgctctcttgctcaaccatgtaagccttcttcatttcttccaggactgcatcatttgtgctgcaagcatacacacatatagcatggttattacatctaaaagaaccgcggtgtatttatcatgcactggccaataccagtctacaagcaaagcatcaggaaatcttcagaaaaaaaaatgtaacagtaaatgcttgacagagagatttcccaaatgcattgaaagaaataactttcagcactacgctcctaaaggatgatgctagtacagttacaggtagctttagactgggattctaaaacaaagaattcactgaacttgactccatcaaatccctaacaatgtactacatagcaaaataaagactgaccaaataaaaatcaaaataagcctggttcctactgtcagtgtaatattgcaggaaatactgatgtattcattggtcaataagttagatcctaacttgaaataacagccagactacagcatacaatgattaaacatatagtggaagatatttttgatagcaatggaaatcctcgcccctcatatatgtacagattagagagtaaagatgttgacaaatatcttgcagacttccctgctcatattagtgcgtggatgtttttaacaataagtatctactgaatgaacagtacaaagtagctaatcagtttctgtgattaggctccatgcacaattttccttatatattcttatagcatgttatggaactctctggagctctggtttgtacaaaaatcaacaatgttcaaacacgaaccggaataccgcttgaattactattaggatactggcatataatgatcaacttacaattgatgaaggcaatcattcaactcttttgcttgtttgcggcattgccataccaccgaaaaagttctacctcgagcacactcagcatattttgagcagtagaaatcacactccttaagggccttctgcttcattttgctccgcaaagctgaaaagtgaaatagaatgggctaaattaactctctgatgtgaagtacaagaaacttggatattgtcaagcaaagcacaaaatttccccttaagtacaatattctaacctaacactagagaacaactaattgagaaaactcttttgaaatacaaaaggcacatgttcaaattttctgaatgttcttcctttattattctgtacagcagtcttcagcagctcctaacattataaggaaagttcgttcagtcaatcagtctgtgcatatagtttgtctttcacaagaaagttctcctaaagattcaaaaaaatcaaaggactgatgctcagtgcaacaaattctttacagggctgtctcacaagtttgaatgtacttgagtgctcataatataatatttagtaaaccgagctatataatgatacacgaataaataacatcacacaagatccaacattctgtaaacaaattaactacagcatataccggttaccatcatcagatagtgttaaccagttgggagagatgtacatgaactatgaaatctgaatggcatgcttaatcaactaatgattcagcttccataccggcaagcactagatcacataacttctcaactaaagtctacaaggttcggccagccaaacggcagccaacctccttaacctcctcgtttgacgactcatttcacacaggattgtgttcccatttcaacaagcaacaccagcggagcgcaatttttcgtcagtacctcacccgttacgcaactatcaggcgattttgcagacctcaagaccccccaaatcaacgaattcggaagcttgaacaggcaaaggatgcgggggctcaccttcctcgaccttcttcttgacgtgattctccctggcctcctgcaggtaccccatggtgcagcgaccaggcgcacgccgtatcggatcgacgccggcgagggcggtggccggcgggggggatcgttcagtcggagttaaaccctaactccctccttggaaggggacgcggacattgacggggaaggtctcgctgtgttttcccctgttcgttggtgggcgagggagaggaagtggcaaatgggctaaacttggtcggcccaaaaaggcccaattcatttggcccaacaggccgtgtaccatcagcctatatgggttttctcccctctcctcttcaccaagcaagttttgctgaactgttgaaaatggccaaagttctcatgaagcagcatagatgagagttgagaccagtagacaggtacagagtcgctgccaggatcaccactgaatcagaaaagatgtttctctgaattgttcaggttagagataggagttttttggagtgaatgctcggcgtagttagacctacacagattaatataactcatatatctgacacgtagccattcatgaattatggtagtataatgattatgtacctcctgatgaaataaggaatgtttcttcgtgtcactgtagtggttttcggttcttcacatgggacctgatgattggagattctggaattgctcgtagcttcaccaaatcgcacgagatccttacagctcttttgtaaggcggataattccaattcgttcaccatcaacgaccaaaccaggacaaaatcaaactagtactactactaatcaagttggtaaggagaccaactgacgatagcatccagccaagctcgacgcttttggcaccaacctacccttgtaaaatgccggatggcatcgccgtaggaggccgcgtgtttccgtactacactcaatgtgtttggtgaaaaaagaaaagcgtttcttgatgcatggttatttgacttaacactaacttaccaaggttaaaagcagatactactgtctgctactaaaatgactgcaggtgcatgtgttttcttacggatcaaggttgcagcagagccaagtcagaggtgtccactgcactagacatcccgccgaattcgatatgatactgaacatcagttgcgtttgaacacgtacgcgcatcggattctgatggttttgcggtagctgacgcctggctggagctagcctgcacgtagtgccgagacgtcctgcctgatcatgtcaaaaacaggtcagaatcaggatagtttccacaagaaacgaacccaaatcccatcggcgacagaatcacggacacaagcacacaactcgagctgattgctcactccacgacgggataagatcataagaagaaactgcaaattaaaccctgtcccgatcgcctccgcccaccactctggatgaggatcagaatgggcgcgtgtgggctcgacgccatcgctatcttccacatagaagaaccttcagaaaccgcaagagggaaaaaaattcagtaaagaactggcatatggcttttcaattattatgccgtttctgtctgtgttcgtcagtggactccagtgacaggttattcacaggtattcgttgcgttggagaatactactcccgctgcgttgcttttcgtctcgccatcaaaagcaaccatttcctaatcctaccggctcatccgtgcttcttttcttctgtgcaaataataatgattggttgagatcacgcttaatttgttctgtttgctaaccttgctcccacgaatgatagcgtgcatccggccgtcctggattcgttttgtgttgatgcgtgtgtcatcttctggatggatggagcggtctgattaaccgccggtttatttgacgcttatttatgtgtttcttgtctgatttggatcggtttattggcgatttggacttgcgagaacgatctgccatgttttatacggattaccgtctgcctgtaatagttttctacagttattatcttggtctatatggacttttgtggtgtgtgatgtaaaaactaaggtgcaataattcattatcaatactttgctgcatcgacctaaccacgaccatgccgtaaagacgttccactttcagtattttctacacctttttctagagtactagaattcatgagttcatgatacatacttattttctgcacctgttttttttctagagtcccattgacacggttgagtgctgaacttctggttttagtgattaccatgagagggaccggttccaaagtccaaacgcaggattcctgaaaatcaacttcagtacaacttttgcaacgccccctgtccttgctttgctgcagtacactccatgaccacagcaacaacacgtcaaacagccaaaactaatcacaattacgtcgtggatgatcgaacgatcggtcgagccaagtaggcgcttgtgagaagcaacggtgaaaggaacggcaaaggactaaactaagtggactaatgactgttaacgcccatggccgcccttcatgggccatgatgcttcacttttgcctagctaactgccacccatcagaatccctcgaatcatcgaagagcacctcagatttttaggccccatttgaattggaggataaatggaggaaaaacaaaggaattgaaatcctacactattcatacctttgatttgtaggaatgagaaaaggaaaaacgtaggaaactttccttttcctacgattctagaggaaaaacgtaggaaatttaacatccactccaatttcttggaaaacttctcttgagtctatctctctcatctgaatcctgcgtttttcctgtggtccaatcaaacggccattcctgtgtttttcctgtgttttgcaatcctctgttttatacttgcattcttatcagaatcctatatttttcctattcctccgttttttcaatcctacgattcaaaggggcccttatatcctctaatatatattaccatgtgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcatgccccccatcctatataaggtgggcaggaggccctctagggggcagatgacataacctgatcatcagatcaatacacacccggcggattcaaatccccaaacaggagtagggtattacctctcattgagagggcctgaacctgtctaaatcctttgtctccgcatccatccacttttaggtctcgtgcgctacccccttttattattgccgaatccatgtttcgacaccatgcagctgcctagtcaccggtcactgattaaaatttctagctgtaaaggggctctcccttcttcctttctggaggtataaaatggtattgtatcactagggattaacttgagtctcaagctgactagagctgcgtcggatgaacgccagcctgaatcgatccatgctcaaagtggtcgagaacaaccaaatattctgcactgaatatggtagccttttattttgggaggaatatcatggaagacgattcgaacgactttaatctcacaaagttttaactggtcaatgtagcacaactgtaactactaccaaccatttctttttttttttcaccttgcaattgcatcgagtggagtggccattgatcagccggtgcttctgctccgtgtttttttttcgaggggacaggcagggagctcctgcaattcactatagaagaagagagttgattcaatttataagggaaaccggacccaaaaactttacaacagcacggttaattaaaggaaaaccggcaaaaaccccgacattgacaaactgaacctaagtacagccgtccaacatgagataaactcctaaaacgaagccttcaagaaggttatgccgacaacggcgacatcgtccgatcctaacgaatctaggttttcacccggagaaaactcttgaagtgaagttgaacgagggctccagtagcaacgccttcaagaaggtgaacggcgcccaaggacgtcgccgttgctagcaccgagagcggagcaagactttcgccttggagcacccatcaaccatagcatccacgacgggagccaccaaatgtcacctgcacaccgaggatacttgcgatattcacaccacctgcacgacgaccagactcggttcccacccgaggacgcgccggatctgggcaaggagccagatccggccgtcttcctctccaccaacgccggccgacgcctagaggggcgccggaggacgccagtggcagccacggggtgcctgcgtgctctggccaccaccggccgccgccggatccgggtgcaccaccgccggatccgcggcctccaccattgctaccccaacgccgtcgccattcccgccgccatcacccacaacaccacccggcgcaactcacctcaaccgccaccgtcgcccgtccccgccgccagcccatcccgccagatccggccggaacggcgcggatctggcggacaccgccgtcgccactccgggcggctccccaggccacccgagcgcgaggagacaaggagcgccccaccgccaccgtccttgcggccgcgcggcttcaccggcggccgctcgggtgacggcgaggcggagaagggggtgggggtgggggagagggacggccgggtccgcccctcgggagagcgacgcgagagggtttttcttacagcagtcgcttctgctccgtgtcgatcgatctagcaagccggctgacccgcctctgcaaatgcaaagcttccgtgagcagcccggagtgatttgccccgggatcgcgtggtttgtgtcgtgtctttgcatacggcgacatgctatgaatccccgctttacacctgtcagatggaccaaatcaccaaacgtgattggcggtccaactgcagagcagtagacaaagatttgaggaacaacaggcaagacatcggcacggcacctgcagactgcggatgaaggcgttcgccgtagaatttgagctttcgtttactgtaacagggctagttggttgtacttgtaccttacggttgaaagataatgacacctagtagatgatttgccggagaaatattataggacaggaacttaatactcattttcttcgaaaagtcatacggaataaatacatgtgctaaagtgttctcctttaagcaggaacatcagagctttcaattgagtagaacaatgcaggtacacattgccgggtttcaaaccgctgctatttttctccttgggatcatggcaagcatttttcgtcaacaagactgttagctgcctgtttagcacgcgtcaccaacaaatgtacagagtatgttaccaagatataatcgaagcaaaccgcctggggtagtgtttttttctctctttttgttcgttatagcctttataagatgtagaattgtaattttttaactgatccattaatacgaaacatcgcactaactcgtagtggttgcttaaagaaaaaatcatagcaaacaaaacaacggccaattccatccttaccaatttatcttgatgtgttggcacggtaaaaagaccaaaatcggcccaacgtttttccatcgaatggacggagaccaaaacaagcaagcaacttggccttcaatcttcttctccttcgcgctctcgccacgcgccgctgctcgccacagagcaccaatccaagattccagagcgggcggtataagagaggggtaggaggctacacccccgccgcctccacactcaccacccgatcgaacaccgccgtcacagcgcgtcgcggcgggggcgatgggcctcttcggcggcaagagcgcctcttcgaagcagaccgccaagctcaagtccctgatcaagctcgctgccgcgcgcgtcgccgtcgcccgccggccccgcctcgggcgccgctccattgcccgcggcgatgtcgcgcagctcctctccatcggccacctcgaccgcgctctcctccgtgtatgtccatgccatgcttttgccttgcctgacacgcgcagagactcctccgctaacagtagccgccgtgttctgtttctgcaggcagagcaagtcatcgacgaggacaacatgctggaggtgctggacatcgtagagctctactgcaaaatcctcatcgagcaggccacgcagctagataagcccaagtatgtatgcaagagcacacagccgtgttcttgactcctcggttgattaattccttgccttgtttcttcgttttcatcgcctctcatcagcaagcttttgtcatctttgggttggtgtatacagagagtgcggcgaggagatcaaggaggcggcggcggggctcatgttcgcgtcggcgcggtgcggcgacctgccggagctgctcgacgcgcgggccatcctggcggacaagttcggccgggacttcgccgcggcggccaaggacggcgcccacggcgtcgtcgatcccacggtaggtttagattgatcattgatccctccaactaaacccatctactaccacccaacacatgccgtgtcatgtcgctcgccaactgcgcgagacatggaccggaacgaactggagttaatgaggacacggttgctctgccgctgcagttggtgcggaagttgtccggcgcgccggcgagcacggagcagaagcagaggctgactaaggtgatcgccgccgagaacgatatcttactggaatttcccgagaacaccggagataccgatcaggttggttgcaatctgcgctacctcgcgatgtaatatccctgtttgttgagatttttcgttggttttatcttacgaagttacggaatcgtatggttgctgtactgtgcaatgcagggcaagcagaatgaacaagccaggaacgtccgagctgaacaatttgtcgaacagaatgaggtcaagagggagcatcacgaggtactagcacttgtacaagatcatagcagttttttctttttctgtagtatctaatggctaatgtcgaggattcaaattgtaacaggttcaggggaggcagaggtttgttgacgaagaagtgaacccgatacttgctcggctgagcgtgcaagaacagtacgccgacgccaggatggcggcggaggcggccttcaagtcggcatcgttcgccgcgatggccgcgagggcggccgtcgagctctcgcggtcggagtcgcaggggaagggatcgagaggcggcggcggcggcggctacgagaaggtgcatccggtgcagaattcggttgcgggcgagaaggaggcgccgccctcctggaagccgcacaagcctccgtcgccatcgacgtcgccgtcgtggagcgacaggagcacggcgacgtcggtatggtcggaggggacgcagaaggggaagggcgtcgtgttcgacgggagcgacgaggaagtggacgacgtcgcctggactccgcagctgcgccggcctccctacaggagggcctccactatgggcatcggcggcggcgcgtggaacggggaggccggcagggtcggcgccgacccgcagccgttccaggacggcgtgtacaacaactcgcaacacccgcgcccgccgcacaggaggcacgcctccgagctcggcgccggcgccggcgcgccccgcgagcccctggtgtccctggcgccccaacgcggccagtacagggacccgccctacaggagggaccccgcggcctacagagacatcaacgccggcgcggcgcaacggcggcagccggacggcgccggcgcgagaccgtacgagagctcggaccacgtccacccgccgtacgctcggatcgtgtcggcgctggaacgcagcaacgagcacatcgcgcggcacgaggaggtgcgcaggatcggcaccggcgagcgggtgctccaggagagggtgtacggcgccggcggcgcgccggggcgcgcgccgctgaaccaggagcaggggaggctcaactcggtgcgcacccgaagatgaggtggtgtcttccggtcgttggttttggcgcggcgcagcgcattggtcagtcagctcagctgttgaattccggtgcaggagaactgggggccgttgcttttttgctggcaaaccggaggttcgtcgcgcgggatccctggagatacagggaaagggatcccctggcttaacagctgtgcagttgagtcatgtcagtgactcaactgcatgtgcagttaaattagaggatctgctttcgagatacagatatgatattctgcctctgggaaatcaaatgtgtataattaaaatggattgcgctagaaacgaaagagaatgtacaaattacagaggtgatatattcccttttttttttgttgtcctgtacaaaggagttgtaatcaccgttttgcgaaaggagacgggttaactgagtctttacggggtgatcgatgaattgcacaactctgcacgctatttgcacaaagtttggatcgatgcacggctgctgctgctgctgcgctacacctgaaaaatggcactctgcataagtgcctagatgtgtaatggctttgttatctgcgagtaaaactactgaactagttgctatctcagccgtgcatgcggtgctcgtcttcactgtaccatcttaaaataaaattcaccacgcacaaattgtgcttcctttcgtaactgcttgaagcagagcagcacattaccctggctttggtgtttctgcatgttgtttgcgttttacatccggtaaatttctttgcacgtaagcacgtttggctcgctgtcttctcattgcattctgcatgctttgctcattgtcattctctaggtgatgctcaattgctcccccacccaatattttccatatgcaagaaaggagtacgacagttcatgtacaccaaagtgaagcaacaaacacaaaagttaaactacccagaacagaagcaacatggccctacaaaacccttgccccttcatgcagacttcctccatcagctcacacaagcaactcgcattctcctcctccttcctttcccccacgcaaaggaactgaccatacaactgataaggtcggagttcatataaccaacagcctaggacaggaacgccgccgagaaccgataacttaacaatggggttcctccatcggaagacctccaagcagacgagcaagctcaagaccctcctggggctcgccgtcttgcgcatcgccaccgctcgccggccccacctcgctcgcaaatccattgccaccgatgatgttcgccagcttctcaccctcgaccacctcgatcgcgccatccaccgggtaagtgtctacgaccttctctgatgaagagagggatccacattgctccaaggcgaggcgtgctaatgccagcaatgtcttgattttctcctcacaggcagagcaggtcatagcggaggacaacatgttggaggcgttcgaaatgatagagatgtattgcaagcgactcatcgagcatgctgcgaagctggacaagcctgggtacatacatttcatttcttcacacttgacttgatcgcgtccttgtctcttttccggtcacatgacaattctatttggtgtgtccagggagtgcaccgatgagatacgagaggctgccgcgtcggtcatgttcgccgccggttggtgcagcgaattgccggagttgctgttcgcgcgcaccatccttgcggataagtttggcagcgacttcaccgaggcggccaaggacggcaccggaatcgtcgatcccatggtactagatagcatatactatccattcatttcacgagtcaatgatttgtatttggaaagatggaggaatggagagttaacaaagttgggtcttgcagttggtgtggaagttgtccagtgatgcgaaaagcatggagctaaagaggaaggtgacgaaagagatagccatggagaacaacatcatagtggacttctctgagctccaagatgcgatcaaggatgaagaagactgataccatcgggagcttgagcacaacacatcatgctagaacaactatgggagctcagagtactcaagacgacaaccctgtttctaactctgatggatcttattagtgtatatcacaagtcaggtggggaagcaccggtgctcacaggaagctatacttcctttgataccagctcaaaaatgtaaaaaaaaactaggtgctgtgtgtgcactccaagattaccaagctgtgaatatacatgtggatgtccacccgttttttacatgtcatctgaatggttatgatattttttttaaaaaaaataacatgataggttaatatgtaatatatcatctcacaaacatgcaagttcaaattcgatttccacaagttgtaacaaaaacaacaaatttgactgtaaatatacatatactagttaaagtttaatttgttatttttgttatagcttgtaggagtcaaatttgaacttgcatgtttgtgaaatgatatattacatattaacctatgttacaattttttttttgaaattttttcataatcatttaggtgacatgcaagaaacgggtggacgtccacccgagagattagaatccatctccctgtgtaaattgcaaatacagatcagacaaagtacacacgtatttatcgttgcagttacagtgcctcttttttacccttcaaattgtgcaaacttttagtttgtgcagagtatatactgaagatttaaatgatgtctgctataatatatgtatgatgaacatttaaacgatacttgtaacaattacatatggtgttccttagctccaattagtggaggatgaatgtgctctacagtttagccagaggttccgacgtttggtcgtcaaaataatgtggatttctttatgaattactccttccatttaatattataagtagcttttgattttttaaatcaaacgctttaaaagtttgaccaagtttatagaaaaatataacaacacttatagcaccaaattagtttcattatatccaacattgaacatattctggtagtttttttgttttgtgttgaatatattgctatttttttataaacttagtcaaaattagagaattttgacttaaaaaaaataaaacgaattaaagtatgaaaaagaggtagtgcagtatcgcagctggctttctacaaaggcacagaagcatagggataaaaaccacataagaaggttaagcaaagatgtggaaatatggtgctacgagaataacatggtttctctgcataaagaaggggccacccactattctacactcatatctatggtactaaacaagcatgattctgtagtacttggtgtcatgcattttgacagaatatgaaaaagtctgaattacacccctaaattattgcatcggtccgatttacacccgcgaactacaaaccagacattttgtgtaccgaattcttcaaaccggacaaatactaaaaactattttgagttgttttctgcacaaactagtacacacgtggcattccaactgaaaaaataaagaaagcaacagtgggcccacatgtcatatctctccctctatctctctctcgacctcagatgtagcgatgaaggaagggaagtaactcgacgacaacttttcgatctaaacctcaccagcgccgcttccatgcgttgagtccaagcgccgctgcggcaaaatcgcccaattcactatcttttgcaatgtactagcatgtcaacaaagagcaagaagcagtagcaatgtactagcatgtcaaccaatcttttggtttccgcggagccaattcctcttcttcgtatctgaaaacggcaaggaggacaccgcctggtgtcctgaaacagaagcagcaagagcaaggcaacaaagccaacaaggcaggagtagaaggccttggcaacaagtatataagcagcgggtgcaaccatgtcacttgcagctacggccaacatcgtctctgcctctccggtgagccaactaattaataagcttcttcctccttcacgattgagtatttgagcttagctagctcactagatggcaatgctggatgcagctacacgtgcggcagcacaatgacgggaacgatgtacctgcacatctgcaaccagaaggcactgacgacccgtggtcagatctagttgtgtacctgccttcctggccagtgagcacgacggcgcccccttctctagctctgtccgctaggcgcccctcctcgagcctcggtgttagactcctgctaccgcgccgctgctcgctagcgtcgtcactcgcgggacttcgccgtggacacccatgacccactacctccctgccctcccattttctctcttgggctgtgaagaaaaaaatagagaagatagagctatcaaggaattttttttgaactttttaattttaaaaataaaccctttcaaaacttatttataagatatgaacctttcagccaagccagccagactggcgtggtaaaacaacattgtcatgccggtctagatggcgtggcagtgttatttggtcacgacggtacaaaactgtcacgcttgttgcgtgtggcatgtcagtgttgttttgccactctaagcgggctggcatggccaaaagattcagattttgaaaataatattttgaagggtttattttaaaattaaaaaataaaaatgttcaaaaaaataaaaaaaaatcgatgtcaagtgggccaactgtcatgtagattaaaaaaaaaattaatcgccgcgtctgatgccacataagatcaaatccaatttgtattgggatagggggttattggtccgatttgaagagttgagtgggtagaatttttggttttatagtttagaggtgtaaattgaaccgtcgcaataattcaacaaggtaattaattcggagtttttctcaacaaaatactactatctcaggggatctttcttcagctcctagacaattcaccatgctagagtaatgtcaaggggtttttatttccaaaagttgcacttagtatatagtacatacacgatctattctagcctccttgcaaggaaagtagcaagttgctcaagctctacacggcttggttacacaaggggagatgggtgtcgtgttcgatgagagcgacgaggaagtgtagggcgtcgcctggactccgcagttgtgtcggcctccttacatgagggcctccatgatgggcataaaatacttaacaaccctggttaatcgctaagaagaatgcacttgtctgagctcccgaagactacaatggcttgcttatttgccaagagctggatactaagcccgccgtttagcagccgaggttgtgagcatgcatgacagcatgactgcgttcgtcttcgctatgccatctcaaaaatcgttctcatccagcacaagttctgcatcctccaatatcaggcatcgtgttttccctgggtaatgcatgttcttcgtgtttatctctggtgaaattttttgcacgtttggcttgcagttttctcatagcattgtgcatgctttgctcattgtcattatctaggaatgccgcacgtgatgcccaccccccattttccatatgcaagaaaggagttcagcagttcatgtacaccgaagtgaagcaacgagcacaaaaattagactccccaaaatagaagcagaatggccctacaaaatctttgcccctcaacgcagacttcctcatcagctcacacaagcaactcgcatactcctcctccttcctttccatcacgcaaaggaactgcccatacacagttgccaaggttggagttcgtagccaaacgtcgaagccaacaacctactaacctagtacaagaacaccgacgagaaccgacttaacaatggggttcctccatcggaagacctccaagcagacgggcaagctcaagaccctcctagggctcgccatctcacgcatcgctgctgtgcgccggcctcgcctagctcgcaagtccattgccaccgatgacgttcgccagcttctcaccctcggccacctcgatcgcgccatccaccgggtaagtatctacgacctgttctgatgaagagaggttgctccaatgcaagccatgctaatgccagcaatgtcttgctctctcctcacaggcagaacaagtcataggggagggcaacatgttagaggcgttcgaaatgatagagatgtactacaagcgactcatcgagaatgctgcaaagctggacaagcctgggtacatacatttcatttcctcacaccagactttatcgcgtcctctatctcttttccggtcacatgacaattgtatttggtgtgtacagtgagtgcaccgaggagatacgtgaggcggcagcggcagtcatgcttgtcgccggttggtgcggcgaattgccggagttgccgttcgcgcgcaccatcctcgcggacaagtttggcagtgacttcgctgaggcggcaaaggacggcaccggcattgttgatccaatggtactagatagcatatattgtccagtcatttcacaagtcaattttgcagttgtaaagatggaagaatagagagctaacaaagttggatcttgcagttggtgtggaggttttctggcaattgaacagcatggagctgaagaagaaggtgaccaaagagatcgccatggagaacaacattgtagtggacttctctgaactccaagatgcggtcaaggatggagaagactgatgccatggggagcttgagcacaacacatcatgcaagaacagcttggacggaagatcatagtactcaagacgacgaccgtgtttctgtctctgattaatatcttattactggtcattgaaacttagggtggggaagcaacggtgctcacgagaagataaacttgctctgagaccatctcaaattgtaacaactaactatgattgtacatgtgaaaaagtgtaaattactaacaaatcaaacagtgcacacgcagatttcttgtggcagttgtacaatgcctcttttattttcccttcaaattgtgcaaacttttattcttgaaaaagagaaattggtccaaagtgacttagtgacttatcaagtttgcaccacagtatatattgaagatttaaacgatctctgaaaaatatctgtaggatgaacctctgaacttttttttttttgactaagaacctttgaactatctttgtagaaattttatatggtgctcgcctagttcccattaatggggggatgaaattgccctaatagtctaatttagctagaggttccgacttatcataagatgtttggtagtcaaactaaatgcggatttttttatgaattttcactggtggcaacctacaaaggcacaatagcataggactaaaagccacagaagaaggcgaagcaaatatttggagatgtgatgctacaagaataacatggtttctttcaatcaagggcaacccactattctgtactcatatctattgtaccaaggaagcatgatttttgcagtagtgcaattacttggtggcatacatgctgacaaaatactactatcttaggggatatttctttagccccttgacaattcaccgtgctaagaccaatttgctagagttatggtctaggggttttgatctccagaactcacgcttagtacatatgcaatctattctagcccctcacaagtaaagtatcaaggagttctacacaaccgcagcttgtttgggttttaaagttcaagatttgggaaaccatggggcatggcatgttgaacacaagagaccagaatcgtggaattgactaatttattgaactcaaagtaacatgtcattggaaattatccagcaaacataataccatttcagttttaatcgcaccaatttccctcgaacctatcacatgatgatataaacaatgcagaaagaaatccttagtaagaggagagcaagcaagggcacgaaacctctctcgtcgatcactgtagcttcatctccatgatgctcttggcctttggggcgtacagagagtacaccaccgcatgccgttttgccacatccagctgcttcttcccgtccgcgaacgccgtcgccaagggcacggttctcgcagaaggcatccgctgcacacggcagcgcgtgtactcgtggatgttgtagttggataactgccatgccatgcggaggaagggtcagagcctccgatctcgtcggtgttgccaccaccgccgctaccatggatgcgcttcctcgcggatgctttttgtacgctagagaacggagtagagaagagctctcctgaatccagaaagatgcttgggctaatgcctaatgggctaggcgcctaagcgcggagacgagctaaaacaatgcttttttgtcaatttaacacatccaccctcatggagaatcctattatgaattggacccttagagtgtctaatgtcaatgtgcatgtccattgtcaaagtgtcagtgccaaatcaaatcaagagtcattaatcagttcaaaatgccgttgtgatttgaccttttgtccgtagtaggtcagttcaaacgataatacttttctacacataagaaaatagtgaaaccatgaattggaagattatttactttgctccatataaagttaaatgatggacaacacagataaagataattaaaagttgtataaacacatatcaacatagatattataatcttccaaacacatatattattttttttgcttattaactacaacaaaaatttaaagtttgaaacttaaatttagaattgaaacttaaaccgaattacctctctaaactcaaaaaccagacatcgttcaccttaaactttcaat

SEQ ID NO: 59782 - DNA, 83139 bp, Oryza sativa
aaaatgctagaatgacttacattatgaaacggagggagtatattttaggacagatggaataggtgggactaatagaaaaatgttgtgattagttggtaagagaaagtagaggggaaatatgaatggcaaatggttgttattgattaagaagagaaagtagataagaaattactatattttgaaacaaattttaaatgctggagttgtttatatattgggacagagtgagtatttgttagtcgtgcgtttttaatatgttactgttccctctaaccatgaataagcacaaagtttgaaatttgtttgacaattctttatctattttctaatcttaaccaatcacaaccttcttttatttatttttctttcttatcgacttccacattttaatcattgtaagcatccctcatctcaacctaatggtttatctggataacggcacaagaggagtgagattggggtagaggaatcagggaatgggttgagggttaccatgaaatgagagagggataatggatgactacgatttaaacatactctttgatcagcgcaaaatcatttccctaatccattaataaacctatgtgcttcctatgtgcttcccctgtgcaatggattctgttggcccttcttcagacggcgacgtgccctacctccactccatcgagggtgatgctttccatcatagtctcatcactccaaacggtgcctatatgttgttgaaacacgcagaattttatttaaatcttttttgggcatttctatctaaaccatttgtgcaatatcgccattagattgtgtttagtccacgccaaaattaaaaatttgtttaaaattaaaatgatgttatggaaaagttgaaagtttgtgtgtaagaaaattttgatgtgatgaaaaaattggaagtttaaaaaaaaattggaactaaacacggtctagaacgctcttcaagtttttattcttcaagtttttaatgatgcccgtgagattctttgttccctagactccaggagcctcgttgcacacatcatgcacgtgctggcaccaattcggctttcacttcgtcgtctctgaaggtcgacttctgtgtctcttactggggtggaaagatgcaaatgttcctccggcgcaccattttctcgacgaaggggaaaaaaaaagtccgaatgccacaagcagaagatccgactaacctgacgccatgaaaagagaggcaaaataaagataagactttgggatcacaggagctgatctttctttttcttctcaattatgggggttcctttcaagccttgggatagtgaagggtgcagtccatttgttgttctcttcagtcttcagctagtgacaggaacttggccacctcatggaggaggtaggagagcctgtctccctaaacaatactagtagtagtagtacctaccactaccaatggcgatgctccttgccatatctcacaaggaattgaaaatgctggcctgttccctttcctctagcttagtttatggggttcacagggcaagtagataaaaaagaagagaagaggaactttctgcaactgcaaaccacattcggttgagatcaggtgtacttatttaaacggcatggtccttgtttcaaaattataatacttaaaggatagaaaaactatggcagtttggggaaatgatgagatatgcacatttggcagatgctaacatagttgactgacgattcttatgaggttatatccaatgatcattgtgtttgcttgcaaagatagggcaacttgtggcaatatcatacaagatgttggggggggggggggggcgcaataattaggaggttaaaatgaacaagcaaagcataagttttcgtgtcattagttgttaggtcaactgcttaattgaactatacagatccctactacccaacttaagttaataaaactgtatatgattgaataagtcaaagcaagtgccgaactatatcagcgtgtacatattggtgccctttatgcacacgcgattttctgcacatacagaaaggacgaaatcatcaaaatatatacctcaggaataaagaataatgtgtgttaaaaattaccttcgctgatctgaacacgatttttccaatgacaaagaccaaaacaaaagctaaaatgtgtttataacccttccagcattcttagagtagattatcactacacaacatccacagttgtttaacaattactccctccgtttcatattgtaagattttttggacttacctagattcatccattgattaatatatatgttttctacatgtgtctagattcattaacatttatataaatttgggtaatgctagaaagtcttacattgtggaacgaaggaagtatataagaaacaaacatatttcatagtcgtaagaggtcatctctcactattgtcatacatactttgaaagttacagattagaggctgatgtgatttttcctgtgacaacgctgaaatttgcctcaaatggctgtcaaataataaagaaaagcgagggggggggggggcaataacagattgatttattgacctctatgtttatttgctcaaggttcatggcataattatacacgaccgtgattttgttatattatactccttgtgtcccaaaataagctcatttttcacccatcccacacataccaatacaaaatcagaaatactataatacccacactttataaaataccaatgcaattattcatctccttatctactcccaatgcatttatcccttttcaaactccgatgcaatgattgcttaaaaatgaacttattttgggacaaacggcaggggcaaaaaataatcttacgtagacagctatgttcaaaaaccaacacattactgtctatacctaaaagtccaagattttcaaaacttgagaacatggtaattaaagtattagtggtagttggatgactgtagagaattttttttactttcaccctgccagttataattatgatatactatctatttcagggatggggcccttaaggattcacatcagaacacagacttaagtgactaatttgttacaccatcagacctttttttatgtgaatggaagtagtcatgacacagtgcagtttttatttcatcaactagatgactgttgagccgataagagtgaacgatgaccattcttgtcctcacaggctcacagccacatgatctggggctcaaaacatttaatggagtgatccttctcaaaccaaatactggactcatgttaaaggttttaaggggtttctatcatgtttttgattgttagttgagcaacactactacctaaaataatatgctgagaaattagctgtcatgacagttgatactgaaaagcaaaaacaactaatacttagccattcttgtagcaaaacctcattacatatttacaagaaaacccaatggatcaaaagagaatctcaagcatcttatgtctatcatctgaatattctgcatacattcagaaagcataattatatttcttctatacaaacaaaaatggtagggaaaatcaaagtcacattttattatacacgttggtctttggttttagtttttggccagaaattcctccttacaagcctaatttctcaacttcccctaaaaaggcctaattcctcgacacaaaccatccaattcaatcacctatcatttgcatttcatcagcacaagaccaagccacatctgtaaacacttgaaacgtcctcaccaaactttagcaagaacagagactgaccgtgcggaaatcccagtggccaacgataagccaaacgcaaggacgcattgccccttcaagcgtagccttttccaaggcagttcaagcagcgctgcaccctgaaaacatgtttaaaaaaaaatcaacaaacatccatagcagcatggtcacagcagcacagcaattcaaaggggcgtgaccaaaggtcaaggaaatctccgcaaaggacggccaacctagtcccgtcacaggtagggcagaggcacgggttgacgaacaccgggtcgtggagcggagaccactcgatcgtcgagctgcccctgcagagcctgcacgcgtaggtccccttcccctcgcaggcgccacacggcgccgcgaatttcctctgcgcgcaacagcagcgcagcccagttcaggtcagggcagcgacggcggcggaggcggaggcggcaaactgagcgacaagggtttgggtgtgttgtagtgtggtacctggttggcgtcggagagggagcggagggagcggacggcggcggaggacgcggcggagaggaggaggaagccgccgccgaggtacgccgcggcgcgcccggccgcctgcagctgccgccgcgcgcgggcgtcgcgtccgccgctgccgaactccatgggcgagccgagagggggtctccgctcgctcgctcgcttcccggccgcacgtcgtcgggacgagacgtgagccttcgttttccttagccgattgcgcaatcggcccatttagttaggcacagtaaagaattcggcccacatgttgagaactgaggagccatagtcttctcaatctaattctctgattaccgattttatcttggtttgtgttagcaagtttttcaagctgctaaactgatggaggttgctttaaaatatcatataaatctattttcttaagtttgaaataattaaaactcaattaattatgctcgcatggttttcgcgtttagctagagtatgcgataaactactttgttttatgctaaactaaaaaaagcttaaccgaggacaaaattactgtttagatgagattttaccttaatatcaagtcagaaactgagggttgtgcccatttgcaggaatcaaataaaatatcaaattgttctagagagagctttggttaagctgaaactttccattatccacattgagtatatttccagatgttttcaaaaaaaatttcgcagctcaattcttgcccataccacagaccggactctgaaactaagtctgagcaatccctgcaaaagtgtctacagcaatgatggcctaaagcacgattagcagcatggctaattctcaagcctcaacacgtcagggggcaacatgatggtcaccgcgaaagaaccatctgaaaactactctgttatcattcatatgacatacgcatatcacctccagattgaatcgaactatttttcttttattttccctttcaaaggagatctagtcgtactaacaaggtcacctttcctgtctacatcaatgaaaaaaaaaacgctatctttgtacactttggcttgtccataccatcttgaactttcatgcccacacctcatgacgaagggcgaacattctgttcctttcatccacattagcatttgaagctttcttggaatccgatgggtacatgggaccagaactgatcaggcttcagctagccctgatgagttagttcttgtgggttgctcgattgataaccgacggcgaacattccgctcctggaacaaaaggaacaaagaattgaaggagatcaatgtattggcaaatagctgaacaattatgcactgcaacgacagtctaagtatcaagaaatctactgaatgaaagcgtgggaacagcaaaggattgcaggcaaccaaagctgaaggcatcaaagtggagtcacagtcaaagacagttcgtagtgcttcagatctatcatagtgcacggcatgattatctgagacaaggaggaagataaaagcttcatgtgttgactgggattcagataaagcaaaccatgtctattatatatgaagcacctgagccacgacattttattaaaggagcatattgagtcatgctcagaacatgcttcagacttcagatccctcctttccatctaccatatatctatctggttaacctccctccctctatctgattaatatggggatttctagccttttagagcaaatattgaagtttatgtagtatcaccttaatatttgataaacaataggtctcagtacaacatgcttacatagcaaataatgcctgtcaggattagtgatttagctcatatagccaaccggatgcatgggaaatctagaatctaaggcagtcatattcattagaaagtaaaccaactcgaccaacatgcacagtacataatcagttctctctctctttttttcaatgtagcattaccttctttttcaacatatttatcacaaataagcacatatagcaagtaaatttatcacaagccatagttcacttactccaatttcagtgacaaagaggcacaacgagcacttaacagcaggcgcaccaaaaggatacatcaataatgtcgcacagtgtccacaatgcaccttaccaacttcatgagctgcaacaaacatagggggaaaacccatgcaagggtaagaagatgcatatatacacacatcggtacatcagtatttggtaaaagctataatacatggaaatattaaggacagccgtgcttcaaaaggaaagacaaagacgagataaattttgcgcaaatggcatccatattttgcagaagtgttgcatgaaaaagctttagagggtgtgcatgaacaaatagtattataaaggcaagggcaaaattctccagttctctattgagtggtccaatgttgaaatatgtaaccaaccatacttcttacacataatttagacagtagcagaaggcaaatttttgagaaaaagcatgttcagtattcagtaagtatttccacagaagtaagatacaagatggctgatatctataggtgttgaaagacaaaataaaaattatatggggcataacaaaagtaaaacactgttgggcaaatgagaaatagtacgcaccttccaatacatagttcattgtctggcaacaagtacagtgaacataaccagcacctctaaaataagcaagaagaatacggcagcttccacataccatttgacctacttctgtacaagttagcaacagaggttacttatgctcagagagagagagagagaattacaccggattacttatatactagccccagatttatttatgggtgaaaagctgacttctttggttcacaactatgtatgaattgatattgagggattggataacatccaaagagaaggtacacagaagcatagtatattcctttcatctattgctctaaaaaaaagttagtactatatttcacaattgcaatcaaacttcatcattttggctgaaactgtcttaagagggaccaggtatacacaaataggggatcaatggagatataagtgagcatattacatgcttttttgaatgaatgaaagcacattacatgcttggtaaactttaaggacttaatgctgattcccgcaactagttcattaaatttatatctgctagccacagtttgcatgagcattcttctttcaaaatcatatcaaagactgagaatcacaaaaaacaagccaacttttttcacaaattataggaaacttatatagtctaagatgggcatatgattggtacatgattaatcaatggaaagaaaactgttcgtagaactccaaacacgacccagtagcatgagcacgcaaggctggccaggttgtccagttgtccttgaacatcaaggaagccaagttaagaggttagaatagataagatagaaatgtgtttcctgttagtggtaagagaatcatatttaggataagatgtttctttagcttagtgagccatgtacgtggacgtcctatgtactcaagtcagggtatcaatgaaatagaccttcctgagaaacttggtcatctcagagcctctgcatggtgtttgatccaatctcacactgactcattttcaccttccaaagacccccaaactcatcacaaatactaagtcaacacaaacaatagcagttatatagacatggaattagaggaagtgagatgcaatatactaacctttatttaggtaaggggaaggtggtggtggcaccaatggcacagagtcctgtaaacaaggtgaatcatgtgcggtagaagagggtggatgctgaggctgcaatgactcatccactataccctcagattgtggctgcattgcagttgtactgacaaggtctgtagtagttgcctgcgatgcaagtggtagctgagacatctcctctgaggccacagccacagactttgagtcagatgcatctagtaagctatctgcagcctgtgatgtaggagaatgtgactctgattctagttgtggcagtgacccctcagaaatattcttcagtggtgatgaccgaatgggcactgtgccagcttccatttcccctgatacaagcggtcgctgaggcgattcttccaatgccactgcaaccctgtcaatggcaggaacatcagccaagccatctggggtctgaactggagaaataacagcaggcagtgacagaagctgagagggctctgaattgtcacatcctgaatgcaccatatctggcaaacaggttgttgtatccttttctgcaggaggaggttgcgcgaattgctgcggagatagcccatctgctccactttcagatgatggtagcaatggaggtactgcatccatatgtacacccattacctccactgagtgcagtagctgaggggcttcctctatcacagacacaggttcagttaccgattgatcttgtcgcacatttgtggtttgtgccagagatggagatggtagcagtaactgtgatgacttataggtttcaaaccctggcggtgccctatctggtgaacagggcgcttcttgcattatgggagaaggtgctcttggcagtggcttttgcaatgactccactccactgtcaaaaggcagcggtggtggatgtatggcatccatgtccacatccattgcctccaactccaatgcaggtggtggcccagctgcttcttccactgttgctgccaaagcatccgctgcggctgcatctggtacagtttggggcagagtgggaagtggtggccatgatgacttaaaattctcaaaccctggaggtgccatctcctcttgtgaacatggttcagatgatgacttaaaattttcaaaccctggaggtgccatctcctctggtaaacatggttcagatgatgatttgaaattatcggaccctggaggtgctatctcctctgctgaacatggttcagatgatgacttaaaattctcgaaccctggaggtgccatctcattttgcaaacatggttcagattgcaccactggagaagggggtctcaatagtggttgttgcagtagtccctcagtcccttctgttggcaagactgttgtgggcaagatactgaggacagtgtctgactccatgtttgtcacctccaaagctggcaatggcctagacacttcctcaatgggtgcttccactgccttggtaaccaccacatctggcaagacatcagtggtttcaactgggggaggagtcgtgggtagcggcaaccatgacgacttaaaattctcaaatcctggcggtggcgtattaggtgagctgggctcagcctgtgtgatggaggcaggtttttcaacatccagagcttccgatgaagggactgactcaaccgcttcctccggcatcaccaataaaaccttgggggcagctgcgactggcaaggagggcattgattcgccaagtggtgtaggagggggcaacggcaaccatgatactttacagttctcagatccagcaggagccatctctggcgaacttgtctcagtgccaattgtgggagaaaatggtctctgcattgactcttgctcaatgttcattgtgggagaagatggtctctgcattgattcttgaagtgacccctcttccctactctccaataccagaggcacactgactgctgcggtaccagtctccccgtacattacctccatggcaagctttgaaccaggagcttcttcttgcatccttgctactacatcgatcttggctgcatctggctccacactctccaataccggagacacactgactgttgcagcatcaacctccctgtacgttacctccatggccaacattgaaccaggagcttcttcttgcatccctgctactacatcaatctgggctgcatctggctccccactctccagtactggagatacactgactgctgaggtatcagtctccccgtaagttaccaacatggcaagcgctgaaccagcagcttgttcttgcatccctactactacatcaacctcagctgcatctggatccccactgtccaatactggagacacactggctgctgtggcatcagtctccctgtacgttacttccatggcaagcgttgaaccaggagcttcttcttgcatccctgctactacatctatctcggctgcatctggatccacaccctccaataccggagacacactaactgctgccgtatcagtctccccagacgttacctctatggcaagcgttgaatcaggtgcttcttcttcttgcatccctgctactacatttttctcagctgcatctggatccccaccatccaataccggaaacgcgctaactgctgcggtatcagtctctccagacgttacctccatggcaagcgttgaatcaggagcttcttcttgtatctctgatactacatcaatctcagttacatctggctccacactctccaatactggagacacactaactgctgaggcatcaggctccccgtacgttgcctccatggcaaaccttgaaccatgagcttcttcttgcatctcttctactgcatcgttctcggctttatctggttccccactctccaatacaggagacacactgactgctgcggcatcagtttccctgtacattacttccatggaaaactttgaaccatgagcttcttgcacacctgatactacatcgccctcggccacatctggttccctactctccaataccggagacacgctgactgctgcggtatcattctccctgtacataacctccattgcaaccgttgaaccaggagcttcttcttgcatccctgctattacatcgatctcggctgcatctgtctccgcactccccaataccggagacacactgacagctgaggtatcagtctccccgtacattacctccattgcaaccgttgaaccaggagcttcctctggcgacaccgctactacatcgacctcgactgaatctggcgatgtgtatgcgatttcagccggactagtgggaggaagcggcagctccgcaggctccgagctatcacactccggatgagttgtaggcggtggatgcggctgctgctgctgaaacccctcctgcccgctctccaatggcggcgtcggcggttcaggtgcggtgcgcgagcccatgggttcgcgcgcacgggacgccattgccgcgggctcggcggaggatgcatctggcccgccctccaatggcgtcggcggcggcggcggctcgggcgcggcgtgcgagccctcctcgtcgccgaagcgatcgcgcgtaggggaggactcggtgtaggatgaatccggcgaggcgcataagaccagtggcggaggagtgggcggcggcgacgccggcgagtcatcctccgcggtttcgtacgaggaggaagaaggggatgacgccgccgacccggggtagaactcggccgccggctcagcgggaggacacggcgaaggggagccgggctgccccgcccccgccgccgcggcttcgagcgcaggtggcgccgccgaggtacccagctccagcgaggggaagaacgaaggcggcgccggcgggcccgccgcaccgggggtcccaccgatcggaggttgcggttcttccgccctgggccacccctcggtggcctgacctggagacggcggcgggatcggggtggcatggtggggttggggggatggctccggtggaggagcgtcggttggtagggaggggtctccttggagaggaggaggagaaggggaatgggatggcgggggtgaacccatgcgtgcgctctccggtggtacgggtgcctccggcaagctcgccatgggtgagggggtggcgccgcgacggcggcggtcaccgggaaagggaaaacggtagcggagcaaagagagaagcaataaaatgggggtgtttctactggggtttagcccaagtcaaatctcggccgttcatcctttgcgctgaagtttttttttttttttgttgctcacatggacaggacggctgatctttttaataaaaaaaatagatatgtcatataacttttaaaatctatgctattcacataattaaaaccgtaccaccgtgacaaatctaaaattagatccacgtcacattatacgtatgagatatgctttgaatcgtcttttctaccgtatatttttatggattaaaatacccctaatcatgatccccatttctttagacgttctcctcttcagtagcagtagctaagctagccaccaccatgatgaagatgactcggatcacttggatatggcctccatggtgacagaccatgggaggtcgacaacaccggcgcttccatcgccagggttataggcaaagtggatagataatggaatttgtcgcagaaagatcacctcgagcacggaatcgatagaccctcctctcctctccatgtaagttcgggctagggagcgagggtgcagaacaagagtaatcacgtgagtaaatgaggtgaaaagcagttatacatgtccgggtcatactgagcgtaataccctactcctatggggttctttcattgctcagcggtttagaagctaagttactatggagttgcgaatgtgtttaaaagtttctaaggttggatctgatccctcttttcggtggctttggatcttctcttgtagtcaatggaggaataccacagtgatcgagttctttaaaaaaaggccttagtacacaggggttaggtatgggaagttttgtcacttaccgacatgtcgatgtaggccatccaatcttgatagcgtgttgatgggcgtcccgagcagcagatattggggatcatgctttgtaattcaccaatagaatccattccggtctttacttcaaagaagttacaactaattattatagatgttgcagttcaaactactatgaattacaaaatcataactcgattgaaaccaacaaaactacttagaccaatagcctgaaggtagagatggcacatattgctaaacttccaactatagttaacgaaaatatgcataactgttgtttctacgcaacggtttgcaagttgtatgtaatcattgtcctcctcgagccaggaagcaaactctccgaagaaacaaaatctctgaaagcagcgattgtgtcgcttattttttgcgcacatcatcattggcgacttacatcgaactaaagtggaagatgatgtcaaagagtaactaagttgtaataaatctgtcatttccctaatctttccactctcattgaatccaattcattagggacaccatcaccaaccgacggtggccatgagcagtgctaacgaccgagaagtttgttgactggcctgtggtgcatggaggaaaaggttcagcggcacgccaaagtctcaacatcatggaaggcttgcaatactcttgggaactaatgcacatcctcgtcaaccccaccattaccatgtgcatcactaaccccttggcgtaagcggccacctcatcgtcgccatggtttacgataaaatccgtctgtactctcactcaatgctggtgagatgtgcctcctcgagtgctcccataggcccatggcagttggtggcagcaaaagataaaggagaggatgtgttggtggacattttttgagtttcgacactatctccctttggtggcggcaaggaaaaaatcagtttctcattcgcttattatgatatcctcttttctcgctctatcctcattaggttagtagtattttttttcagcttaaaagaagtgtctttgatacttgtcacccatgtcttcgtttcaatagtaaaaatgtaaaaaaggtcatgtttccttccacaacaaattgccagggccgtccctaggccggtgcggggcatgcaaccatataaggcccctaaatccaaggggccccaagtggtattaaataccctaagtatataatgttatagtgggctttgtttttattattcttgttgttcaaatgagttttttagctcatagttggcacaatctctcttcaactctccgtatctcctaatttgtgggttctcctgtctcactcgcttgtagttgtctctagggtcgcttcacatttgctctttgtgtcatgccaatcagtatcgcatcatggaaaggatgcagtggcagcaacaacactgagcgctcatggtcgccgtcattgctcttaattattttgtggccgtaggagatggttacggcgattgacaacgacaagctccagccttccggtatactccctccatcgtaaacaatgctaggttggtttttattgggatggagggagtaaattccaagtccaagccttatttttcctcttttcttttttttctatattttgtatatacaaatcagttgatttggtgtttcattgtttcaacttacaagccaacttaagtttaggtcccatttagcgttccatatagggccaatgaatttttctgggatggccctgcaaattgtacatgttctactactacaatggcgcaaaaatatttatatttttttgtctacaatattgtactcagtaaaaaaaagacattaatgaattttgtagagaggtgaggatgatattgggtactgaatagaggttatgatataccgttacactcactatatggaaagatagctgacggcgggaaccccccatgataaaataagcacaaaagggtatagtttttgttgtcgagacaattgtggtctatgtaatcattccatcccatatacggacaatatacatataactcataaaataggttgtccgtagtataattaattatttatttagttttgtagatggtatataaaacatatatatggtattaagttgtctattaggcttctttatctcacctccccttattaaaaaaaaaatctacgtgacatctactctagacactgacatcgcgctagtattcgtgccttaaggataaagtaagaatgtgtggtatgccgatttttgtttaaatacaagaaagaagcatgtaccttatggcagaaataaaaatagagaatgctgatatatttcaaagatatatataccttatgtaccttatgtacttctttaaaagactccaatgataatggtgaatctgccaccacttcatcgactgcaatcttacagataggaccactatccttcatccattttcatactgactagttaattaacacatgagagagttgcagatgagagcatatagtagtcggaaattcggaatggcatgggtagattagatggtgacattggcattatcgtatgctgtgtgctccaaacccataacagaagtacgtgtattctgctagtagaaaatgatgttgacaagagcccatagaagagatgaaaagcccaaggtacatactatcagtacggacaaaactcacttgatgttcctctttgtattttttctatttcttctagcttttatatcatctaactattttttgttagagaagaaaatgtatttttccatcacttggcggttgcattctcattctatcatttcgatacgacttatcccacatctagtcaaagctgtcctaaagtttcatctcacattcatccataattaaatagaaatgttattttcttcagagaacaacattcaaaacaaccctcctccgaaaatactacaatgccagagaaacgcccaggggctccacaaggtgtgagctggacgatgtgggtttgaagtttcgctccttctaattatttgatattagatcattgcctaatattcgcatctttattgacatggtatttgggcagtaaaaccttcatcctaaatcaaacaagaacagagggcacacttggcaactctatgggggaaaatgatatttacacatgtacaataacaatgaacgaaagcaacttacaggctacagcatggaaattcatcagcaccagctgtccggtgaagcatgattacagtataggaaaaactgaaaagatttcctttaaaaacaagaaaccaaaaacacaattaaagaaagaaggaaagcccattggatggttgcaagttgctgtcaactggcagtgactctgtacttatagtgtcctttcattgcttaatgaatgcttgttatagtcaagccagattaagcaaagcgagcttaaataccaagatattattttcaatggagtaactaagaactttttaaaattttaattgcaagagaatgcttgtgccgtatgaaagtcccaagaattttacgtcacacctgtataaaaattccagctctctataccttctatatatatatatgcaacccactaaacacctaaacctcaacatataaccatagtaattattagtacaccctaatgcctaacatataatcatgttatatccaccagtaaacacccaaaacttaacatacaaatatagtaatatatgatttttatgacattctaaaactcaacataaatgcatgctaaatcatcattttgatgcatgatgagaatagtctcatgtttgtctggtttccatggttcttccaaatcggattatcctctagtatttcatagtaggaaggatagaggacaaacgttacaacatgttgatcatgcagttaagttaattttacattatatgctttcatatgtgcagctatagtattcttacaatagccacaaattttagaattgtacccatcaattcaccgtatacacaacacggagttgaagtttctagcattgtcaggtaaaaattggatggaacatcccgaacaactcatacaaatttgatcctccatattcccatttggaagaccatacaaaaaaatattccctcttcgtatcccttttcgctctaatagattatccaaattacatcctccatattacaccattctatattttagtaatatattccaatattatttttattagctatattttaaatgattaaattctaacgctattatttgtaacggatagattttttaaattattatgtttgaatgtatatatttgtaatggactagtgggtatttttttaatggctatatctccaacggatggatatttttttagcggctagttgtaacggctactatattagaattgatagctttccaacggctagatttcaacactacatataccattacattgtttgctatctttttcctccatccacattgttgtgcatcctctttcatcactcaatgagctacattttgaggcatcttctcttggatgattcattgttggacgatgaactcatcgttgctgtagcaatagtcgcacaagataaatatgagcagtcggatcctccactacgatgtggttctgttcctgttcaaatgctccacagcggggtgcgagtgtgggcacggggcgacgcttggctgccgtagcagcctagggaatcggtggcgcagcgggtgccaacccaaaacccatccccacctcctaatctggtacactccttcctctctacctccactcctccacggctccaccagccaatgtcccgctactgccaccatcattgtaaaaaaagaatgacaacaatgacaataatggacaaggggttgctccgtcaatctgaatcgggatagctcggtctagaggtggcggttgcgatatggcgtgaggggagaggaacgctaaaatttaacgtttctctttgggatagcacacacgtgcccacatagcgtatctgctggagctggttttttttccctatgctatttcatcgatgaaggactggatatagtatccgttcgaattgctcttaggcccagttctattcaacaactgaaactaacttacttgttatccgatacgacgcttttcaaactattaaatgatgcgatttttgtaaaaaaaattatatatagaagttgtttaaaaaatttaaataaatatatttttcacctttataattattaatatttaattaattatgtgctaatgagattcctcgttttacgtgtggtacaaatcttcctcctccacctgcaatcgaacgaagccttactttcctagatattctagtgtaaatcaagtatgttgacttggaaggaagttccaacactttttcgtaagaaataacatgatctctccgacggaaaggaaatgtctttgcatccaataaattctaatgagctaaaactttcctgtagtcgaaccatccaatttttcatcattccttttatgcattttttaaagttttttttcatttacagttcatctcattcatgtgtttgttttccatttctgtactttccatccctgtgcggcctaattctgcccaaattaatggcaatgccttttttttccctactgagagagatttttttttccgtggaataagggagctctatttttcaatgccattttcttttcaatgtcaaattaatggtattgaaaaaaaaatgctggatcctcgagcaatcactgctccgtgccaagtccaagcttagtttttgccccatacctcgtgcgcgattcgaaactttttgaattttgaattttgaaccttgaaggcgagtagagttcaaattccaacgtagtactactagtagtatccgccgcggtacacagcacgaggacgaggggggggggggttaaagctcaaatcaaatgagcatccaaagaaccacaccaggggggagcactatggccgtgggccccacctacgcgctcccggccctatggcccacccgaatacatcgcactcgggcggggggacacgccaggacgagtccacaccgcaccggggccccacctgtcactgaccagcagctcgtgctgggggggagcagcctcccgctgacgtggcgtccgggtttaccataccactcgcaccaacaggaaggctggctggtggtccccacccgtcatcccaccgacagggcggtgcaccggggagacaccgacatgcgggccccactgaccggccgtggtgtccggctcacggcgaggtcggtccacgcgggtgcgggccgggccgcgggcgagagaaccctagccaaccacgtcactgtccacgtcacgccgaccaaataatataaagcggcacccatcgcctcagcgcctccctctctctcgagtctcccgtctcctttcccctccttcctcctcccctttcgtcttagcctcagctcgccgcgagacgaatcctcccctcgccgccgccgggtccgatcgacggcggtatcgagggacggagggggcgcgcccgttctctcgccgtacaccgtcgtcgccgaccggctccctcgacggcacggtaaaataaaaaataaaaagcctcctcctcctcctcctcccctatgatggcggatgcggcggcgggggggcgggccgatctggacgccgttgacccgcccgattcggctcggtcgcatccccccgtgcgcgcgtttactgggaggatctgttgtatttggacgttttagactggatcgagtgagggggattttgcggtgttcttgctgtgacgggattcagctatgtaggtgtaggaatcttatgttaacttgttgggtggctctgctgcttctgattctttctgtgaatctggagtaacaaattctttctgtgaatctggagtaacaaggacttgtgctatggccgatctctacttttagtacttcgttatgttctatacggcataggagtccatctctcgatagataagagttctctgattttggatggggatttgcttgatggatccggagtcatataacatgtttgcaaaaaaagaaaaaggaggagtccatctctcgatagataagagttctctgattttggatggggatttgcttgatggatccggagtcatataacatgtttgcaaaaaaagaaaaaggaaaaatgatttagtttgtgttctgtcatgtataacccttgtttctacaaagatgtactagtttgcgatctgattaagcatctcatgctttctcgctttgattctctttcagagtttgaagttggaaatcaaccttgttgttctctgtagcgctttcctttggattgcggagaatttcaaacaaaaccaacaaacctttgcatctgactgacttgaggtaactatgccaaaggacaggagcacccgtgccgtgtcatacgagcgccgccggtctcgtgtttcgccgtacccctccaatgggaagggctgtgctcgcaggtcagaggagtctgctgctgctgccgctgccgctgccgcgaagcaggctgcggaatgggaggatgtccgctgcccggtctgcatggatcacccacacaacgctgttctgctcgtctgctcgtcgcatgagaagggctgccgccctttcatgtgcgacacaagctaccgacactccaattgctttgatcagtaccgcaaggcctctaaggagtcctcaaaggattctggtgccagtgctgctgctgcgccagaatgcagcgagtgccagcagcccataaaactgtcttgcccgttgtgtcgtgggccagtcagccattggacaaaggattatgatgcacggaagtacttgaacgtgaaggttcgagcatgtactaaagagtcctgcgagttcaggggggcatacggtcaactgaggagacacgccagggagaaccatcctactgttagaccaactcaggtggatcctgaacggcagcgagactggcacagaatggagcagcagcgtgatcttggggacttgttcagcatgcttcgttcaggcttaagtgccagggaggacgggatcggagtcagtgaaggggaagaggatatcagcgagagggctctacatagcccatctataacaatggtcttcattgtgcgcactggcaggtcgatactccactacagggaagcattcccaggccaccacagaagaagaacaattcttctgcttggggaggcttttggtcgtgaatcctccccattagggggagcaagtggcagtggtgatggtgacaccacagctcgcgaaaatgatgaaggtgatgacgacgtcacgctatcaacagaggcatcggctggttctcagcatgatggtgaagtcgatggtgatcctgcacattgatgcagctggtagggagtgccaaggcgtgcacctggactgaaaagctctacaagcaagcaatctttcgggttcaccaggcatccaagaccacatgttgggaagaaacatgggggtgttccatttggctttaggcgtagtcaggacatcctgcctacgtgcaagaagaactgagatgaaattgcaatgcagggataggctcaaaaccgctgtggagttgtcttagtttcatttttaatatatttgctggaaggtctgtagcaaacagaaacatcaatggtggtggtgtatttatcatgtccacggctaggacttgggtgaattcaattcactgcgttgtaatttgatctctgaaatatattctttctgcgttgatgaatctgatcatgttaaagcagaaatttgatgtatatttatgtatataggtgcactttggttccttctacattgaagaattcggtcatatgctcctgaaagttgtgctgtgttcgtcagaccatattgtttggacatgagctgctctttgtgggcttaggcgcgtagccttaacttgtcttcttgttgattagaaaaattggatggacacttctatcatatgtataatacaatcgatagactctactttgtgcattaatagacatacagcaaaaaacaatatttgaagctgtgtcagtttctgtattcgatggcaggctgcatctgcgtctaatcctcttcaacggttcagtatgggccaagaggaaccgccatctctgccgttgcaacaagagtagttactgcctccaatggtatggaaggaaactgacgcccattgatccaccatctgagcacactgaatttcatttccttctttttctgtgaaaaatcctacgaatagaattaactctctaaaaactactgaaaatatttctatgtttgacctgtaggcatacagctttctcttcttctccccccatttcttgaactgcagatactgtgagtgcttcagcaacatgtggttttgctccaagctgatactgaagaagccttaggcattcagaccaaagatcgtcgatgtcagtgcaaatggcttagccgattcggctgtggtaagtgccaatacctgattctacactgtgttttcttgttcagttaggctcaggttattgttctgaatctttggatgaacaggatggtggcgagcgtgaggaaccaagtgaagggatgcgcttgctgtaagtctggatgcaggaagctttactgtgagtgccttcaaggtaaacggaattacgtacggatgcgctactgtcctttgatgcttattttgtgatgatcgtgtcgtgcaaatcttacgttcgctttgtgatttgaaaaacaaagttgcgtgtaccgcgagatgccattgcagagggtgtggcagaatgcaaaagatggtgagtgctgcatcagacgtttattcatgttccttagcatattttctttctttctttcttagtttctttctcttttttttttgggttttctaatggttaagttttttctttaatgtcagtgactgacacagatatacaacgatttgatgacaatggcgattctagtgggacatctggctattccagtggaacaataatgggacagtacaaattgtagacgacaagaggcattggccaacacaatcaagtatgatggaaaaaaatattatagttggctgtccttggaatgttgatccatataattcgtaactgtccttgtgtgttgaacttcaactagtaaagtttgataactagaaaaggcggtggtttgattctttgatgtgataatcatcttggtgatctatttatgcacctgttctactgtttagcctattttcatttagttgcttgaaattctatggttgtacgatatacagtatttttatgatgtgtaatgtgttcacgattagtcaatatttttatgatttgttcctttgtgcagtgatgatggccttgagatcagaaggtttctcaaacatattggtgatggagattactttcagcaaaatggtcaccccctaaacaaaccaccttcaagaacataggtatgtctgctgctgaaagattatctatactttagacagctcatagtaacaccttatcatcttatcttgttatgatttatgaattatgataccttgaaattgtgataaaatcgtacggttaatttttaaatctctcatcttttgttggtccaggggactatgatatcatgtaacgaagtacactaacatgatctagagcacaaatatattatgactgcaagattagtgaggctcgatagcattagtaacgaaagtatcaaacaagcaatacaatactacattatacgcatccctctttagcggtaacaaagtacatcagtagaaaactacaactgtaacgtggtatgcagttgtttggaaaacacatagtgttacatatgctaccaaagccatgactgtcacaattcacatatcctaatcaaccttctcctgtatattgtcaataccttcttctcttatacatcactaccaaagccactgaaccgggttcatattttcgaattagccgcgggatcggtcaagtcccagccttgaactgagccacttgcagacatcgtccatttcttcagggatggtataatgccccaggctgtgtaaatggcatcatgttagttattctagttttcagagaaaaaaatgaagatggggaaaattaagtaagtgtgtctatacccgttgtagggtttaaaattcagatactgaaaacccgagcctcgcaggaaatcggctgatttctcaccatttctgtaggtgacaacctcatcagctgcaaaggcaaaaataagtagaacatttttagcatcattacattttatacacatctagttcaaaacgattgcattgctcacctcttccatggctgagcaggattggtaaggcaccagcccttctcagtgcagtctgagagctgtccatcttgctcttcagagtcctaaataagaacacatgaagaacatcacttgtaaggaaatcattgcaaattaaattattattatcattttccaaaacgatcgaagaatagaatcagaccttgaacagggaagccaaccgctcaaaccgatgacggcgctgagggtgaccgggtaggcaacgccgtttgtgaatcttccatgagcatagcatgcagcagagtggagggcagcggcagcacccatgctgaaaccacctatcccaagcttcactgaaatttgaaattccaccaaagatcagtaagacaaatacagagtattctaaagcttatttaatattttcacattttttttccttttgttctgtaattatggtacaattctgaaaatgtaccatcagatggctcggatgacagtaggtttgcaacgtgtgcagctgaagcatcaagcccttcaatatcatcacggccatccacggaagtgtcctccacatcaaaccctgtttcaatttcagtaaaaaggagaacggcaatatcagaatctgtagccaggttgcagcaaaagaaatggcctagaaaattaggaaagcaaagctgcatgcttctttttttcttttttttttctttttttttctttttggccaagtcataaatggttcagaaacccacatgctgtgcaagggaatccaccgaaagcagcaacagggcgtgttggtgcagtagggcaaatccatttgatctgcataaggatggtataagcttgagagttaataaacttagaactagcatgaacaatgctattgctaaaaatctttttaaaaaattgctatggctaacctagtgattcagataagttacattaatttgaagagataacagaatgaacaagtctatacatgcattattgtgcccatttggaatagggataggaatagaaataagattgtaggtgaagatggttgtgtgcatgattgattcaactgcaaagtgagagtgcagtatggtatcttacattaggcagaggaagagaatccagtagctgggaccagctgcagaagataaaattatgaaaaagaaacaagaaacaagattaggccagtgtttcaagaaaaagtacatgttacagctagtcagcaacttgtgtagagatatttcagtgctgtgctggctttctatcaaaactatagcttcatctaatgacattaacatgtcaacaaaagaagggttatcagaaagtaatggagaataaaagaagtaaagagtgaggaaagaataaaacatgacatagcacaacactggatcaaactaaggcagctaatgagctggctagagcacatatgtatatataattaagttttttcttgtgttctcctgaaagttccaggtagtagtacaatcgtcttattaatgaaatatgccattgtaattcagtactgatgggaaaagcaaagaagtgggaagagaacatttgaagcagacacttgacagttgacacatgcatattgaactcagaaaaagaaaattaatggctagcatattctatgcttttgctgccaaaacccatagaagagaaacaatgccaaaaaaacttatgttatttaatgcaacatcacaaaactgaggtgctccatgcatccttgttggcagacagaaccttgcatgaagcatgaggtaattaatccacatctatctcttctatatttaatcaacatattggtccttcaacaatggattcttgcattcgtgtttctacaccctttcgtggtaagagaaaccaaagaaactattttaatccctcaaggttatatgctattattattttttgcatgtggttcagatagaaacaagatattttgaaataaaaaaaaagagagaatataaccgatcatcttacacacccttcacaaacatgcaagttcaaatgtttatatctacatcgtttaattttctaaagaatacaatgtttcataactgttaatttgaacggtgtgtaccacccccttgagggattaattaaaaacaagcctcttaacgaaccacacaaataataactcacactccaactacagttatagttttgtgtttaatttaagatacgtggattatttgtcataagacacatagatggcaattaaaaccatcaagtgtaactctaaacaagtagtgagtggcagatggccaatatatattccaactggttaattttcttttcgcaaacatcggcatcgtctagctacctccatccttctcgatctacaggaaatttttgtgaggtcggggagcagagacagagagagaataggacaattggagatgatgcatgatcaggctttaattcggaggtaaaaagcaatcctaggaatatatgcatggacagaaatggcgaggccgaatccatcgtttctagcaaaaaaataaaggggcatcgatcgagttacagtacaacgtcgggggagagagaataaagcgattaattgggtgcagatatcaacatcttgacagcctaacctaagctagttcattcgttcgtgttccccatgtcaatctagatcgtcccatccatctctgtttgttgcattcatactaaacacttgcagctatagctagtgaagctaccaccaatctttctgaaccactccctcctttttacttttataatatacatgtatatgacctttggtgaattcaggtcatatataagtatataaaaaaggagtgagtatagtagtagttgtgataaaatctgtgtactactaggacatttaaaaattaaaaactgggagcgtgtagtagtagtacaagtttgcatatttttggtcgtgtgtaatataattattaagctgtggaagaaagaagtcatcatctcgagatcgagagagagaactctagagaagtgatgatgggttaccttgcgccattgtcgccgaggccatggagccacacaatggtggcctggtgcctccccttgggcctcaccacgtacgtcctcccgtactccacccgccgcccgcctcgcccccctgcacgcattccattcgatcgttcgtcagcacacgccggcggcggagaaagaagacacgaagaagcaaagaaagaaaaaagagaggaagtgagagagagaccagaagagctgctcccgtagctcatggccggcgaccaagaagcttgagagaactagtactgcaggtgatcgatcgatcgctggaggatggtgaatttggctgctgctgctgctgatggatatgtatagctctggatcgaggagaaagcggtggaagtacgaagagcacaggcggcccgtatttatagagcggcgacgacgaggaagacgacgtggtgaatatgtgaatcgcgcgggcgcgcacccggtaatcaacagttggcggcggctggtaggttggctcgctagctgtctgtcgctgggagaggggggaataataatccatgacctctagcatacgtaatgcgtgccggaatgagataaacgttcattcagttatttgccaacttaggatggagattttacaaatatacctgaataaaatgtcttttctaacttgtgttggtattagtattagttattgtctagtcatttcctggtttttatgcgctgtctattgagcgcatcataagtggtagtagcttctttgaagtaaaggccgggattctttgcattattaaagggagtagatatatttatggcgccatatttttcaacaaaaaatagtcggcatgtatttacattgtaagtatctaaattatatatgtaattttattgtatttagtatgtaagtctcaaaattacctatgtaagtgtttaaattacatatgtaattttagtgtatttaggatgtaagtcccaaaattacatatgtaagtgcctaaattacatatgtaattttagtgtatttaggatgtaagtcccaaaattacatatgtaagtgtctaaataacatatgcaatataatcgcaacaaaaagaagagggaagctcacaaatcataggtccgtttggagaaaagaaagaagctagcaaagtagaaaataattactcacaaaatcacatgtccctttgagtatttgtaacaaagtaatcaagtgatgaagtcatccttgatatacacctcgacaaaatcaatcagcgtgggaagctaagcacggacatcaagggagatcctaccactagaaaaaacgactgttttttcctcaaaaaacatgcgccataaatatagcaataccgttattaaaaagttagcacacgtacacacgagggagggcaaaaaaattttaaaaaagaaagatcaggggcttttgccttttgctacctcaggatggggatgggggaggtggcagcctgcaggcattggcagtggagggtctcttaatgtatgtaaattcattggtgtaatggtgtgtgggtggcgtgtaagtagggatgaaaaacggtgccggaaattcccgactgagcggctattattcccaattttgttttgctgatcaaaccatcttgaaatcaaatggctaccaatcaacaaaaatagaaaagcaagtggtaaaaatgaaatgtgcaaactgaaatggttttgatgtttgaccaaccatttacttggtttaccgtatttttcacagatattgttaccgtgtttataatatggaaattgtcatatttctaaataaatcagttcatgtagttcaaggcctataggttttactctaactcccccactaaaccctatatatttttagcacacggttaaaagcgaggcaactcacaattagtgttgtaagcatgaactaacgtggtatatagtcattctaaattacatatgtgattttgtacttcagaatttcttctgattgattttccgtttttgatttcctgatttttctatatcattttcatttctagctctactgttttcaattatgtttctaagaagaaaatgttacggaaatgggtaaggctgtttttcaactattttcatccctgagtgtaaggattgtaaaagcacaagaattaacagaaaaataaggaacaatccttaggaacaaaatggcctcatgggatttcaagacacacaagttaagtttagggccggtatgtttttggaaatcaatgtttctccgaagggtctttctaaaaatatagtgatagattttttaggtaaaaatatgtcaaatgtaattatagtataaatctaatgtaattacatatgtgaattagtgtaattacatatgtaattttgaaacttacattgtaaatacactaaatacatgctgattattttttcatgaaaaatatggcgacacatttatagcaaatccgttctccgaaatagggtgtgagagagaaacataactcatgtttcttttgagcataggaatacacaacatatgaatttgacaacacattcatacgtttcaaactttcttgtgggaaaagaaatccaaaattcccaacaaaaaccttacaaatctgggcctcgtttggaatgcagattttttttctcgaatcatgttagattcaaaaagattcttgtggaaaccctgtgaatttcctataaagtccctacaaattcttatgtccaaaggtggcccaaagagaccctggggtgagctttctcctgtgcaaaggataagcatgggaaaatagtcctgtagttcatgggtcctatgcacaaaatggttaggaggttaattgtcagcaccacactatgcagcccatctgagtaggccccaaaccctgcaagattattttccatgagcatggcatgtatttaggcagggagaatagattcaatccttggcagtggagagagaaccgaaatatataaatactacttagtaccccttttataaccacccaatttctcatcttggtgtcttgataagatactaatgcccactaatttagcatcacaagtcctaaatagtattatatacaacataaatacaaatgctaaggaataagcataagtgttttttttctatccctttgtctctctagagaaagaaaaagaaaataaaggtacatagtgaatgtctcactctcagtacctaaggaaggttcttgttaacacaaatgctccatatctagtaggaaaaggcatcttttgttgtagaatgtttgtgcacaggaggaagcttgttgttcatgctccttcctagttcctatcataatgtgataaaaaaattcaaaattactgctgcacatggaagcaagtactgtgcaggtaaaaatacagaacaactgtagattttcagaagcaatttcggtaatatatatatatacagaactccctgtagagtttcaggagcaattttcagtagagtactccacatagagtttcaggagtactagacagataaagtgaagattgccatagcaaggaagattccagaaatatctcgaatgtgtcgacactaaaacagcacttatatgatatatcacccccaacttggcacaattgcaggcataatcatatcattgacatggcggcgctgatcctcaaggtattgatactgaacgaagaacagcaaaatgaactgctcaccacaaagcatgcacaggtatgtgataactgacaggaacacttaactgtaaattgcccatcaagagaaactacaaggacctattctttcgttataaatctcatcaagttttacatcgacgatctgccaaaaaaatattcctcagcagcatacctgcttctcctttgaggcaagcttttctaacaaactgctattcttaggttcggcttgcgaaaaaagtgacgtaactttggccagggttgctttcagtgtagagaggtaggcagtaggctttgatcccctctcgacgatggaaatttaaaagggattaaacaaagagctaagtcaaatctaaacaaaacccctggggaatttgtgatagaagaatgatgcaaagctctgcacatttgcacctagtttttccctcccgtgtaagctccactacacacaggaagaatcatatgcacttcacctctgtattttctatgcattgagattagcagtgtgggaggcagcttgaggctaaactatgtgggctatgtgagatttttgtccctatatgttattttttttattctttttagtgtagtccctatctgagcttgagagattagagtctacatagattagggactaggtgaagtttctcactgaaacacttgcttattaactacctaatcctttctccatgctagagattataggccatgattgtgttctgtcagaaggcttggggcctgcatattccatatgtagcatacctttcttctaattgcatatgctcctatgaaacgtgaggcatccataaagtttaatacaattatattctgaaaaggtcgtagctagcacagaaatttcagacaattgtcgttgctgaaaatattacagtttgtcggttacggggaacagcatacgcaactagcacaaatattctataattatctcttttcttgtaaacatttcatggatggttaagtacatgagatccatgattttactctatataaaaaaaatcccccctttcagtaaaacctaattcatatgtagaaaacgagggccagaggttccttgagaaaaagaagaagaatccaacgttgtatttagatgtcatgtcatagctagctccggtttacttttcaagcatcccctttgttacagaaatacagtattgttatgtactatatgtttctttcaaaatattactttcacatattttaacaagattcgaagtaacgcacacactgttttgcattttctgctgaaaccaggatggtctgactctgaagattctgtcctaagcacgtaaatactgaaggttattttttttccccaacggggccgtgttcttacagttgtcaaaatgggtttgaaatgaatggtcgtgctcatacataaaacacggtttcatgtaaagaaatgctcatgtccgtctcatcagaaatacttttgaaatctgacagcaatattctctgggttctgattgcctgtgtcgttaggtacggttccctggttcatcatctcgcactgaacaacacaacggaaagataatttactgtatgaattgagtccacgtcaagggcctaattaacacaagtcagcggccagaacgcaacttggaatgatgcagaaataaagagagatatttgaggccagcattgtgtcaagaaggaataatgccaccagaaaagactccaaatcttcctgccggttgcaattgcacgatcacacctgaaaaactcgagagaaaaaactttgcttccgtactctcttccacttattaatcatatatgtgatttttattttatgtgtacaatttgtcctcttttattcagtttatgcaccttgaggctaatgaaaaaaaaaggtttttttgaaggaaaaggtatttaaaggtgaagtttagtgcagaacctatcctctgatcaacatttaatatataatccagaacaaagacaattctgtttatcttggcgcttctgagttgtttaataaatgttcgtgcttgtgaaggaggggaaaagaaatatgagatgaaaagttacaacaatagtagcatttgtcaactttaatccatcttttcacatgagcacacatgctaaatttttttctttataaaaatccgattttattccaatccattggtgcagccactctgtcagaattccatgggtttcaaggtgcaaaaacccaccattacaagtcctattcgcgcttgcggtaactccgtgcctgggtgcgctgaattcctgaaagagatgaaacagaatatgatgatctgtttgcaacaattcttttacacttttttctacttttttcacttgtaagaaaccatgcgtagggcacacttccattaactacaatatcatccaaagaaggagggaatgttatctgattttaccactaaagtttctggcatggcttcttctctcaaaagtaaaaaaaaaaaaaaaagaaaggctcccaagtgtctgaaatgacatgatagatttcatatgaattccttggcggtgtgaagctctcaaagaaactacaggagcacaagttttctcctgtccattcaccaattgatgcgtgtcaacatcggccaattaaaccatgtcacgcgagatgctgcgggaattcctcgtgttcttggagcccttctttttcgcgatcaatttgcgactgttctgaatcaccagaggcattatcttgaagcttatggagaaggggaatccaagcataataatatgttcttgcctttttcttactttttttttctttctaaaatgtcaatgcttgcatgtacatggtattgcatttacatcttggcatgatgccacaaaagttgaatgcaactgaaaagggagggtaggggtatgtagaaagaagaacatcaaacagctacgcagtactaccttttccttttcatttgcaacgaacgaagtacaagctcttgagactacctaggcaagaatccagtttcctttatgctgaaatcttcagagtgagcggattaacggagcaacgctgctcttttgttccgaaaacgaaaaaaagaaaaggaacagggctctaacattcgccagatcaccctagctagctaggtgagtggagcagggagttcaaaaaaacaacggaaatgcacttcgttcacaccaaaatgtacgtctagacacacaggaaacatctcttatatttaggacggatgcagtatttggtagagccaaccaaaacaacggaaacaaaatttgttggtcgagtttaaatatttgcaatgtttgaattgaaatttgtttcaaaagggttcatctggattttctgaaatgattctgaaatttgtgaagaggcttaaaaggtttttcaatggctaattaatctcttgcattcagggagggaatgtgaagcggggctaattaagcctatgaaatggcgccactggtcacctcaccggttagggcatcgatcgcctcgtcatagtggggattcttgctcccttttttctgagattttccgcggcacagagaataatatcgtggtgtcatcaccaccatcagcgattgaattgaacgcccctggaaacccctggcccttcctattgttagccggtgacggatttgatgtttcctagccagcattttccatgtaaattgtgtgtacaagtataacgaacaatatatatgcatgttcatgaattgtaatattgatctgatctcaaaaaaaatatatggttcatgaattgacgtgttgtgctgcacgctgaatcaaaagagctcctttttcacgaggttccttagagagagagcgatggtgtatcatatcgcattttctagtgttaattttctgatatctcaaccatagaaaaaagtacttcctccgtttcacaatataagtcattctagtatttcccacattaatactgatgttaataaatctagatacatatatatgtctaaattcattaatatcagtataaatgtggaaaatactaaaataacttacattgtgaaacggaggtagtatgtattagatggactcgtgccctctaccgtcacgacaagtgccattgagacactaacatatgaacctgatggtattagatgatctaaaagctaacgttgaaatagcgatacgtgcaataccatctcacttgttagaaaccatgcatatataaaatactaccttaaatatgaaataggagtagatgccggtgctatgaaaatgcagagaactacaagaagcatttctcctccgaccctctttttttttgctctgttgaaaacagcaaagcatttcctctttgttgcccttttggaataatggcgagggagatatagctgtgacaaattgagcaggcagtgacagatcataaagataatacataaaccgtgtcaccgttcacacaataaagaaaaaaaaacgacattattataaaaaagtatattattgcttttctcttcgcactactgcaggacattggaaaaggcatgcatttggctcaaaaccgatgtaagttataggcctataattttttctcagggtaaacttaaaacgttgcttggatgggccataacctattaaatttaccagtgtttttggcccattccgacattttgattgttttgttctctgatgagatcatgagagaaaagcagcagcagcttcgttttttcctgcacggtcaagagcaggtttcccaattcatgttcttcatgagcattgctatctagaatcagagcagaacaatgtaatggtcccaagacacaggtgattcttcagttccctacagttcttcaggatttcagatcttgcatggtcaagaagagcaggacaagtgattatattctagcaatccgatggattaaaaaaatcgttttttttccttttttgtgattatgattgagtatcgactatcaaggacatgtgtttatatgctgcctgtcactcttaacttaattacaagggtattcgtaaggcaactagaaaagattacaagtgtgttcttggtgacctaaaattacaaggtgcctttacaagtgttaaaaaatactatactcccaagcagccccgcacagggttcaacatttcggcccttccgatacgatattatttcagccgaaatttttaatttttttaaaattttacgtgaattttggtattatttattcaaaattgactaaattttgttctaaatttcggaccaaagttttcgaaatttcgtcataggggcaccgccagatacaaacacccaaaacgaaaaacgaaaagttgaacctggccctgcacgcattgctgaagagatcaccgatggatggcacgtgcgagccatcagccatgcgtgcatggctggctgagcgacaggtaacctacggggaatgaaacttttttccgatgaatagtgtggctactatcctctttagtcagtgccggaatcctattcctatccgatccgagcgtcgagcgatggatcgagccgtgtttttgtcatgttggtaaagaggggtgcttgtgcgtgtacgggcacgggctggacccggcctgactttcaagtttgtgagacacttcatccgtagggaaaaccccatcaggccttgttcgtttaattcctcccataaaaaaattaagagggatttgaagccttggaggagatttatttcacataatatattatgatgtagaattattcccctctcttgagaattaaaggacaaaatctcaggaatattggtgtcttgatggccacccgtcataataaaggccccattcctaacactccattcatgtcggtttccgtgaggatcggtttcagacgtcaggagaagactgctttctggtgcgcatgatccctcaaggtggatcaaccgtacatgtgttgcttgtgtatttgtgtatggtacggtcatatattctaagctatatgagcgtaagactatgaacaatatataggcttttcattcggtctccttgatttgaatgatgatttctttagataacatataatatctggcctttacttcaactaaagctatagccacttagtacataatttttggttgaaaaccaagtataacaatttctaacaaaggatagagagacgacacaagaataaatgtcatcatcaaagaagagaaaaaacttatttaaagaataatcctactgttaaatctccatttgaagttgacagaaatttgcatggcggttgtctccaagttccaacatgcaacgtgaataatcaccattttctcttcacacctttgtagttatacccaaaaccgaaaccagtatattactttgaagagtacctacatataagatttagttagcgttttgtcaaaaactatttcatttctactcaacgatagagctcaatataaagtagatgctataactaaaatatgtttttttatccttaaacggtgattaattgcatataagaacaacaatcgataattcaaacaaagatagtgtctaatgcttgttatgtggtcataaaatgcatgctgggaaggggagggggtgcacaggatcaaggaaaatattggccacatttcaaggaatctacattagtgaaaagggaatccctagatgtcaccaagatgagccacatcatcaaacaaatatcaaccgttgaatgaatgatttggataaggagaaccgttggattagtacagaaaaaatcagtaaaaaaaagacaaacaattttattgggtgttttagaagcacctcccatgagatgtgtgctaacaaagatgtgaaaatgaaaaaaagaataccttaaacattgaccgtataaaagaatatcaatgagtattcagtactagttctattgtatcaataataatgagtatcggtgtatatatgaatagctaattaacctgatgctatcgactacttcatcacaccttaaaactaaaaatcatgtgtcatgatgggacatagtaaatttagtaaacttgatttaacatatgattataagatttatgataataaaatgtatatatacttcttaactggtcatgacataattgtagcatgtaacagatgtggctatttatattattattgctacagataatgcatttaaagataatggctacagtaatatacaacagattttttttgttgcgataaaattcttaatcatgaatcaagatatatagactcattaatgttatagttacacatcaaaatatgttaaaaatatatttcctgtttgtagggatacctaggctagatattgagtttagcatgacaaccagtggcgtagctaggattttagattagggtggtccaacttaacataaattttctaaacactacaataggattatgcattgttttaatttatcaatccaattctaatcggaatttctaaaatcgaaccgaaactgacatagtgacatagctgcttgctgaacgctgctctcgatcctagtcgccagacgccgattgcccccgttggacacgggtccccaatcccaatcgttgagtcgtcgagttacgaaagaagcactcgcacgatcaatggtgtagtcaggatgggaactgggaaggacggaagctgaaacaacaactcgataaggcaaatcaactaatgaaacaaaagcatcgttcttttctacgtttgcatcagaacaggggtaataggcatttgggctagattttactgtgttccatggcccacacggaccaccatgtggctccgcccctgtaccacaggggccagggcacaactccgccatcacctaccacgttaccactaacttcgttcatctcacagcgagccaggttagttcgaatgagtgaattgttaccccttccaactttcttattccacttttctgttttttaagtgcaagtgcatgctatgtagtttagagctaatgaattttataatagctcatgtgctaatgcatctaacactccaaagagctaccacggctaatatgtagttgcaaattcacacaagaagtggaccagcgaagccatggcaaactaacatgccatccagtgggttgtagaggtaattaagatagagagaaatggaagacatgattaactgtttattactagtgctactgatttcctatgcataaattcatattattttatatatacatatatatgacatatccccgtatgcgtgtttttcaaaaaatgtcgtactccccgtatctgggtaacatagactgtaaccatccaacctcgttgttgccttggcatgccaaataagaaatccaatataaaacccaaagcaccgagtagggaacaaaggagatcttcgatggaatagtttgccagtcaacttcaacctaagatgtacctgccagaccgcacgaaggcggcgactaaatgtgttacacatctcaggggacttgactgaaagtgctaaattccacgatcatcgcaattgctcaaaactcttactcgtgatcagctagcctcaggaagttgctagcttcacactttcatcttagctagaccaccaaaacacaaaggcctaagttaaacttaggaacaattaaagacatagaactaaatcataaatataaggccgaccagccaatagtagaagtttagcagaaagcttgtctacccttccacacaagcaaaccgactaggggtaggcccctagttagaatcatgctgaaaccctcaacctaagcaacaaaataatcaacaagcaagagtcggtacattatataaataatgtattggcaaagccacgatcaaacctatgcaagctctaaatcaaaggagggctatttgtggtttcattttcagcacaaagcaaattttgtttcataaacattttgcaacggaacttataacacaagttaaagcatgtacatgatataaaacattgtgatccacgtaagtaatttcaacaatataaatatcatatccacacttgcaccatcatgccatcataatcatcataagtatcataaactcccaatcccatggcctatttcacacatttaaaagaacaaaactatacttatggcgcacacactatgccgctcatgaccatgagcatggctaatcgattattttagactctcaagagtttgtaaaaaaccacatgatgtgaatcgctctaatttatctggtacccgtcggtatcaccacaccttgcctattgaatgcggcctagaggtcacaatgagggcattacatttcccaccagcacagatcctggtcttcacctgcggcatgacggattcgcaaccagttagtgccccagatcaagccgccatcatacttgcacagctcagctgccactgggcgagggatcggcagatctgcagagccatcattttcatcttctagtgaagtcatccctccaaggtgttagaaccctagctcacgattcacacaagcacacaagaacaagatgatacgaggaactcgattgatagatttctctctcgcgtccaaccggaccgagccaccgtcgccaacgccgccgccgagttccaagccaagttattacaactgttgttttgcgtatttataggatgttctctcctcaccaactctctctctctctctctctctctctctctcttacatggccaagatgggccgatacacagagatggttcatacagcccagtcaggtcccatgtacttcttgttccttcgccggatgcgttttccccttggtaaggcgtcttcctccaactcgccttcagactatacgtcgtcagccttgttgtcgtcttccccttcaggtccttccttctcttgggacttccagctggtacttccttgagctctaacacaaggtgagctggacaacaagctgaaactctgatccattgttgttgcggcggcacagtagtatcccagcgttcctgctcccgtggatgttgatgacgacgccatgagagcaagcggggagcctcctgagatcagccgcagcggcgccagcagctgctgcagggtggttgtagcggtagacgaacagctcttcgcagaggaggcaatgtatggccttattggccggaaactcgcccccccccccttccttcacctggttttcttttttggcaccgcattaattttctattttagtaaatttatgcacctaaagtttatacacctcaagtttacacatctaaagtttagagaccaaaagtttacaagtcaaaagtttatatatccaattcaaatttgaatttgaattcaaatattttttatatatagtatttctatacatctaaagtttatacacctaaagtttatagacctaaagtttatatacccgtttcaaatttgaatccgaattatatctgattcaaatttgaatttgaattcaaatattttctatatatagtatttctatgcatctaaagtttatacacctaaagtttatagacccaaagtttataagtcaaaagtttacatacccgtttcaaatttgattgaattcaaatattttttatatatagtatttctatacataaattttttcaaactttttttaatcttgtggtgtactgtagtaggaagagaaggaagggaggaggaaagggagatccgagtgtataggggaaggttgggaattgggatcggacgatttcttagagcaagtttaataagagagccaactatgagcttatagcttatattagagttaacatgtatagtaaatgggctataaggttatctcttttttttcttctcctctctctatctctcacctatgtatttaatgtatctatcttaaagtatgtgaatagctagctcttgcatgaaagccaatcctctccatttttcaaattctctttcctccacataagcttatagttggcttatagcctactattatacttttttttgaaactaaaccggcaggagaactgccaattatattttcaataagcaggagtaaaaaccctagacgggttacaagaaaagaaaaaacaaccaccggctggctgaacagctgcacagcacacgccagaactcactagcaactgaaaccattgacggagcccaacatagaacgtcgttaccaagcttgaccaagacaacaaaggggttccgaccttgcaaccgtgtcatcgttgccgagcttgtcgcctagcgacacagcagctccgacttcaaattggttgcatcatccatacctaactcgctgtcaatggtcaagtggcttcaacttcccacgaagaacttcagccaaagccatctaaacgccacatcctatccacggccaacagcaaaacccctagaaagagaatgcaacatgtcatcgttgcctagcttcgtcaccctacaaagcagctccgacttcacctagcaaacacaaacaaggagcgaaggtcgcccgccgcaaaacaaaaagtgggactagacagtgaaggcctcgtcaaaaccaagtactgaaaagcttcgaagccaatgcatagaccattaatgacatccttgcatgaaaaagtttctccaaagcggtgcctccaaggaggacacgacgtggatcgccgccaccgctcgtccggaagccagagccaggttttcacccggagaacggtagggaaaggagagagatcaacgccaaaatgacgcctccaaggaggtgaatgacgccaaaaggcgccgccgtcgacagccggccaattgcacagcgaggctttcgccagcgatttcccgtccaaacccacacaaccagtccgcgcaagatgatcgtcgccggtcggctacatcgtccctttagcaatcagtcctaggctaccgcccgcagctccggcagactcgccagaccagccgcagcactggccctcctgccgcggccacccacgcctcctgctgccctctaaccgccgcccttgtcgacgcgtcgtccactgccgaggagccaccggaggggatccggcctccctcgccggagaggccagatccggactgggggtgccggtgccgaactagggggaaccatagccggcggcgccgtgtgcagctaggcccatgcctctcccaccgttagcgccgcccccgccgtcccgtcgccgccgccgccgcctcctctgccccgccaccccggagccggcctccttcgctgcgggcgttggatccggcctggagggagccagatccggcggcggccaggctctctgcctcgtccccgccgccagcgacgtcgcctcctccgcccgcgccgcgactgccgcagccggcggccttctctgccggcacctcgctaatgcggcgtggccgacgccgcttcgtctcgatctggccgcgggggggccagatccgctaacggcgacgccggcactactacctctggccgtcggcgtcgccggagccgcctcaacgcgtcgccgcccctccgcctgtttcccgtcggggccccaaccaccgggtgttggagggggtagaatgccccgccgccaccgtccttgccgctgcccggctttgccggcggctgctcaggcggcggcgaggtgggggaggcgagggagagaaggccggcggcggggcggcttcaggtcgcctcctgtgtcaccctggagcggagcgacacgggggtcctctctcaaagagagactattatacttgctcttagggtttgccaaggtaggcgcttcgagtggtgaaaggaattgaattttaaatatatattgtttatttatttattttttttcccagaaaaatccgggatgtaattttttggcataaatatatcatcgtcgctgagtgggagttgcacaatgatggttgcgcaggagctgctcgaggaccgtgctgaggaatctctatgtaaaaagaatcgatgttgctaataagctgcaagtttacttgtaactttgtttatgatacccttaattttttttatttaacaaaatgaagtgtgcatttgcttgcaggctaaaatatggccttcttcgccaataccgatgggtggagtggcaattagcttcaatatctgatttgagatctcacatggcaatataatagatgtgctttgtgctatattttgggtttgagacatggtgatagatgtgctgacgtgctgtgagtgtgaggtatattttgggttcaatatctgagttgagacatagcaatagaggtgtttctgtggtatatatttgggttgcaatgttttagggccattgtaacggtatatttggaaaaaaaataatttgtgaataaaatttttatatacacgttcttagcaatctaaaggctaaaaaataaactatgataaaaaccaaatcaactttaaatttaaagttgaaaattcaaattttagcttattagcgtataagcgaaaagatgagaccgtttgatagctgctaggttgcatctgtagcctattgttttgggttgtgttattctaacactgtcaatcttaggttgaaatgtttgatatatactcactcgatcttgacattggaatgaaatatgcgactccactgcatcttctttgtgagctattcaatgcatcaaatttataattgtgttttacattgctcgtacacgatatctcaattttgtgttttttttaatgtttgtacatatgtctaaaactcttcccccgtccttaaaaaaaaaacctagagaaagatgagacataacataaaacaatgaatctaaaccagattcgttccgtccttgcctagtttagcttagggaatatttttttcaaaagatccttgaaataaataataaggttttagcattttctgtacttttcagtgtcggcgctgtgaaatgtaagggtaaaaagtctaaaaagtaggttagttgtacacatgctccagtagtctttccggtgaaatttggcatgttatcttactgtttatcgtcgctgtgctgacatctgtaagtaagttcatgaagacatgacaagcacttccataactgtcacattatgaggaaattggggactatgagacgatcgttaaagatttagtggctgcttgcaaacagggactcactgagcactgaaaataaactgttgcatgatctgaatagaacaggtccatcacaccagatggccattaggatacacaagaaaaacgcagctgatgcagtcatcttttattcgatgatgctccgaaggaaatgcacaggtcaagcctcgatgagttttttgtttggacaaaatccctaaggaaaaaactaccacctgcttgatggccaaatgtgtgcattcataaacaaggacgccgtagagcagtctggtgctaaaaaggtttaaatgaaatcatctgcctcatcaaattcttattatcagaaccacgaggcatgggcgtccttagtggtgatgctcgtcgtcatcatcatgtccatctggatcaccaccatcaccaatgaccttaagctgcaaaaggcgagcaacaaagatccattaaagaacaatagaacattacagaatcaaaacagcttggaactgtgagctacattcaataaaaacagttactaaatacataaattaaagtaatatgtcaaacaacgaattccaattaccacaaaatattgtgaacagactgggcactcatgcggttcatcttttttcaaccagaaccatacaacatcatgctcatcctctgtaaatgaaagaagtgaaaaaatgttgataccagtattgcataatatttggcagtttagagttttcgctgagccaagtcaacactgactgacctccttcaccaccaggacaaccaactatcctcttgttatagtaggattcaatgacagctggggcctcctgcaggtaacaccatagcaaattgatgaataacatgacatggtgctcaaatgatgctgcaagataataaatgaagagactaatgtgccatggttcagatccagcatcatccttacagccaatttaaaagaatagctccaaagttgaaatttcatcattttaaagcaatcgcaaatcacaatcagtgcaaatcatccccctcaggccctcactctaaaccacccatgtttaatcaacaagacatcaacatggataggctaccccccaacccacacacacacaaacaaaaaggtgtaacatgctgcaacagattcaaaagacttaatcgtagcagaagtagaagtacaggaaaggtcatggtgagccaggacaggctaaaatcagcagggaatacttgggattgtgcaatctatcgccacctcttgcagcaccctgctgcccattgtggctgtgtttgcagaggtcaaaggaccatgttcacacacagcgtcaaggaaattaaggaaaggacttaaggcttgatgtacaggcaagaaagaaaccgtcaataagaataaatcaaggtcccgcctctaatgttcttcattactctcctgtctcctctgcatctgtatctcaacaaaaagaaatccaggttctcatcggcaataattttctcactaccatattctacgtcttagaattgaaaaaaaaaataattttcagttgcacttccattgcacgctgctaaaccagagtctctgtcatcatggcttgcctcctgactcctacatttgggatgtggagcgtggcaggtgatcaggattgggcatgatgcaggtggctactactttgtacacagaagagattgagtaactgataggatataaactgggctggattgattgaagcggtggactggtattgctagctgaagggcataaaacaaagttctaagagttgagtagttagattttgactccgcggaaagccaacagggggtaaaatgggttcagttcaaaataagaattgtggacaagtaacatagaaacctgtttccaacaggaaaagcaaacagcaatggggaaaatgaatgacaggtaaattcaaataagtaacagtacgatgtgtcacaaggatataagggagtgtaacacagaagggagcaaactaggggaaactggacgagtccctcaaacagacatttgtttattgtacaaatacatgaaggtgtataaatatgctcatttacaaatatttgatgacctctttacagatgaaatacagatttcggattaaaaacgcaacttgatatttaatgatcacatcactgtctataaattgaccaagcttgtgtggtctgctgtgataatactaggcattgagaaatcagaattagagaaaaaaaacatgctgtgataataataggcattcagaaatcagaattcaagaaaaaaaacatacatagtactaatgttaaaagacttggctacaggaagaggaaaatcatccaaagaacaggtgggtgtggtgagggcacagcagcggatgtatgctggttcttgttgagccacttcacacattagtgtgtcgttatttttttctggtatacatcaagaggtaagcgaaacacctttgcaggaacagaagggcacagttcaccacctagtggttaccctaataaatttggcacgaacactaatgttcttgggatagtaaaaaaaaatttaaaaaaaagatctcaccactcttagaacagaatagtcaatcagatgatttgcagttaggtgatgtacaaagacattctacaacaggtcaccaaatatccctgctgacatcaagaggtaagcgaaacacctttgcaggaacacaagggcacagttcaccacctagcggttaccgtaataacctactaaatttggcacgaacactaatgtttttgggatagtccaaatttaaaaaaaaaacgatctcaccactcttagaacagaataatcaatcaggtgatttgcagttaggtgatgtacaaagacattctacaacaggtcaccaaatacccctgcttcaaaaacaggttttcatagttcctattcaatctgagacatagattgccaacttaacaaaaaatctaagtatcaggactaaaagtccttgcattgcatagctcaagcatttaaccacagtaagtttgtagtccactaccatatcacaaatgcaacaacaaaatgaagttaacatactctcaccgccaaacaatacttataaacagttcccagttacaggtaccggtttgctagatagctatagaaaaacagattaatgcaacattcccaagataatgttcaccattcagtctctaatttcgacttcgacaattgtttcaacacaaaaaaaatgcatattaaacttgatatttctcagcaactaatgtttatttaggtgttccagctagtcaaaagaatgtaacttaatggcatatccaaaaaacagtttcaatgaagaaaaggcaccccaccaatatgcatattaatcaataggattgggtcagccatattagtttatatgaaaggagcgctgcgtttctgatcaaataagatagcacacactgtgtaaacattattgtgtatcctgcaccaactactcatagaagtttaaagaaagcatccctacaatatatgacaagaacttatcataagtagcattagtcataacatcgcaaactgccaacgggggaagaatagtttgcaccaatatattaactagtaacaatcatttgctcaataatgtggaacaactattgatgctttagtagacaggcaaaggcaatgaacatggagatcaaacacattgcccgtcatagagtgaacaagttttacaacaatggtgcattgaagaatagcacacgaaaacaattcccgaaacgcattagtgtatagaaccaggcaatatagcatgactactggcaaaaaatgcagtttctccctcccagcacaacgcgaatcaagtcgaaggtaatctagcaaagcattcgcaattcatagtttcattaaattcagctctaataaacctaaagctaaggaatagaaccaccacgtatggtgacgatcgcagattcagaatttcagatcaacagaatcaatagaaaatatcctacaactacgaccagcgaacgcctcaccttggtaccaaatgggcctacgggaggatccatgtcgaaccgcttctccccctgcgaaaccacagacagatcggcaaatcacgaaacccatttccagaacagacaaaaaggagcaatactccaacccgaagaagcaaaaaaaaaaacgaaaaaaaaaaggcataggcatctccaccttgagctccgccgcgagctcctcgcgctccagccccgtggcgatgggcatgacgtcctccaccgtcgccggcttgtcccctgcagcgcgacccccaaccaccgaccgatcagcgccgcccccaccaccccacggaagcacatccaaacacgcgagatccgaggaggagagcccttaccggacaggagagggctggtgcggcggaaggcggcggcggccgccgtggagagcggcgcggcgcgggcgagggaggcggggcccgcggcgcccgatgccgccgcggaggcggaggcggaggcggcgcggcgcagggccggggccagggtttggaggcggcgccacatggcgggcgtgcgtgtgctctcaggtcgcggcgccctcggcggcggcggcgggggaatggggaggagggaggaggaggcgaggcgagatggggctctctctcgatttgatttgacccggatgcggacgaagacggcggggtgggatggggaggaggaaataggagggagaggggggaggtgtgtgttttgggccagaggggtgtgtggcctgtggcgccgccagaccagtgtaaattcggctctgccagcgtgtcaatagcaaccaggaggacacgctattgtttggaagaaaattgggttaattctatttatgccattacaaatgtggttattaaaaaatatactattacaattcgtatatttataaatatgccattcaaattttataaaattagaaccatgccatcacaatcttcatccccatctacacgtggagcctactcttcagattgatcttcctcctccaccctcccctcttctcttttttccttctttcttcccatgtagagcagaaggaagagatgagcggcgcgccggtgctccagtggctgggaggtggcgacaccggcggtcaaatgtgttaccgagcttggctcaatcaaggaatgtgttgcccgatacaaggagctagagagatggccagaatagcggatggaagggcttggctctggcggcaaagaaggtgatggtggcggcgggatagggtggctaaaagagaggggaaactaggggaatgggttctcctcggcgggacaaagccggtggtgcgaggatttggtgtgaggggagcgagtcattaagattaaacacaatcactaagaaaatagatagaatataaatatggaaaatattatgattggacgagaaatggagataggtgaggaaattaaacggcgaaagattgagattgatggtaagaaaatgttagtgaagaagttgttatattttaagataaattttgaaggctagaagttattatattttgagacgaagaaaatatgataatatgtataaaatctaaacacaaatgtactcgagttcttcacaattcacaaatgaatttagacgttcagatttgttgtattataatatgtaatagattagttttctatagaacaagaggactattccatccgtcccattttaagtgcagccatatatgattttccgcgaccaactttgatcgtccgtcatatttgaaaaatttttgaaaaaaaaattaaaaacataagtcacgagtaaagtaatattcatgttttatcatctcataacaataaaaatattaattataaaaattttcaaataaaacaaacaattaaaattaaacatagaaactcacgtttgcacttaaaatagaactgagggagtacgtgtgtgtgcaggccgtatagctttgcctgcaaatatcttttcgctctatagctttctccgagaagggacaaggaagtgaagccaggccggctgtggtagaagcagcacaatacacaaagaaggggtacgtaaggctaatttgctaggcacaatttctcaacccatccatctcgacaggccgccatatcggttcgatttacggtctataggaatatccacatgggcaatgcattctaaaatctcttatttttataaagctaatacttactaaacatgtaaaactcaacatgaaaacatagtatttattattactcctataacctacatgcaaacatgttatatcaacccattaaacacgtaaagctcaccaagtaagtatatagtaattatatctataaattatttcattttaaaactagacatacatatactaaatcatcattctcaaattatttttataatattttaatccaaatcatttcatcatttctccaatatgtaatatatatatcccgcagcaaagtgtgggccatcatctggtagtaggaatatcgaagtacagattaaccgtgaacaaacaccttttgatttggaggaaaaacattgaaaaattttctataaatatctttgaaacaaataattgaatcatgtcctatcatttgaaattcctatggaataaacaatcccaaagagattttaaagaaaatttagcaataacttcaatatcttggaaaattttcttttagtttatctctttcatccgattcctatgtttttcatgtggtccaatcaaacggtcattctttgtgtgtttctgtgttttgtaatctttctgttttgcacttatattcctattaaaatcctgtgttttccctagttctccgtttttcaattcctgccatttagagtgacggttctctccgtttttcaattcgtgacgccatcagtgaattgtcgcggatgcacccgctccgacggtgaataggttcggctcgatcaacacgggcgtcacccattgcctcctcaagttggtaggttattctcgttggactgacgttggaggtggcgatatggtgccgacggaggagttagaaccaaagtacgatcaaatccccaccgcttcaacacggatataagaaatacagaaagtgatcccaagcaaaagagaagagacattctcaatggtgtccgtagtaagtattctcaaattataggaactgatgcaaatagaaataggggtatcagatgcaaagtgaaatgagatgagctactagtagtaacacatcccggttagttatttagttacaagctgatacttctacgatctagcaccaaggcagtaaactacagctagcatgttatcagacttacgtagctgggcgtttaagcctccttgagttgtgatttttatcttttgtaatcaaggatctgtttgtattctgttttccttcttaatcaaattccggctgagctcctgctgtcgtcttcaaaaaaaaatggagagtaattgaagtcatgactggtgctattaagctttaacaccacaaatcatacatggcatatatggcttcttttaaagaatatgtttcggtactgaactgactacaaggttacaattccactgctcaccactaaattgagaggagtcactacagataaattctcaagcgctgtgcatagaatatgtgtaaggtacagcaaatgctacagaaaaaaaaaagattaggaaaaacaacatctctaccattaaatcatacaggatgcaatgaatacatgttataaatctattatgatggcgttgcgataaattatgtttatgcagttccatcaatttattttaaacctagcgactacaggtaccattggcaaatgaaggccaatggaacgccatcttgcataaaactttcatcatccaatgagcgcaggtccatcagcattaaaatggcatcctaatttagacctctagcagttcaaaacacatagtacctacaacaatagtaaagaaatggatctttaaagagtaaagtgcattgcgatatttaaacttgtagggttgtatcatataggtccctaaactctcaaaatacatatccaggtagcataactttttaaagtgtatcatctagatcccaaattagcacatcccctctaagatcctacgtggcgctgatgtgacaatgccacatggacatgacgtgtccgtttctcttttttttttctttttttttcgttttcttctcattcttctttttttttcctttttttctgcacgggtcactaataaaggagaagaaaggggaaaaagttaaagaaaaagaaaaaggaaaaaaaattaaatggatcctatttgtcagtcaaaataatgtcatgtcatgtccgtgagacatggcacatcaacgccacgtaggatcctgaagaggttttagcgatttgggacctagatgacacactatgacaacaagttctgggacttagatatacattttgaaagtttagggacctagatgacatatccctataagtttaaggaccgcccgtacactttactcatctttaaatctcacaggttcagtggtttcctaatttcaccccttcttacagctcttaccactacacacaaaatggacaactcagtggaagtaacaagtctattgatatcagcacagcgaataccataccacctccgtagagtgcacaacactaaaaaaaaaaaacatgaagcagctgatctaaacaccatgagggctaaaacataaaaagggtagcgcggcaatgccaccctgcaattctagttgctcaagctaaaaatgggcaagtgcaaactgtttcaagaaaaagggcaagggctttgctatttattgaaggagaatcaaacatatgttcctcatactccctccgtcccagaatataagttttagagttgggacacggttattaagaaaatagataaaagtgaatggtggagggttgtgattggatgagtagtggaggtaggtgggaaaagtgaatggtgaaggattgtgattagttgggaagagaatgttgatggagaagtggttatattttgggaatcccgagggctaaaaattgttatattttgggacggaggaagtaagtcataacataccataaaacggttggggttttagttcctatatgcaatttgatcaaaaagagtaagataagtcatgccgaaaccaattcaagtagcagagccaagagagacaatacatatttgtcttaggtcaaccagaccaacatcatgcagcttaaaaagagcttccacagatcacctcgaatgcttcgactcctctcaactctataggttcaattccagctcgccgagacctaaaccaggcgttgtttcgggaggcggcatccgttgtgtggaagctgggtcacatcgtggataaacaccacaggagattgctcccttactctttcaccccgaaagccttctctgaagctcaggatcactttcttcttcttattgaagaacacagttcctttcactttcatcaccacggatttcaaacccatcttcctcgcggctcgcccgacatgttctgcggttgcttcagtagcatatttggagagacgagagcgccctttcttgtcctccaaacaaccagcggatgccccggtctttctgttcccccgaacgtctgtcacggtcacaaaggtcttgtttctcttgagcaagacatagacaaaatctctcttccctttcaccagagattgcttgtgttcgtcaaagatgtgtgatggggtcccgaagtaggagggattctcgccaccagctatcctggaccttaactcgggattaggaggaatgagcaaaatcatcatcagcagaacaatgcagaaatcatatgggcgcatggaaattaccatttgcctactcccatcgtgtcaccagaacgcggcacattggcacggtagtcttgaggcagctgctgtgactccatgagacggtctccatatgaaggttggcgtgtgtcgccgccgggcatagagaacaaacccatacgtgaagcggttttagactgaggaggtgggaaggcggcggcggccgccgtggagagcggcgcggcgctggcgagggaggcggggcccgcggcggaggcggaggcggggcccgtggcggaggcggaggcggcgcggcgcagggccggggccagggtttggaggcgtgctctcatgtcgcggcgctcgcagcggcggcggcgggggaatggggggagggaggaggcggcgaggcgaggcgagatgggggctctctctcgatttgatttgacctggatgcgcgcgaacggagacgacggggtagggtggggaggggaaataggaggaagacgggtagggggcgcctcggggttcgtgcgggcgtgatggacggtctggatcgggtcacgtgatgagggtatgctgtgggccagaggggtgtggctagtggtgccgcagaccagtgtaattcggctctgccagcgtgtcaaaatcaaccaggaggacttgcgggccccatcgtttcgccaaaatggtttattagaaaataaataaatttattggtaaaacttttatatatgtgttcttggtaacttaaaaaccaatgctgaaaaagaaattacgttaaaaaaaatctcaaaatcaatcctaaaattaagtttaaaaatttaaaatttgacttttttttttcttaatgggatgggagccgcagtttagttggggggccgaaaagcctttcagaagtccagcaaaagccggcaaggcgccgccaacgccgccgccatcatcgccggagacgatggagaccgcggtgccatggaaagtcctcgagttctatagcggcatcggcgggatggtactaacacccaacccaccctctccaccttccccactgcgaacttgcccgcacctgtctaacggcggctagggtttttgcgccacctgccctcccccgcagaggtactcgctggcggcgtcgggcgcgcgggccgaggtggtggaggccttcgacatcaacgacgttgccaacgatgtctacgagctcaacttcggccaccgcccataccaggtgcgctcggtttcttccccaaatccatctgtggtatcccaaattggaacctaggagaaaaagcttctggttagattccgcagttttgatttggttcggctcagatttaggagtagcacatagaacatggtattattgtgccaactgcaaaggtgatgagaagtgagattcagaacttaagctgctcgaccagatgtttaggctgagattcagaacttaaactgcttgatcagatgtttaggcacttcttagggagtatgcttacaagttttccacagaatttatgttctgcctagaatttctcaattagtagactgtcttgatgtatttgtttaaactgtccacagaattgcttacaatctggttgatttcttttgagtatgttgtgttgttttctataaccatttcacatggcaagggaacagttggtcatttgccttcctcatgttcatgtagtcattctcctggctcatctaccctgtcctgcagattaagcatatcattctacctgcatgatgattcttgtattgaattgtctaagtctttaacaatttcattatctgaactgtatcactgttatctaaatacagggaaacattcaaacactcactgctagtgacctagataagtataaggcacaagcatggcttctttctcctccatgccaaccatacacacggcaaggttttcttctggagctttctttcaacattatctgaccacttttcaaatttcactaatggatggagtatcgtgtaggactacagaagcattcagctgatgctcgagcattttcattcataaagattcttaacctaatgaaaaacatgtgctttcctccacaaatgttatttgtggaaaacgtagtcggatttgaggttggtgtaatctttggtttctttaaagcactattcttgaccgcagtattttatcaagttgtgacccctatttgtttgtgacaggtgtctgatacacatgaccagttgatagaggttctttcagatctcaatttcaacacacaagaatttatcctaagccccttgcagtttggtatcccatattctagacctcgctacttttgtctggtaagatttctggaggatctttcctgttgtttcaatgtgatctgtcacttgacgttataggacatgacatggcacaaatcttattgttactattacatatgtgcatagcttccaaagttcacaaattgtggaaatcagcaagggatgacttgggggtttgttgcttaagattggtaaaaagattgtatttgcccaagtgcttattaaaagaaaaaccataggaaattagtctggtgtcactacaaaactgagaaatcatgcaataaagttcctgataaaaaattgctggataataaactctaggttcttcaatagttcatttttgttcagctaagcaactcttcatttatttaacagtaccttgtctataggcgaaacgagaacctgtgagttttcaaaatccatcagacaacagcaagctgctccggacacctacattcctaacattggtaagggcaggtcacaacagatgtaacccggatgaagatgagctggaactagtatgcaaaccaatcagtgacttccttgaaacaataagtctgaatgtcgctgatcaggattcttcaggtacaatctctgacagtaagttcaataagcctataataattaccagtatctcatttgaacatgcaggttaaaaatattttttaatgccactctatattttgtagttaatgggtctgatggatgcaccccaagtggaataatttctcaagattatgtagtcccgctaaacttgattgagcggtgggggagtgctatgggtatcttttttttttcttagtttaagactcctgaatcaatcatttaatgatagattattatgttttactgatgcttggctgtggtgtctcctcgactgtttgcaagatattgtatgccctgaatcaaaacgatgctgttgttttaccaaaagttattatcgctatgtcaaggggacaggctccttactagctacgtccaatgtaaggctcattatattcaatctttcatctgctttgttttcaggcatccctggtgttgcctcttaatctgaacattcatgattccttttccttttatgattacctacttaaattacagaacctcaaacgaatttccaaagaggaccttgaaatttcttcactgaaggagttaggcttacgatttttcacccctcgtgaggtatgtgcttattgacaacttcacataggtccacacccttccgtatctatgttttgtctcatagcatgcaatattcatgatttttcaggttgctaatctgcattcttttccatcgagtttccactttccgaatcacataagccttaggcaacagtaagttttaatccctaccttttactctgttggaactcaatgaacttcaggaacatcataatcgcaatatatataagaacatgaatgtgactttctagttttgaaaaccagaccgcactgcctgaattgtttgttatcgctaacttacctatggtggcaggtatgctatgctgggcaatagcctgagtgtagcagttgtggggcctttgctgcgttatctgtttgctgagacatagtgatgttcaatcagttggcacatgatgctacacaggacaaacacattgaccttcctttgcccgtgttatcaccctaaagccaggttggttcgtgggtatgattcgtgtactccccgaagctgatggttgtggttcaaaccttgcaacccaattggagtgaatttcccacagtggtgcaacttcaacttcatagggcttggggacttgtcgattcatcggtgggaagaagacagcgtgcatgatggcccggcatgtatcggtgaaactctgacgcgaatcttacctagtagagtagagaagcttcctcagcattttccctttgccccaggcataagttttaataataatgttgaatgtttgaggtgttacagcatttgactcatgcgcattgtgaaacgaggttattatggtttagaactgaacttcaacttcatgagctcaccattcgactgtctcaaatcagtttgctttcttgatctttctgcaaagaggcaatattttgacgacacatttgccccgtgtacctcagttaaacagtagatctgcattcgtttagctatagccaattcttgtgaaaaggaagtttgaacatttttttcgtgagaagtttctacccttaaattgataaattgaagtttctcaatccctttattttgttctacaatatgaacaaaatgttttgagaaagggtcaggactgctcgttaacacgtggatcctcagttccacatgtcaatgtgcagtgtgtgtacagcaccgttcgctaacacaggtcccacagacactcgggcctacatgtcagcgaagtgaaatgtttcaccatgatcgatgttaaattgttaatctaccagcagctccaaattcaagaatgtttgagttagaaaaacacaactgaaaaagggtctatcttttattttcaaacttaaatttagagctgattttaaggttttttcatcaaaatttaattttttagcctttacttttaattgctacgaatacttatataaaaattttatttacaaattactttttatttgcaaatatgccgttcacatgttctctgcttgctgagaagtgagaattgagaactgagaagacagtctccaagatatgcattgcacagcgcgtattcgtcgcaggaaacggcggcatatgcaagcgagagcagagcagatctaaacccaaaacaacgcaaagccctctctcctcctcctcccccgcgacacgacactgtcgacacaccatgcgccagccacagctccgcgccgccacctcgcgcccgctctcatggcgctccaactgcacggctgctgcggcgtccgcctcccagccgagcgagccgctctccgcccacttcaccaacggccggcccctctcgcgcgccccggccgtggtgagggacctctcctcggtgctccgcgcgatcctcgccgcctccccgtcctcccacagccgcgcgtacccgctcctcaagtccgccgccttcgacgcccgcctcgcgccggacgcgctcgtcgacgccgtcctctccgccgtgggcggcccggggtcacggcaggccaccgcgctcctcagccgcctcctcgcctccctgtgccgcgccggccgcgctggcgcggccgccgccgcctacgccagcatggaggcgcgcggggtcaccccggacgccaagtcccgcaccgacctcctcgccgtcacggcgcggagcgcgtcggccgcggacgccctcgcgctgctcgccgagatgcgggggaaggggcgccccttggacgcgtggatgttcgacgtggtgatgcgcgcttgcttcaaggaagggatgtacgacgacgcggtcaggctgttcgacgaaatgcctgcctctgagatcgagcccgaccagcgcgtgtgctctgtcgctatcgcgtccctatgcaagctgcgtgacgccaaccgtgctctgctggtgctgaggaagatgcaggatgcggggttcgtgccgtgggacttcacgttcaactccgtggtggatgtgctcgtgaagggagggaggatggaggaggcgctgcacataaaggatgagttgcttgctacggggaagaaaatgagtgtggttctcgcaacaacgttgatgcacggctattgcttgcaacgggaggttaggaaagcgctggatatattcgaggagacactaagggacggtctggtaccaaccgatgtaacatatacggtgctgatcagaggttgtactgaagaggggatgccagagaaggcctatgagctgtgccgccagatgagagatcatggattgttgccgagcacaaatgagttcaatatggttatcaagggccttttgaatgataaattgtggaaggatgctgtaagcttgttcaaggagatggctgattctgggataccagatgccttcacatacaatatactaattcactggctctgtcagcgtcgcaaaattcgcgaagcgcttaacttgtgggaaaagatgaatgaaacaggagtgaaaccatatatcgtgacataccacagcttgttgttgtgttattgtgtgaatgggtgcatggatgaagcagtcaagctgtacactgagatgcctggaaaagggttcacacctaatgttgtcacttacacaacgctgatgaaagggcacataaataaggctgcttttgacaaggcttatgccctccttgctgaaatgaaacagaatggagtctcttgcaatgattatacatacaacactctcataaatggcctttgtgtggttggccgagtttgtgaagttggtgaaatgctgaagagatttgaaactgaaggttttgttccaactgcaatgacatacaatagtatcatcaatggatttataaaagctggcatgatgggctcagcatttgctgtgtatcagcagatgtgtgcaaaaggcatacctcccaacatagtaacatataccagtttcattgatggatactgtaagactagttgctgtgacctggcactgaagatgctaaatgatgtcaggtgcaaaggctcttaacctgaaatcgctgcatataattccttaatatttgggttttgccaagaggggaatatgtctcatgcactgcaagttcttgtccttatgctgaaagatggtcttttaccaaatatttcagtctacaacagtttcattacagggtacaagaatttgaaaatgatggaagaagctttgagattgtacgagaaaatgattaaagaaggaattgatcttgatacagcaacctacactaccttaattgatgggttctcaaaagatggcaatgtaacctttgcattgaaactatactcagagatggtggctaagggtaatattcctgatcatattactttcacagcattaacacatggtctttgccgcaacggagatatcgatgatgctagaaaattattggatgaaatgaataggttagatatacgccctaatgttttgatgtacaacatgttgataaacggatacctccgtaatggaaagctgcaagaagcgttccggttgcatgatgaaatgcttgaaaggaaaattatgccagatgatacaacatatgacatactagttggcatgaaatctttgggaagtgacagtcccattgacgcggagaatcctaatttaagttccacaggataaggatcaagagctggcttgagaagattaaactttccattgtatggccagtgtcagattatgagttttgctatatataaagtgaaatcttagctatggcaaatagaagcaaaggtaagcattgagattcagttactaacaagaattcaccttttattattatgtaatctctattttaccattggcactttgtgattacttctgtactatacattaatttgtgtccaatcaatgtacatgattttccctttttggtattattgttgaacttcgcaaaaaaaaaaaacacttagagcttgattataaactgcaactgataaatttatcttttatgtgaccatgcccaacacatctcaagtaatggcgtctggttgggcctgccttgaatggtcaataactcaatatatcctctgtaaagaaataagtttgattgctattcatgaccttggtaattttgacatgtttaatatctgcatgagttgtttctagttgtactttctgatctattacctatttacttgctgcattcacaagataagagaaatggcattattgtcggacctcaaagatccataatgattaatatagggtactaactagactggagacttatgaggaatcctaatcttgcatagataaagggatgaaccttgtttcctcatagaattagcagaatggatcaatgctcttctgggctgtagaacccgacaatagaggaaagattcacctagaaagtttgcttaacaccaatagagcaatgaacaggacatcgatctaacttctatgccaaataaatttaaaaaatactaggttttgtactgtcattgacttctggtgtttcagaaaggtcaattcgtcaggtaaattgtattgagactttcaaatttctgccattttcctaaggtaaaacacgatgtgtgtcctcaggtttttgttgtgaacaaatgcttacagttaaccagccaatgatgaaatctttctaaaagcatgcatgatttgtgcttacaattagcagaatggatttatctgtgcagtctgcataactcaggctgttgtatcggcactgtcaaccttgaggggagggcaagcgttgattgagctgaggatggtgaggggcgtgttgctgtggtgcgcgagtctgttgatcatgttgtagaacatcacccttgcctgcagtgtgctccctcaccaaatccagaaattcatcataaaagaggatggagatggagacagatggagcagctcatgtcttgattcacctgatgctcactacactcacattacctcctctactggttgttcggagaggcaaggggcggctgccaagagaagtaactagtagaggatgatcaatgaacatctaaggtatttctaccttgccttgcattatattccataaaagaaagtgtcatctattggactcagattttctacaggacaaattccataaacaaactgtgcagtacaactctctgtctggtagcaggtataataacaatatggtaacgtgtacgtgaaaatagacatgacctattaaggattttctcacctatatagattgaggagggaaggacacagtggctgagagaatattacagtttcttaaaagtcaacatcaccctcatcctggttaacttcactgccgttcctacacatgattcatattgcgtcctcttttttcctgattaatcctgtgttactgtgggttattactttcttctgttttctctaaccccgtctgccagtgagcatatgtgcttgtttttatgtttatgtttgcgttgtgctatcttcggcatgctccacctgtggagctgagctgccgacggatgcatgtgagtagcaaggtgtcgctgcgctgggcgttgcggacgagcctgcattgctgtcgtgatggtttctctcaattcgccaaagagtagtccttttttttttttttgtgtgtgtgtgtgctcccttacctgtgccaacttaaactccttcattgctgtcttttttgtcagtaactacatatcatgttaacttgcttatgccagatgctcaatgaacgctaatcaaaggaggatatgtttgacaatgggacaaagtcttaaaacgctgtactggctaaagaagaacaaatatatggaatattggaatcatctgccaggcttctctgggaggtacctccaattgaacttatttatctgtttgcaaattaaatggtcttctcttatatttgacaccgcagaagaaattaggcatccagaattttgttgtgattctaaaatcttgctataccattttgttatgcagcacatctccattcttgacagcttttcactcgtgtccaaatcataacgattttaccaaatataaggattctagaaagcttcaaaggttatggtttgtcgttgcaattgccaatgtctatactatcgttcacctgcctactgttgcctacaaatcaatagaattattcacaacaatcgtctgaggtttgtgactgtacagttcacctggatgtttgcacataacccaggtaatgctatttatctgctttggacgcagtatacgctgataaacccattactgagaaaagcactccttttgggctgttgcatgcatgctgagttatttgatgatctggcccttgtttagatcagtgctgctgcttaaaaaaaatatctgctctagagaccaggaaattcaagtaggctcatgaccatctgcagtttggttgttgtaaaaatggtttttgtttcttgcataattgacacctattaagtatttaaattacatcctcaacaatatattctacggatggttcatggtgcttttaaatcttcaatactgttcatgtatatattgtactccctccctccatcccagtttgatcatcacataagatttttttaggttttctcaaaatgatcatcataacaaaaaatattttgtttatttgtgcaaagagtaaatccgcatcgtgaaatgccatgcaacaaacattctattggttcaatgcatataacgtttaaagtgtgaattaatttttgttggacatgaaacgacaaagcaccttaatcaatgaggattaatttcacaatgatgatcgatgaggattaatttcacaatgatgaatgttttggtgtctttgtcttggtgttctttgcttataagatgatcatattgggatagtaagagtattgctttaagtttgttgcatagtagtacaacttaaggaatattcccaacaagctactactttcttgtaagtgaatctcaataagctgctacttggccatactattttcgtattccctttgtcccttactggtatgctgcccgtgggttaaatcttaagactagcaaagctgtaaggctaaatataaatgtgtgtttagctccacatgtcagcacacacggtcctccatgtgggaaatggggataattggtggaatggcctttcccgctttacataatttgagtggttcttcccttttgtctccgagtatgcaagttttccatgttagatgtagagaccagtttaattcattgttagaaaaaaaatgtattgaatcggtacctcaaatctaaaggatttttttttcatgtgtgcaaatgagccgtctaatatgcacaagcagagggatatacagataattctccaatgtacgtgtgatttgattacatccatgtcctgtacctgtacgcctgtcttaacatatatatggccattttccgtgccacttcagcaccaagtttacatatcttcaattgtatctaaatgatcaaggggaatagggttgacgaaatgactctcgaacatatccttcaactcgtggctattggtgtagccgtccctcttgccatggaagaggagggcgatggacatggacacattggcgatccgctgcacgaacgggaggtacacgcggtcctcaaagcgcgcctggtttagggttctccatgcgccttccaccatttcacttatctccgcctccgcgacatcgcttgtcacgccatgctccttcatgtaacactccacggcattggccacgtccatcttctccctcccattctgcgtgccacatattataagtatgctatagggtaatggcgaacacaagattttagctatagggtacaccactactaaaacatatagttaaatagaaaaagaaaatatagtttccttgccgagaaaatcaagtgataattttgacactagtgcaaataaagatcaatcatgaaaaaaaaactctataaaacaactaagaaaaaattattacaagttttaaaaagaggtttatttgatttttttttaaaaataaaaagttctagaaaaaacacaatttaacaatttaaaaatcataataatagaaaacgagtaagttatagtttggagtagagaaaataacaatgcattattagttcaccatgaattggcttatatttttttattcaaaataaccacattgcccctggcatctaaactgaaaactttccatatgggaagttcatcaaggaaaaaaattacttaaatgtttttttcctaaataagatgaactctgaccaatggaatttcaacactcaaccaaatatgaaaaccaaaatttataacattcatatataaagttataaacccaagagtgagcgatctagctggcatacatgcatgcatattagtactagtaagtattaattaattagtacctgtgatacagccaaatcatccatgaaacgtgacacctctccaaaggccctgccagcatcagcgtaagacaaggcccaatcaaaggcatccttggtagctatgtcacccatgcctacgattatactgacaggtaattctatagcacctccggttacgagggacacggtcgcatgctctgtaaagcttggaatgtatttttgatggaaccactcagcttcctggaggtaattgttggataatatttgaaactgcatgtggcaaaaaaaacagagtataattaagataaatacatatttttgaagatgtatgtattaattcttaaagttgctagttcagatttttatacgtaggagttgattgaaaaaacaatttcttttttgtccatttctgttatggacgattatctatttatccatttctaaattataagctgtacataactttgttgaaaagttgtatacgacgcttcgtaccgctttaatgttgtaagcattacgatatttctcatgtggttccaactcatcttcaaagtccctaaagttgctcataatactgagaaagaacctcttcagcccctccggtacaagtgaaacagcattcttatcccatctgcattgtcaatttgagaaaatatgagaaaaccatgatgattttatcaaaactattggttatttgctactactttgggtagtatcttagaaaactataacgatagttgatgattttcttatacaatgggaaaaaaaactgatttgcccctctaaactattgtgttcatcggatttagcgccctcctcccactcccagaaaaaaaaaaactataaaccctatggtacataggagggggtcaaagtgggccaaaaatggaggagacgaatctgattgctgctgctcttcatcccctcctccctcaccttccatcatggtctactggctagctacatgggtgccagattgcatgtttgatgagctcatgctcatgaacaacagaagaagatcctttggttgtccctcttagaacaggtacaatagcaagctataatctcatatcgagaagaaaagagaagggagagaagaaagcggactacagatttatagccggctgcaacacgaactccaagacgttatgcgtggatgagaggtgggaccgagtattaatggtatagtatatttttatagttaactattgtatgaatggctattaaattagctatagttgttttggagccaacagttggctatactattaaactgaggtttagtggcatcagtgccgaggatgctagtcattggctgacacgctttggtcggtagcctcctagagcctattgcattggttgacatggagagcaaaatcaaaaggaattgaagaaggtggaggtgatatgtggggatcggatgccatgcaggaccaaaattgtcttgtattggactcatggtgtattttatctgatattaggagtttaggaggatcaagcttgtggtatcataggtagagcatgtgtaaataggacttttcccttccaaactaaagtagagatgcaaatggttaatcccgctacccacgtaaaaatccgcttactcattttatatatgctagtacaaaatttggaagaaaaaataaactacaagtgggataagcaagtaaaaaaaataccgctagcccgtcccacttacatccctattccaaactaggcatctcaacatccttatacatgcatgtattagttctcaaaatgaagggaataagaagttgacctttgcagtgcttcattgaacttccgagcctcttccaatgtcgcatgcacatcataggtatcatcaagtagagaaattagcataattttcttggcgagcatcatgcgtgcacgtgcgtactctttctcatagtacacaatgtaagcacaaaagtaacactcaaccacacgatcgcgggtgtagtctaggttaatgtcactggaaacatccttccaccacctaaaaaatatattaaatataaattaattctttttctcaatattatgattagtaatgacattatagagtgattagaagacttgccgacaaatatgcttgagttccttctggtgaagtttttgtaaaatgttaaaatcaagcttggctagctctgaaatggatgggttaaatgtatgctcttgtgcagtatactcgaagataaaatttagcgcctctactctcttcaaggtccttggtaatggtatttggagggcacgctttacttgttcagccagcgggaactcaaggctaccacttaataattccaggtgatgggttgcaaataagatagcttctttgagtgccctctcattatgagttagaaggtaagctgcatggtacaaacttaacaagcccttcgggtcattatttatgtcactcttgaagctcccatcttcacatttgaatttgttgaattcgtctgtgtatagcataaaccataaaaattcaaatacgagtactttagaataattaattttatatcttgatttatatatttcttcttgctaatccctgaatctataggagaccatattcaaggtttgtatggaaaacaataacttcaaagaatttttccattaagaataaaaaagatccccaagttttaaataagtcgtagtcaaagtgttatgtatgccagttatttcattcccgaacataaatacatacctggtgaaacccaatacccttgttgcctcagcaagcgaaaccgaagagcaacctcatggaggttagagctatagaattcaatgctgtgaatatttcttagagtggtgttaatctgctcctcaaaatgatgttctattcccaaacgttggagtacatcgaccaggttcatttgtttcaccacatcatccctgcaagcttcaaacattctacctatctgctctactaactgttctgctctctcttccatccattcatttgactcctgctagacacatggaagcatatataacaaacatgacatagagtggatttcataaaactattattatttcgttaaaattgttactttgatacaacttcagcacgatacatattttgttatgaaaaagattataacaagaccaaactatctagcacggattaaataacgtgtgtgcacatatatgtatacatgtccatgccttgagtggttggttgtattcgatgaagaagtcgccgaatatcgttgggtggaaagtcggtgccatcttactagcaatgggagatgacggcgctgtgcacttgcaaggcatgaggcgggcggcgtgcagggaggacagcagtggatgacgtatcatcatccgatgaggaaacgaagggccaggatgaacccacatgcgctgccagcaggaggcggtaggccacgctggagctgcagtgggcagcagcaagagggaagccatgtggctcttcatcccgtttagagcaaaagtgtacactgtcgagtattatgccttagtgtacctagctagtgctggctgatttggcagatgcaatttcaaaggagatgtctttttatagggcttcaaaaccggacgcttgttaactgaacccgaccaaagatatttcaaaatcgcttttgttgtactaaacccttgcttgttggatccagccacaattttctaattggcttttaaaggatgaagagaatacgatttgtagccgtcaagaaagttctcaaagaaaaaggcatcgatcgagaaaatacactccatttatcctagtttgatcatcacctacggtttttgaagtctttcacaaatatctctttacttatttatatgtaaaaagtaaataagcatcattaaatatactacatgcaaccaaccaagattaattcctattggtacaactacatgcaatatttaaaacttgatacaatccacgtgatacgaagcaacatattaccttaatcgatgagaattaattatagaatgataaaggtttagttgtccttggtctctacgctatttgcttaggtgatgatgaaaataggacgaaaggagtatggtgcacttatccataattatatatatacagatccgtttttgttagaattttagtgtgggcattgattaatcgacgcttttaattactaggattttgatatggtcacagataaatggttggtgttcatccttcagtgtatggtaattaaggaatgtgtaagagtgtgtatttctttgtaataagatatagggtatgtatatagataataataaataagctagtccagacaacaccatataagctaggaactatggaaatgggaggaagggaggaagagagagaggaaaccaaataaaagaagtattattccccttttatctatcctaaggttttcttgctactgtacttcatccgttcatattgtaagtcgatttaatatttctttctagtcaaacttttttaatttgatcaagtctatggagtttaacaatatctacaacatcaaattaacttaattaaatgtaacattgaataattttgataatagtatgttttgtgttgaaatgttattttatctctgtacaaacttgattaaactctacaaagtttgatttaaaaaaaatcaaaactatttataatgcatcagtgagggcccaaactctgccccgccagagatgaagagcttgttcactttgctaccatttttaaccttatcaaattttggtattgccaaattttagtaatgttgccaaaattttggcaaggttatcaaattttggcaagattttatatgtgcttattaaaatttggcaacaaactaaacgtagccaaaattttagcaactttaccaaaaaaaaatggtataattgaacagaccccaaaatccgttttggggaaaaacggcagtcaaagaataattttcactgtaagtcggtggtggcaacatttctaccatgcatggaccattattcatccagtcagagactttctactaattttcactgtcagtcagtggtggcaacatttctaccatgcatggactattattcatccagtcagagactttccactaattttcactgtctgtctcaattgttttgagtcaatattgactcaacaattgtccttcgaaaacgtagaaagcctgactgcgtcgaaaattcgatctctaccactgatcttgtacttggagctattgactattcactactcaattgttggctctttccatgagcatgaactatttattattcatccggtcagactttctaattgatcagtttcttgctcttgccgactattcatccagtcaagaaaacgtgaaagacccgagactttatatatacagaatatgtgacaaatcgttaggcacacatccttgtatgatcaaatactgttatatttatataaatagattcctacaaaccaaaaactgggtattacgaaaattagcaccacataattttactacatatggtcgattatagggtcaaatgaacatcgactggtatatatccaaaattgttgggaaaattgtgggctttaacatgtcagttttatgcggctcctgcggtattgtaccgttcgtactcgtgagctttttttgatgtgtaggttgtttctatcgttagtacagtgaatttctgttacaggcttatactactgtggtgcagtaacgaattctatctggtatatcaaccaggtaataaagaaaatatatttttagtaaaaaatattggttcttcttaaggcgcgttctttggttcagtaacgtttcacatctaggtcccatgtaaaaaaaataatatttcaatcacccgtgttatcctcccgtgtaacatactaaaaatttattactaacaaaaatctcaactgtttgattaagttaattgaaaattataaaaagttaagatccaaccacaatatgactcatacgtgtttgtaaaaagttcgtaaaacaaattagtatgcatatcgttctcctttttggagtttgattttttttttctctagtgtgctgtgttcggttttttcgcccacggttcgattttagctcaggaaaattctggtgttacataatcatggacctacttttgttctaattatgaaaacacgtcgttttggatattggaaaatctaactttgatcactaatttttattataaggatttttagaaaacctgataaattaatgattctaatgtcatatttttgataatttgacttgaaaattcttgaagatgacattatccttcgttttctggagcgcttgcgtgtgtttctttttgggtccaaacagagattgttgatgtccccaatgtagccggatccgatagcaacagaagctttcgtttgtaactgtggaaatcacacctctggtatacttgaccgacgacttatgccggccagcttcagcttggattcttgtttgttgaaacgcacaaatgtgattaacacaaagtacacgtgcttctacacttcgctgatcatattcatacaactagtggtaataaagtcctaagatagctgacaacttttctttgttcaacaggccactgcacactgatcagatcaagatatatactgtgcagtacaatacatacatactcactcaggaaaaatgctcactcagtcactccgtcctataaaaaacgaatctataatcggatgtgacgcatcctactactacgaatctgaacaaatatactctctctgttctacagaaaaccaacctagtaccggatatgtctagattcatcgtagtaggatgtatcacatctggtcctagatttattttttatgagacggagggagtatatccagattcgtagtaccaacttatgtcacattagatttggtttttataggacggagggagtacataactgctccattaattttgagctctaatatatgttcttaaattttgagtttaaatttcaaattgattttaatgtttttaatgtagtttattttctagcatttacttttatgttactaagagaacaaatataaaagtttttatctatttcttttatcgttaacaagcattacattttataatccgttgtaggtgagtagtcgcttttcttcatctcgtcagcttcacttcggagaggcgtctatggctgagtttttcgcgtacacgtttttcaaactactaggcggcggtgtgttatttacaaaatttgtctataggaaagttgctttaaaaaataatactaatccatttttttaagttttgtttaactaatacttactaaatccgtcccaaaatataataacttataaccgaatgagacatttcctatctatctagattcatagtactgcaaaatatcttctctgattctagattcttatattttgggacggagagaattaatctcctaatcctttgctttgttctccgtgtgagaggactaagcctatgtcgagcatctgccgaccaatgtgtgtacggtgtactggattcctggaatgatcatttttagataatggattttcattaatccggtctctatatccacgaaggatatacacagctaaaaggatacatgagtacttacactcccacctcaacaaagaggaaaacacacaaccaaaaaacaaaaagaaaaccaaacaacctcgtgacatccctgcttctctgcgtcctgccatattctcctgaaacggccagatattacaagtggaagttgtctagtcgccgccgcccctagtgcgccgtcgatgcaaacctccgttggtgccatctttatctgtttcaggtaagctgacgccacacgccgccagttagcctactttcaactgtcggcattcgccgtttagccggaaatagccaaccacacacgaaccgacgggatcggcttccacttcatcggattcacagtgctcagactaccgctgtcctaggccgccgcagcccctagggctgtcgacaccggtaggagccgtcgtcctcttggaccgccgcagcccctagggccactggcgccgacgggagccgccgtcctccgccgcatctcctagtgccgccagcgccgatgggaactgccgccgccccaagggttgccaatgccgacgggagccgctgggccaccactgcccctagggctgccgccgccactgggccaccgccgtgcttcaccgcccctaccgctatccggagagactccatcgctgacgccttgccgctccccaccgccctcccgaccacctccagccatccctaacccacacggccaggcgcaggcccggctgcctctggccaccacttccgcacctccgcctcccacctccccactgccaccgtcctagccgccgcgcagacgccggtcagctctggcggcggcggggctatatctggctgggagagaggaagagatgcgtgagggagagtaagagacgcacgcgtgggggaaaggaagcaccccctctcacctggaatgattatagtactagaaaatatcttatttgattctgggctcttatattttgagatggagagaataattaatctcacgctaatcctttgcttcgttctcagtgtgagaggactaagcttatgtcgagcacctgccgaccagcgtgtgtatacctggattcctggaatgatcgtacgtgcttctcgatcgctgcggtcatcccccacagatcgatctcaaagagtcgatgagagaccaagtgaaaaaaaaaagaatgacctaatattaaataattagaaggggtaagacttcaaaccagatcgtccagctcgctactttgtgaagctagccggaagacttctgttgtttctcgaccaagtgaaacgaattgatatgatatattgggctggctagtgcgcgtgtggagggatccgtcggattcggaaataaaagtatttaaatcgcgcattgaagcttctttttttattcatctcacaatcatcaggataaaggcccgcgcggcgtcgttaacattgagtgcaaaagtaatttcatttagcgcttagtttacataggtcaagtgtttttcattagtttaattacttcaaaaggaagcattggaaaggtagttatatcatgaccgtgtgtcttaaacattaaaaaacataggatcacacgtataaatactatggcaacaattggtctataaataattagcagtcaattaatatattatcagtttatttaaattgagaaaaattgaagcatataaaattcgaccaaattttatcaacagaaatgaactgatatattttttttggggggtggggggaagacccaacgtgaatgaaatgaaacgtcttgtgagcaagttcccttctttgcttcttgcctcaactaatgtattgtgtttatttccttgcaagtcgaacgcacaacagattagcggccccattgttttacatattcgtggaataaggagaacggcacatttgcaaataaaaaataatttgtgaataaaacttttatatacatgttcttatcaatctcaaagtaaggctggaaaacaaactttgatgaaaataccccaaatcatcttcaaatttaagattaaaaatttaaattttagctgataagcataagcataagcgaaaattctataataaggtacatcgaagttatcatataaaccgtaaacagtcttaactgcatgcttcatggtatgaacgctacatttaaagacaacttctatgatgtaaaaatttcacagaatggcaagtcaatcaactgtgttagatctggtagacagcatccggacatctggagtgcatcaaaactgacagtaggtaggtgttaaaagcattaaatttgtcgctaacatgcacaagataatcggtctcatcttttcgtttatacttatatttatcaaccaaaatttaaattttcaactttaaatttgaaactttgcgatttttttctcatcaaaatttatttttcagcctttacttttatatcgctaagaacacgtacataaaagttttattcacaaattacttttcatttgtaaatataccattctacgaataaaccaaacaatgggggccgtttaggttccagaaaaggcgaaaaatcatgcactagaattttggatggagggtcttctgagattttgaaaagcttcccatggtgatttgtcagcaagattttccgccagcccgaaaagtagacagtttatgttaattattatatgagttctatatgcatggtcactaggaaagatgcaattccgtaataaggtacattgaacttatcatataaaccgaaaacagtcttaactgcatatggttcattgtatgatttgtatcaacgctacgtttaaaaaagaaaacttgtatgatgtaaatttcacacagaatggcaagatcaattaactgtgacatccaaactgaaagtaggtaagcatcaccaacagtctatctattccatccccaatcctattttttttggattttggttaaaaaaaactgatccaacagattcccaaaagagctctggatgttttggagttccgaaaaaaatttgaaaatatatttttatttttcatattttgcatttatatacatgtccgagattaatttgcaaaaatatacccaatccgcatattagatgcgcgggagcgaccggtcccataggctggggatgcggtatcgcacctgtcccgcaggaagtttgcatgccgagcgctcccgcatattggatgtacgggaccgtggctcccacacgcgtcttctcccaaattgtgaatacatgtcccgtaggaaaaacggagcagtatattggcacgtgattaattaattattagtttttttttcaaaaatggatcaatataattattttaagcaactttcgtataaaaactttttgcaaaaaaatgcaccgtttagtagtttgaaaagcgtgcgtgtggaaaaggaaggagatgagttggaaaaattaggggaataatacagaaccggatcgctccgcatattggatgcgtgggaccggcccctctctcccgcatggcggatgcgcgagactgccactccgtcctttccaaattgtgaatacatgtcccgcacggaaaacggagcagtacattagcacgtgataaattaattattagttttttttttcaaaaatggattaatatgatttttcgagcaactttagtatagaaactttttgcaaaaaatacaccgtttagcagtttgaaaagcgtgcgcgtggaaaatgaagaagatgagttggaaaaaattaggggattaataccgaataacacgagactcgctcggtaccgcgcgctggaaccacgggaccgcgcaggtcccgcgccgctgttatgcggtaccgccgcgctcacctgcggagctgacgtccccatcgctcccgcgtatcggtgccgcggtactgactcggtcctgcagtctagccgtgcgggaccggttcggtcgcgcatctcggttccgcgtgaccgactcgggttctacgtgaccgactcgaattctgcggttcgtcctcgctcccgcacaaccattctgcggatcagatatatttttgcaaattaatctcagacaggtatataaatgcaaaatatgaaaaataaaagtatattttcaatttttttccttggagttcccatctccaattttctcggtacgtgtatttgagggcgagagaacgactcccaatcccctccttccgcgcgtttctcccctccttccgcgtttctcctgtccttcccgcgtaagggatctccttctgcgcacgggaaaggaaaaaaaaatagaatttctgttggtagtttaatagaagggcccacttttagtttttttagtttttgaggattgaatttaggctatctcttggaggaaggggttttttcaccatctattttcagtttaggaaaccaccaaaaattaaattttagggatagattattggtaaaccgttggtgatgctcattaaattttgttgctaatatgcacgggataaaccttcagtggcaacatctgactgcatactccctccctcccaaaataagtacaactattaatttccatatacaactttaatcgtccatcttattttaaaattttttaataattagtatttttattgatattagattataaaatatgaatagtactttatgcgtgacttatgtttttcagttgagcacggaaactcatgtgttgtgcttattttaggacggagggagtatatttggtgagattatggccctgtttagttcccaagacaaaaattcacgctctaacatcgaatgtttggacacatgcattgagtattaaatgcatgaaaaaaaatcaattacacatattgcgtgcaaattgcgtgacaaattttttaagcctaaattgcaccatgatttgacaatgtggtgctacagtgaacatttgctaatagcggattaattaggcttaataaattcatctcgcagtttcctggcagaatctataatttatttttttattagactatatttaatacttcaaatacttatccgtatatccgatatgacaatcaaacctaaaatttttctccatctaaacaaggtctattgtcacatgacttcagctaaggcgatggataaagcaaccacctgggcaacgtgggaggccctaccatcgtggcgaagccaccgtggatcttcgactaggcctgaggccaggcccatgagttgcatcgatcgaatcgaaccgtacgggttagtggtaagcgaaaactaattggtactccccgtcttgaaaaaaaaaatccaattccaaagataaatctagacatacaccatatctagattcatctctagaattaaattttttatgggacataaggagtacacactaacatacgtggtgcaaagtaaaatggttcaacttatacatgatgcaaagtaaaactgttgaatataccctgtgcaaaataaaatttactcacttttttaaatatataccagtgcaaaactcaagaaatccatagtactattttgcaactgagggagcactaactaagagcatccctaggagatcctccattcagaactccatccgagatttagcgtacgaaagtgaaaaacggggctccagcggacacgccatcgagccatccaaaaatagaggatgcgccaaaacggagagagtaaggccaaatatagcgtttctctctccaaaagccatatcacaacggttgcagctcccgccctcatccagagttccgtgacctcccctccgtcgtcgtcgtcaccggacggaaggggaggatggagagaaagaggcataccagatccagaagtacagtgtcgctagtggcaatcatgctcccttccacccctccgtgcccgtcgcctacctccgcccctcggccgccaccactacttccgcgcccgctggcctcctcctccgcctccgcctctgtgcccctcggctgttacctccacgtccgcgcctgccgaccaccgcctctgcttcaacacgcgctttccaccgccgctccacctccatgccatgctgcttcgctatgcccgcgctctttgcccacccgaccgcatcgtttatctgttcggctggggttggggtctcggggaacgatgtttatttgttcttttctttttttttaattttagttttttcttctttgatttaataataaacgtggtagttttatattgatatacgtgagagattaattagtaactatcaggtgaaacatgtttagcgaataacaatatttcttttaactaatccaggctaaaaaaacgtacacatagcaaagttggttaaaaattatttttaaatatatgacaggtgttatagagaatgtaatatggatgatctgttggaaaggaacaaaatctagagaaattttttttagatggccatccaaaccgagatatggagtaccaaatttagagagtgggtatgctctaatgtcctcactcatccacaacaaacctcgtatggcagtccaacctggttttcggagtccaccagggaggcctaatttcagagtccaccaactgagttgcagcacgaaattaaaacactttaactggattgttggcgtggtgaaaagaaatttgtgggatagagggacttttggaaggcaaaatttgcaggcattacctccaatttacaagcaactttggtcgggatatttaatcaattcaattaaagtcaacagcaagggcaatcccttgtgcaccaacagtataacagcaagaaaaacaaatgagaaagaggatttgaccatgtaatttgcagtcttttgtcaagatgatggcagggattcttcttccattctgtccacatcaggaagagacaaaccgcagcttttgcagggattaaaaactacttgtatcttgcagctttgtgcagaatttaggctgttttttaattagggtgaaaagttttggcgtgtcacatcggatatatacatatatctagagtattatagactaataaaataacaaattacagattccacctgtaaactgcgagacgactttattaagcctaattaatccgtcattagcaaatatttattgtagcaccacattgtcaaatcatagaacaattaggctattcgtctcacaatttacacgtaatcggtataattagttatttttttgtcccagaatataaatattttagtatagtgacaagtcaaatattgtttaactttgaccaataataaaaaaaataaaaaagatcaatcatgtgaaattgatgttactccctctgtcccacaatataagggattttaagtttttgcttgcaacgtttgaccactcgtcttattcaaattttttatgcaaatataaaaaatgaaaagttgtacttaaagtactgtagataataaagtaagtcacaaataaaataattaatcatttcaaaaaaatttgaataagacgagtggtcaaacgctgcaagcaaaaactcaaaatcccttatattatgggacggagggagtactatatttatcattaaacaaactatcataatatacaactctttttatttgatattgttgatcaaattagtatctcgaagaccgtgtcagggtagaaaaaaatgcttatattttgggacggaggacagagggagtaacaattagcaccttcttcaccaccgacttacaagaggagaagaaatacagcagccagctgtagctttgtgcacgagttaaaaatgtttcaacctgcataacgcaaataagaggtaacacacagagcaaacaaatatggaagataattttgctcggtttgaggagaaggggatagagaagaatgggaagatatgcaaaacgaggtgagctattagtgcatgattaattgagtattaattattttaaattttaaaaatggattaatatgttttttaaagcaactttcctatagaatttttttgaaaaaacacaccgtttagtagttcgagaagcgtgcgtgcggaaaataaaacaaactttctcacactgtcatgctacctaacgcagaaaatcgcagatggcttactgacaattagggctattaaaaaagctcggggctcgtgagttgcttgagctcgacttgcccaaggctcgattcgagctcggctcgagctccaaacgagatgagcccgagcctatcccaaagctcgcgagccgagcttgagcttctatcgagtttggtaatatataattttttttgttgctatttaataaattgggagatcaaatatgttatttgtatatcctgtattggcatcatatatttattttattctttacaataagatatcacatgattatattcttatgaaagaaaaatatacgtttcaaacaataaaaacataatgtttcatgcgtgatagcaatatgtctcaccacgtgtcatgtgtttttattgtgtttcgcatattttttatatattcccgaggcagatttctctgttacatcatgtattatactaatagtcaactgaaacatttgacctctatttttttttacaacatctaacgtctgatttgtagctcccacaaattttatatctatatctatattatacctatctctactacgtaaaaaaagtgttttcgtggccagtacaaaataaataaacagcgaaaaaaagtccgattatatggtaaaaaatgcgcgagaaaaagaaagaaaaaagaaaacacgggaggaaaaagcggaggggcctacgcgtcagcgccacacatgcgtgcaataccactttaaactggtttttctcttaaattatttatccaaatcatgatccaattacaccattaaattcgttgtaattaaatctttaaaacaagtccacacatggatatgttacacgatgttccaccaagtatatcggaattgtttcactaattagattgaaaatgtttcactcgtttaaatcggacattgtttcaccttatataaaaacaatgtttcagcaaatagcgaaagaaataaaacattgtgagtaagctagatgaaacatttttggtgaaaaaaaaaatgaaacgaattccattaatagatggtttccaaaatatgtggacgatttgtttcaatggagtatatggtgaagatacatggtaggtggtggcagagaccattgtagggccaggctcatgcatgcacgcgcgtgggggcggggccgcggg
